United States Patent 10,407,724 (METHODS AND COMPOSITIONS FOR SCREENING AND TREATING DEVELOPMENTAL DISORDERS) - sequence listing, part 79

SEQ ID NO: 2205 - DNA, 122351 bp, Homo sapiens
tttattttaaaaagttttattttggagatttagaaatttgagatttttaataacggcaaaagaaattcagtcacacctaatgattaacagaatgtagtggtgtattatctaaacagaaatcgtgctgatgtgccataataaattgtctattagtaaaaaaatacactttagggcacagcattgtatcacaaattacagtagggatactttgcaagaatttaatcaaactagagaattctgagtaactgtatcttttaaatgcagcacttaaaaatgtaacaactctgtgcatcctttttcttaaaaaaaatgaccttgcatgtgtcatagaaacgctgctttattgctgcagaggtcaaagttcaaggctcaagaggtacaggagagaatacaaaggtagcctttagaaacgtggtcttgtttatgtataaaaaaggtaaagtttataaaagttaatttacaaaccaagaacaaaagtggtatgcacgcattatgtacaagcatccttaaaacatcaaaattttcaaatgcatagccagaaagaacagaaaaccaccactgccccttgtcaaaaaaaaaaaaaaagaaaagaaaagaaaagaaaaaaatatccccaaatcacaccactattttcttctgggtgataacacatttctgaaaccaccaaatgcacaacgtactcagtctttgtcatgatacagtatctagataatgcacaaaagccataaaaacttagtaacacaaggagaatgagctaagaattaagaacatgagggtaaggcatttctgctggttagtatgtctgtggtaatatggtgaagttagagatctgaagaggccatggaaccagtctcacatgcttttgtatccttccctaagaaaaatgtgttttcatgtacagtaagtcattgtcttcacttcaccctcccccagttgtaaatctccttgctgtacatttctgttaaatccacaacactggttatatattccaggtgcatttaaaaaatgtgtgcatattacttcatgcataataaaataaaatgtgtacgtatgctaggccagggccatagtaaagtttgaaacagtgtactttggaaagaacagacctcaaatgcacccccatttactggctggtattttaacggaaatcaatatgtgaagttaagcagtgacgataaaaaaattacaaaaatcacaaagcaaaatatctttgaacctctagccaataccaacagtcccgtcaatcacaaacatgcagtgtgtagcatgttttccgaccatggttcaggggcatgctcactcatctttatcagttcaaacaaatgcctcatactaacaaactgtagtatcaactctaaaaaaggtataatacttgatagagtggttccatttagattaagtttaatccagtttcacattatttaagttcctatatttcaagagttaaaagtggtcaataaggacagaaacacagtttgctccaacgagataatttggatctccgggaagacacttgttttgccaggttttaggatcacctatgagagaaaagaagttgatgtcatttacagttcagtaaactgctatccgtaatgctttgcaattatagggcaaatacgtatatttagacataattttcttctgtttcttcagcatattgaatttgtatcaaaacacattgctgtatttcaaagcagatctgctggcatctaacaattccaaaggtgtttcacacttctaaaaaaattttttttaaaacgttctttctaactcacaccattaagaacagttttttgttttttgtttttaattttcagacttctcctttattacattatcaagtgcattggccttttcaaaaaatgaatacaagtgagtgatggcaatcttatgcctgggacagtcccagtttgccagagcccacataattatcagtagcactttttttttttttccagtttcgaaagtctggaggataattatgtgatcacctatttgagctgagaatgaggacacatttctcacactcaactataaaccaacaaatgaagcccagttctgcagaatctagttcttgaagactgtcttcccccttacaaaaaacaagcaaaaaaacgagactgcaccagagctgctcagctctgattccagctggacaacaaaattaatcatgcagcttcaaaaactcattgactgggtgttagttaggtctcaggatttaagtttttaataagctcttggtgatttctattagatgtgaaggcagggacgactatatgtctctgtggtgtccaagcaagctgagagtcacagctgtggacgtttgcttcccttacagaagtagctctcaaacaggaatgaccctgcccctgatgggacatctggagacagttttgcttgttaccactggcatctaggggtagaggcccagggaagctgctaaatattccacgacgaacaggagggccctacaacaatcatttggccaaaatgtcaacagtgccagctgagaactttgcttacagtacgttagacattacctaagcaatatctggagccaaaagcatttcatttttccagaaaatggggtacttgtaaatatgaggaaatatgtatttacatgtaattttttcctctgataacattaaaatatgctcttgctataatctttagaccacaaacttttatttcatactgtaccaaactaaaactaaataatgctcatctgatttatcaaagatttggaagctagactttaaatcaggttcgcttaaagtgatctacacccaaaataaaattctaattattaactgacttaagtcactcaaggaagtgagaaatgtgaaaatgcagtggaagctttgaaattatctcaggagaaaaagtcatttacaaatagtgtataaaagaagtaatttagagtattacactgaaaaaccatggccaagtatgatcacaacggaagatcttgttaagtttctctggtatacatacgttgtagattaagaaattaaacaggccaggcacggtggctcacacctgtaatcccagcactctgggaggccgaggcgggtggatcactttaagtcaggagttcgaaccagcctggccaacatggtgaaaccccgtctctactaaaagtacaaaaattagccaggcatggtggtgggcacctgtaatcgaggctgaggcaggagaatcgcttgaagctgggaggcgaaggttgcagtgagctgagatcgtgccaccgcattccagcctgggcgacagagcgagactccacctcaaaaaaccaaatcaaaacaaacaaacaaaaaataaattaaacaatagtaaccaaaaatagaaatagttatataaaggaacaaagtcattttaataaggtaaaaatgcctatttgtgcaggacaatatctcccactgcatcctgaaaaatttgacagaataaatcatttttctgaacaccaagaaatagtcaatatttggccatattatcaaaaaaaaatttttttgagacggtctcgctctgttgcccaggctggagtgcagtggcacgatcttggctcactgcaatctccgcctccctggctcaagcaattctcctgcctcagcctcccgagtagctgggattacaggtgtgtgccaccacgcctggctaatttttgtatttttagtagagatggggtttcaccatgttggtcaggctggtcttgaactcctgacctcaggtaatccacttgcctcagcctcccaaagtgctgcgattacaggcatgagccacggcgcccggcccaaattatcaatttttaaaaggcagaaagtcttctacctttccatatttatttacaatatatgcaccacaaataaatgtgaaaacactggtgatgcctacaaggccacaggaacagagatagagatttgctaacacacagcatgggcagcatcatcagcccaggtattaatcaacgacagtccccaaagctcccaaaggacagagtgaagacagcatacccgacgaggagtcggatgattttagagcaaaagaccaaccgtcaggagtcatggacgcacagtgtggtaagcgcagctccacaggcttcaggaacttgaggccatggggaccacacatcaccaaaggactcagcagtgtttcacctggagttggaaaaggggataggcagagaggatggatgtggtctttcttctagaatcccagttttcctcaccctgcttctaattatatgcttgaaagcctaatggagttagttctctacagtcgcactgaccacaaaaaaacgtaacagcagccacatatggaatcttaaatttcccagtagccacgttagaaagtaaaaagaaacaagtgatatcaaatcttacaatattttaatattttaactcaatataacgaaaacactgttatttcaacatgtaatcaatatatgaaatctttggaacttggtgtgtatttcacatttccagcatctttcaatcccaaattgtcacacttcaagtgctagctagccacgtgcaggcagtggctactgcattcaatcatatgggtctataataaaaaacatattcaaatgtgcttgttgcgaatgtgatatattttccattttcaaaatgttttgtttgctccataggtggttaaagagattcatgcagggccaacacagtcagtcctactggtttttaaaacaggatatccccaaaatcagagtacagaatcagatgtcagtattccggcaaaatacaaaaaagcgaactaaatttgtttaggaagtaaaagcactgctaaaagatgctaaatcacaacacacttcgttataatatcctggtagatccaggaggattatgaaaataagtttccttaagaagctcagaaacatgctgtcatctcctctgagactccttcatgcactctgctgagcatgtactagtgctaggttctggggtgatgaataagacagtacctgtcaagaggtttaggttctccaatcaggtgaaggcacagcaaagcctttctgagtgggtgttacctaacccatctccagagacgcaaaggctgactgattcaaagacaaatttggttaggtcagcctaggctgctcagcaggtgagacatcccgtggcctgtcctatgccatcattttttatttcacaccaaaagtaaaagcaggcagtgtggtcaccacagccttgcttcaggccacccactgcttgcttgcaacaccgtccccagggcacccctcgctacagcactcatctggagatagagaggtgctgcattattagccaagcactataagctctgaagtgcacacagggcaactcttaagttatcaaaactaaggagaaaaataaacacatttacctttctctttatctaaaggtggaaggatgctgttgtcccggcagaccttgaaatagatttcctgctcaactccttcgggaatggctccttgagggataattatactaacaccagtttctatggaactcagcacgcccccattgctgttaaatatgcctcgggctgtggccaccacagtatgaccatcttcatcttcatcctcttccacagctgaaggactgaaagttcagaaatggctagtgagtgaattcctaataatacacaggtgctttgcttttactactactgtattacgtgctttcacttttatttctccatataatcaagaagttactttaacaagataagtttctggcaacagattttactgacagggttatcgcagagaatattatttcttttttgtttgtttgtttggttttgagacagagtctcactctgtcgcccaggctggagtgcagtggcacaatcttggttcactgcaacctccatctcccaggttcaagtgatttttctgcctcagcctcccatgtagctgggactacaggcgcacgccaccaagcctggctaatttttgtatttttagtagagatggggtttcaccatattggccgggctggtctcaaactcctgatctcgtcgtgatccacctgccttggtctcccaaagtgctgaggttacaggcgtgagccaccgcgcctggcgagaatattatttctagagaaattccattctagaaaatttcaaaaattctagagaaatgtcaaaaattcaatttttgaaggcaattagtcaaacgaccttcattaatgaattgcaacctgaaagtgtaaaatctgatgccttgaacacccaactacaggtgaagcatccctaacctgaaaatctgaaatgctccaaaatcggaaacttttttttgagtgtcaaaatgaagctcaaaggaaatgctcattggagcattttggcaatattccaaaatccaaaaaaacccaagatatgagacacttcagaacccaagaagtttggacaagggatactaaacaggtacagagttttatgaagcacattttaaaatccatgaaattggaactttaaaactggtaagtcacaatttaattggtagccctgttcttcccttcctgttgttttttgaaatggagtgtcttgctgtcacccaggctagagtacagcggtgcaatcttggctcactgcaacctccacctcccaggttcaagcaattttcctgcctcagcttctgagtagctaggattacaggcgtctgccaccatgcccggctaatttttgtatttttagtagacatgggttttcaccgtgttggccaggatggaactcctgacttccagtgatccgcccgcctcaacctccgaaagtgctgggattagaggcatgagccaccgtgcctggctgttcttccatttttagtgacacaaaacaatggtgcatctcacggctgacagcatctcagacttgataaaatctccctaggattttaagtgtgcctgagtatggtcctgcctcagcattccctgaggaccaagcgcccgctctggctgtaggaggcaaggcttccaaggttccatgaggcgaagacccttgtatgggcatatcccaaacatccacgaaagagagacagtagattaacttagtaatcacagaacgccaaaggcaaaggggatgtggtatcaatgactgcttcaaaagtagaggctatcaacttcctgaaagtacagttttgagccagggctcaaaggtgagcagaaagaccaacgaaacagaattacatgaaggtagctgccgtttcactccagcatgaccggagtgccagggacgacatcctacgacacaacatcaagggagcagagcgcagcctgagctgcagagcagaggccagctctgtccgcccctgaccatctgtggatgtgcagagctaggaaggcagtgaccgccataaccatcctttctcttggaaagcagactcaggtggccatcctgacctttggttctccctgcctgcaagtgcttctgctttatggtggcgtgaaaatggaactggctgtaggaggctgagatgagcttttatgtatggccagaatccatctggtcaatcgccgtggaatgaaagacaggaaagaggagctgcagggaggctccaggtgggctcactttgtctcatttgctcagccatctcactaactgctgctctttaaacagtcagaggttattctatttttcttcttagcatcattgtggaacaaataatgaatgaggaacatagatacttaatgtttttagatgtcctccacatgcaccttaccagtaggtcaggaggttacaaaaggtcatggctggttaagagtatgggctcctggctgggtgcagtggctcacgcctgtaatcctaacactttgggaggtggaggcggatggatcacttgagatcagaagttcaaaaccagtctggccaacatggtgaaaacctctactaaaaatacaaaaaatttagccaggcgtggtggcacacacctgtagtcccagctacttaggaggctgaggcaggagaattgcctgaacccagggggtggaggttgcagtgaaccaagatcgcaccactgcactccagcctgggcgacagagggagactcttgtctcaaaaaaaaaaaaaaaaaaaagcatgggctcagaggtcggatgaccagcagctaaattgaggctcacctcactctagctgtgaccctgggcaaactgcttactgtcactcaacctcagttcttagtaaaacagggatgatgacaatacctaccaaccatacacgactgttagctttattattttaccaacatcttgtacctcctggaggaccttctatgtaacagcattcattgcaacaacactcttcagtttaaaggttgagttaaaaagatcactttaaagtcccaagtcaaataaactacaacaaactcacatgagaaaaatcacagggccaatgctttgagcaaaggcataagtcttacctcacaggaatagctttaggcactgtgctgatattatttatttgatatttaggcttctctgcatggatagagaaagtttcaactccactgtcaaactcaggaggctgtgccaaactgtgcgatttcacaagagtttttggagaagtgggagtttttgaagacaagtcaggtttatgtgcagtttcacttggcagaagattgtgattgaatttaggactttcaaacttgcgttcaaatggtcgggcagaacttgtatatggttttggtgtgaatcgattgtatgctggagtgactgttttctgagtctgttcagttccattaactggggctttatctggaaaacttttctggggatagaaagctgcctgagcagtatcttctcggtttggtggtctgaaagttgctggcttattctgagatggaggtgggtctggtttggacactaaggaattctgaaaatccaatgacactgaattacctgaaaaacaaacgtaagcatttaaataactttctgaaaaaagttataatagccctgtcccagcttaacttgtcctggtgctggagtcgaggcccaaatgtgggtcgcacagccagagcctgactcttgagccctggaggctaggtgtgatgctgagggatgagggcagcatggacaggtggtgccatgaatatatataccctgctgccctggagtcagggtccagctgctaagattcctggcctccaaagattggcactagtctttgtgaaaactagaatgcccaataatcatataataaggatactcactattaattagaaaaatgtaaaacaaaaccaacaaaaagcattaaatactatttcacacccactagaatggaaaaaccgaaaagtctgatgatgccaaacattggttaaaaagtggaaccacaggattttttatgcactgccagccacagtgtaacacagtaccaactgaactctgtgaaataattaaggacactacaagacaggagaattattaatccaaatacctcatgaatatagtaatataattttccacagtacgagaagaaaaatcatatggtcatcttaatacatgcaggaaaaacatctgactgctttcagcaaactctgaatatagggaatgtcttaaacatgataaaggacatctacgaaaatcctagagctaacattctaaaggataaaacatgaggtccttcctccttaaaatcaggaactagcaaaagaggtccaatttcaccacttacatttcagagtttattggaggtcctggccagtgcaatcagcaagaaaagaaagaaggctaggtgcggtggctcatgcctgtaatcccagcactcttgagaggccgaggtgggcggatcacctgaggtcaggagttcgtgaccagcctggctaacatgatgaaaccctgtctctacaaaaaatacaaaaattagccgggcgtggtggtgtgcgcctatagtcccagctactcaggaggctgaggcaggagaatcacctgaacccgagaggcagaggttgcagtgagctgagactgcgccactgcactgtagcctgggcgagagcaaggcttcgtctcaaaaagaggaaaaaaaaaaagagaaaaggcataaggactggaaagtaagaattaaaactgtctttatctgtaaacatgggcatgtgtgaaaaaaaatcttaataaaagatagcctcaatccagaactataacacatctgcttgaagactcacaagcccaaggaggtgcctcctaagggaataataagagaagtctgtgctaggaaaatgcctgtccacagcagaagagataaccactttgtgttatatgctgagggtaaaatgttacaaagctcttaagatgaataatctggagctatatgtgatctacctggtatgtaaatgcaaaagtcaaggtgtatgggatacattttatatgaaacattatggcttttctatttgggtgtgtgagataaaacatagtaggttttacaaaccatctttacatatactggcaaacactacttccagaagatttagagactagcataaaatagattaaaatctgtttagctaaaaggcttgtccaaaataatggtcttgtaaaaacaggagacatacttttaacaaaattcttagtttttactgttcccagcccaaaggtttcaagcatgtattttttaatgtaaaaaccattttgcctagaaaccaccagaattttacttcataagcattactgtgttaaaatgtctacttccgaacttcctaccttcaccatgtgctcccttagaatgtatgtggagagacgcgctggtgacaggctgagatggctgggcatactgcgagggcaatggaggaggagggggagtggcctggatgggttcatagcgtttctcgccaaatgatctatccacaccatcagcttcaggaggctttcccctgttaacaaatgaagaaaatgccaacacctgaaaatggactcacatttacaaaacaagttctcatttctccatgtatctctaagttaaaaaaaaaaactagaaatttcacaatttattctcatgagtatgggtagctactctaccaaaatataaaaacagattcgaccattcatcggcacaagaaatgtccagacacacaaaaactttaagaatattagtaaaacatccagaagatggcaaccaaaggcaggtgaaattttgggtatagtttaattgttatttacaaaagatagtaatgttgacagatttaagaaagtcttgcaaatattctgaaaacatatcatggcacaaattttcctgagacccactttttttgtttttgagacagggtctcattctgtcgcccagactggagtgcagtggcgcgatctcagtttaccacaacctctgcctcccaggctcaagtgattcttctgcctcagcctcccgagtagctgggattacagatgccagccaccacgcctggctaatttttgtacttttagtagagatggcgtttcaccacgttgtccaggctggtcttgaactcctgacctcaagtgagccgcctgcctctgcttcttaaaagtgctgggattacaggcatgagccaccgcacccggccctagacccacttctgattttgtatctggcatctggcatactcggagcaccataaaaacagatgtcacagactaggggttggcaaactttttcactgaaacaccagagagtaaatgtttgtggtcttttggcccatacagtctttgttagaactattcaaattatgcggttatagccttgaagcagccacagacaatgggcatatctgcgtttcagtaaaactaaaaaaactggagcttttactttaaaatttccccttgagttaccaggtccattttttggttaaatgactgctagagcagcagatcctgctttattttacaaggttcatttaagtcaaattgtgccatgtatgtttattttttcagattgccaattgttaatatgtaacacaaaattcacacaaatctttttaaaagacccataattgcaacattgccatctaaaccttactgctgaatgccaaagctgcactagctttatgtgcaccaacaataacatatacatttggaatactcctggtcattttcataaattttcattgaagaagtcttatgattggcttttttatcttgctttcatgaatttagactaagcccttgatgatgacattaaaatctgaaagtgcacataatgccagtgacacagtgagggacaccttatggaacagcctcacattaattgccagtcttaccacttgacgttccttttcaagtagtcatagctagtgtaagagccaagaaatctaggtgatggcaaagcaagcgcaatagaaaaatgaaagaaaatggtcaatctaactaagtaaatttgcagcaaatggaactcaaatgtcatttaaaaatatcaaccaacatccaccatttcaccataatttggtctataaaggaacatatcactaactctcatttggccaaggaaattgaagataaataaaacacaatcacttagttatgtcccgtctgctggcccatccttcatgtactttaactgttactgcagtgaaaagcaatgtgtttgaactttgctccttctccacctctgttgcagctgctaatagtgagcaaagaaatttatcaaatcaaagagtggtgatcaaggataattagcaggttctgaataagtgggagtgacatgtcccattaaaaaaaaaaaaaaaaaggctgggcaaagaaattctgcaagtgaagacacaggaaaaagtaacacaacagaagagctacattgagcccctgggaggggaatggtaaatggagagatagaaatatgcctggcttgaaacctggccaggcttcacatgttcctttctagcaagacctcctccatctccaatcgtaagctgggccctgtggtggtggagtcttactggtgaagctgcatgcttgatgctcaggctctctctcatctaatgatgtctcacaaacacaaaaacaactgaacatcagtctctcacatttagttctttaaaagctacaaaccaccatcatttattgagacctggaagtctcacatagtgagttgagtcctgaaaggtagatttgataacaaaaaatccctggttgtcctgaagaagttgactcaatctctggactgagacatgtgcacagccctggagggacactgctcttcttgcactgttttagaatcctggaaacttctaatttactttggaggtgaatgtctaagctactgtctcctaacctttccagttctaatccagctctatggaactgttagactgggtaatatctgcttgcttcctggggcatctgtcctgtgctaacaaagattattttccatatctaattctcaccatttctgaggtgtgtttttaagtgaagcataagcacacatcatctgaaggaagaaaattttgctactcctgtatttactgaaagaaagaaatgcctgaaggcagtcttatttagtgacaaacagtaaatggttttgaaatgcaggacagaatcctatattttaagctattttccagttgatgaagttgtactcattggacaagagtatgaaaaagcattacaagggaaacttacagaaacaactaccctcttagttatcttccatgacccttattctcctttccatttctctaaccattaaatacctatatgggaaaatgcagcacaattataaagagtttcaatttcacactacaaaggaaaaaaaagtatactggtatccagcccaaactatacttttctctctcacagcagcagggagtaaaatcaaactgagttctgagtaaattcacaaagacagatgtcatctgtttcacaatatatccctgtgaaaacaatgaccaggtaatacaggttccttccagagctgtgttaatgaaaagaagggtggtggatgcacctagtataccatgccctgttttgagcttcattcactcaacaattactgagcccctactgcatgcaaggcaatgttctacaccctaaagttatacatcacaaataagctaagtcttctttctagaaaaacaaattaacacagaaagcaaacatgcattttgattgattccctggcaaaacaacttactttttagacctaaatatactcctttttttttttgagatgagtctggctctgtcgcccagactggagtgcagtggcgcgatctcggctcattgcaagctccgcctcccgggttcatgccattctcctgcctcagcctccagagtagctgggactacaggcacctgccaccatgcccaggtaattttttgtatttttagtagagacagggtttcaccatattagccaggatggtctcgatctcctgacctcatgatccacccacctcggcctcccaaagtgctgggagtacaggcgtgagccactgcgcccagcctttttttttttttttttttttgagacagagtctcactctgttgcccaagctggagtccagtggcacgatctcggctcactgcaagctctgtctcccgggttcacgccattctcctgcctcagtctcccgagtagctgggactataggagcccgccaccacgccccgctgatttttttgtatttttagtagagatggggtttcatcgtgttagccaggatggtctcgatctcctgacctcatgatcagcctgccttggtctcccaaagtgctgggattacaggcacgagccactgcgcctggccatataatctttttaaggttgtattctatttaccaaatatgtaaaacgataaataagagatatctttaaactaaacacctgagccttcttctgacaggaatgaatgtgtttaacggtgtttagtaaaaataataactaaagggtacacccttctgccttaccaaaggtgagctcctatggctcagtgcctagctcactttaggctagtcaccatttagatgttactgtgataactgtgtaaatgaattcctgtaacactgtaaatgtaaatgaattcctaatgacaaatccacatctgtttttgttcttgtgggttttgttctgttgaggtatgaacccagctgtgcacctgtgtgggtttatattgtgctagctcacttcagtccagacaccatctagatgccacaacccctttctagtgttgtgctaaggggtggttcacaacactagtacaagacacgttttgcatttaatacaacccccactgcagcactctcagtttgcatttggattctcataaactgctttcttctgtaaacataaagccttaaatataggacagtgaaaaaagtcttcactacaaaggatgtcttagaaaaaagcagtggtaattaaaattaggttttaatgttagtggttttaaagtatgttctaaaacaatttacactcaatagtaaatgacaaataggtcatttcccaagataatcccaagcccacgcaactaagtaaggaaaaatctaggtgcttttaatatagacacaatactatgtgtgatgaattctaatatgtcaatctggctaggtactgccatgaagggatttttcaggtgtaatgtccccaagtcagttgaggggagatggtcttgggagggcctggcctaatcagcagagccctctgaatgagaatttaggccttccctgatctcacactccccagtagctcaaaatcttcccttcctgaccaactgccctctgaaataggacttgcttagccagcccctgtaactgtgtaaatgaatttcttttgacaaatccacatctgtttttgttcttgtgggttttgttctattgaggtatgaatctacctgtgtgcccgtgtgggcttagacacaactatcagtaccaaattctcttatcagtcagggttcaaccagagacacagaaccagtaggagacacaaacccacgcaggcacaagaaaggagaacaaaccaacacgaaacccagggatgagtaaacggaggggagcagcaagcacagggaaaagatgactgggagtcaagaaacttggggttcagtcccagctctgccctgtcattttccctcacctgtaaaactggatcagaaatcttacaaaaacaaaaaacaaaaaacctcttcagtatttccctcaaacaggatcctcctcacatctgtatttatatttaaaaaataaaaacagaaaagaaaaagaaccagcatgacatcattaggtgtgtgtacagaagtgaagactgatgattacctatcgatgagggtccttgtggttgacactgtcttccgtcaaaaccctgtgatgttagcatctttgtgaatgcaaaaactatgtacatctaatagcagactttaaaaacaaaacacacatcccagaactaaaaagtatgtacaatgctgaaccactagagcctacagaaatcatatattacacttaaattatttttcttcaaaatatattgaactgcacgggattaatatgctgcatcctatttttaaaagccaggtgaaatagcttactttgaagaataactagaaaaatttgattgattctgagaatgcgctggctttgcaggctcggagagatggctggcggcaatgtgtgcaggaggcttattctcaaaacttcttcggtcaaagtatgacagctgttttcgataatattcttcatcttcttcagggtcataatgattggaccgaacaatatcttcaggtggcttcagttgaggtttttgaggttctgggatcctaacagataatgaatgacaaacggaacacctttttaaatattaatgttatgaaggaagtagaatatgtaagtcttatcttgactaaaaggtcaataattactaactgctgtgattactgaggatctgagcagtcccaacagttaaaatggatatttcaaatcccatgtcctcacagagtatactcaaaaggcagcccccttctggctcatgagtcctttaacacaatataataagctaaacgattacatgattagggaacagcaggttagaagtagttaatcagaaagacaaagggcaatgtaaccgagacagtgaacatcttgagaagtacatataccaaggtcaagaacagtaaatgatagactttaagaactttcaaagggatttttaagaactcagtccaggatctcaatgattctcatatgaacaaataactctatatggtctaaagttctagaaggcatacaaagcagatgaggaagaaagcaagtcattaagtaaattcatattagacagttctcttctttatcctaagtgcaaacatatattcagtcaaaaaacaaaatcagaagagctgtattcaaatctaatctgtcacttattggcagtgcaatgaggccatgggaaaaagctcaggctgaggagcagcaggccaggtttctcttccagctctaagtcttgtaagctacttgcccctctcagcctcagtgtctctctctacaatgcagaacaacaacagtgtcacctcattatgctgatgtgcttagcacaagggcaagcaccttatgcatgctcactaaatgatttagttatcttaaccaatctgagtctgtttcctcaccactggaaactaagagttcacatgtcgaaaagcacttttaaaactaaaaaacataatacaaatgtcagagcttaaaaatgtttatttaatcatctgcttggagaatatctttccgaaagtctgctaaaggtataaagatttgtcagatttgtcagaaataaagttctactttttttccccctagaatcactgtttaggagagctgatagtttttatttaaggacaaactcctcctattcacacctctcctctactaacacagtaaaaggttttcttattgactaagagggttaaattcctggtcagttctatgccacaaagagcacaaagtgtactcacctgtacagagttttgtcatgttcactgaattgattctgagaagtgggtttgggaccaatgatgggagcacctgaaggtttagatgctacttctggaggctgtttaaaaaaaaaaaaaaaaaaaagacaaatatgcctaaggaacagataattaacagaatagatatcatgtaatggcggaggggagagccaagaagccttttaaacggtgtgcccatgcatccaaggcactaaagacatatttaccttaaaactgccagtgtcatttacatccttcttggtctctaaggatgcagatcttttgttttcaaacatcttaactctggtgagtacagactgtggcttcattgctggatcttcctcttcttcggtttgagttgggggtggaggcagtggtttggtgtttgaaggcagagcttctggcttatgctgagatgaaggtatcagcggagggacagctgcagcaccatggagaggctcaaaatgacctgctctagaggtaaatccttggggtggtacttgctcgtaactgcgtgaatattgctcaaaatactgcttggactctgcaggcttgggccctgctgaagggtggggctgggcttccggtctgagtctaccatgtgtgtcatacccaggagctggctgctcttcgtgccgcagggcggatgctctaggtgcctgttcgtaacgtggtctgctgtcgtaagacagaggggctggctcttcaaaacgtggaaagtaccctcgttctgaggactcttcgggatgctgtctggagtcaaggtcttgagagtgctgattatcaaaaggtggccgagatgggtagggctgtttgtcatcataatatgaccactgttcttcatacatggggacgcgatcttcgtatcgcagacgatgttcatagtttcgagaaaactggtccgtatagcttgaggactcgtatctgtatgtgggctgctcgaggtctctgctggcttgtttctctacgtatgggagttggggttcataggtcagattaggctctttgtctggcctgtgccctgggtgactaacggctggctgtttcaaaacatggttctgcctcatcatttcctcgggatatggatcctttctatacacctgtataaaaaattcacatttaaggacaaagtcttgtttctaattctagtctattttattagactgtgattaaatattaaactacgatttaatatgtgaaaatggtatgttttaccatttattatcaggatagacaagattagtggaaaaagctggtttaagtgaaagctcaaaatttataatgcaggtaggggcttttatgtttcagcatgtactaaataaacagtgagttaaagataaatattaaatttagtagaaaattaatgcactattgattacacttcattttgacactgaaaaatcctaaagaagatttatgggcatcataatttgtattaacataaatatgtttatgatgggtttcgattacatattaaggaattctggaagatactgaaagccaaaaataaaaataataagcacaaatctcaattaaaaggcctgttttcaaataatcagtataccaatggaagccatgcaaactacgaaactgaaatgatttgtattgatttgaaagcattacagtgtataagcctgcagtaaaaaagcaaaaggaacacttaaagggcaaagcaaaaatgatcatgtgccagattgatggacagcaacaaattagtgcaacaccgcagcacaggtacctttgttggatctacatgcgacgacaatgatggttcttgatctcttagcattatgtgagctgcctcagtacttggtgttcttaaagaatcagcttgtggtgagtaagaggtggaaggagctggggtgggctcctccagtctgacattagttaaatttacattatgattaacagcagaggttgatgatgctgggtttgtttcaggcgaaaggtaagggactggagatgaagcttctgctttctgtgaagtgtttaaaatattttaaatatagtgtttctgtttactgctaactttccacttcaatttatagtgattggtagacatacattttaagtgtgctgaataacaaaattatgacctcatgtcctaaactttttgggaaaaaaaaaaaatccagtacattgctgtgttaagacaaacacacaaaatttagaattaagcccttggtactctcaaattgaaattgaagattaattcttaatctggagaaaggacaacatatatatttttaactcaatcaccacattctaaaatttaataatgcacctctatctacaaaacgttgaatgcttgctgcttacctgttgagaggctggcttaaatccaggggagtctattctatgaattggttgtggctgcgcttgtggtgagtaaggaggatatgtttggttttcatgatgcattccagaggagtcctctcttacaggctcagaggaccgtgtaatggcagactccggtggagtcccaacctcatcattaagagtttcatctagttcttgatcagtgtaggccccgccttctgtgtctgtgtcttcatagtcagaagtgtgtctactgtccgtgctatacattgagtattcactacctggagctgacaggtaggacagacgatcatcatgcaaatcaaggtcatcacttgtagcaccatccgcctgggtcaaataaaagtaaattacaaattttattcagtagttctttaagagatggcctttatcgtacaaggcagattgaaaaggatatctttctctggagaagtcacatctacttcttgaaacttctggtaaggaaaagtcaagaagattgtacaagcacacacgcagacacatggagcaccccttgagatctgaagggcatggatgaaggaaacagtggccggtaagccaggacaaagttagactccagggcccagccctggaagacaacgaagaaactctgacactgctcagatttataaaacctactcactagctcttcagcccttttaagcaaggggaagagggagaatgttaccaaactaagctcacagaaacaaggacacactgacagaatagcacatggaagaatacctatgaaataaacccaacagttcaaaagttgaataagagctaatatatttatgtttaggaaacaactgatatggtttggatttgtgttcccacccaaatctcatgttgaattgtaatccccagtgttgggggaggggcctggtgggaggtgactggatcatgggggtggtttctaatggtttagcaccatctccctcacacagtcttgtgatagaattctcccaagatctgtttttttaagtgtgcagcacctccccaactctcttcctcctgctccagccatataagacatgcttccttccccttccgccacgattgtaagttgcctgaggcctccccagaagcagaagcctgtacagcctgcagaactgtgagccaatgaaaccttttctttataaattacccagtctcaggtggttctttatcacagtgtgagaatggactaatacagtaaattggtaccagagaagtagggcattgccaaaaagatacctgaaaatgtggaagcagctttggaactgggtaatgggcagaggttggaacagtttggagggctcaagagaagacagaaaaatgagggaaagtttggaatttcctagagacctgttgaatggttttgaccaaaatgctaatagtgatatggacaataaagtccaggctgtggaggtctcagacagagatgaagaacttactgggaactggagtaaaggtcattcattcttgctatgctttagcaaagacactggtggcactgtgcccctgctctagtgatctgtggaactttgaacttgagagagatgatttagggtatctggtggaagaaatttctgaatagcaaagcattcaagatgcgacctggctgcttctaacagcatgtgttcatatgtgtgcacaaacagattatctgaaactggaacttatatttaaaagtgaagcagagcataaaagtttggaaaatttgcagcctggctatgcagtaaaaaataaaaacccattttctggggaggaattcaagctggctgcagaaatttgttaagtaacgagggacagaatattaacagacaaaacaatgggggaaaatgtctccagggcattttggaggcctatgcggcagcccctcccatcacaagcctggaggcctaggagggaaaaaatggttttgtgggtgatccaggcccggccctgctgctctgtgcagcctcaggacatggtgccctgcatcatggctgttctagctccagacatggccaaaatgggccaagttacagctcaggctgttgcttcagagggtgcaagccctaagccttggcagcttccacatgatgctaagtctgcgggtgcacagagggagacagttgaggcttgggagcctctgcctagatttcagaggatgtatggaaatgcctggatgtccaggcagaagtctgctgcaggagcggagccctcatggagcacctccagggcagtgtggaggggaaatgtggggttggagccccccaccagacagtccccactggggcactgcctagtggagctgtgagaagaggcccattgtcctccagaccttagagaggtaggtccaccaacagcatgcaccatgcacctggaaaagccacaggcacacaatgccagtccatgaaaggagctgcaggggctgtgccctgcgtggctacaggggcagagctgtccaaggccttggtagctcaccccttgcatcattgtagcctgggtgtgagcagtggagtcaacggagattattttggagctttaagatttaatgactaatctacttacttttggaatttcatggggattggagctcctttgttttggcagacttctccattttgaaaagggagtatttacccaatgtttatgtcccctttgtatcttggaagtaactaacttgtttttgattttacaggctcctagacagaagagactagccttgtctcagatgagactttgaacttctgagttaatgctgaaatgagttaagactttggggcactgttgggaacgcaccatcatattttgcaatgtgagaaggacatgaaatttgggagggaccaggaacagaatgatatggtttggatttgtgtccccacccacatctcatgttgaattataatcctcagtgttggagtggggcctggtaggaggtgatcacgagggcggtttctaatggtttagcaccatccccctaatactattttgtgataagagttctcccaagctctgtctgtttaaaagtgtgtagtactccccccttctctctcttcctcctgctccaaccatgtaagacatgctttttccccttcactgtcttaagtttcctgaggcctccccagaagcaggagcctgtacagcccacagaactgtgagccaattaaatctcttttctttataagttacccggtctcaggtagttctttacagcagttcaagagcagactaaaacaacctgttaaacatttggcccttaaagctgttatgaaacacaatggaaaatcatcacctacatggtggttgctacattaagaagaaattatttattatttttcatagaaacagtatccaacagatggagaggaagaaatacagtaatgcttttcttttgttaagtaattaagaactcagtttctaatagtttatgttgattatcttctgagtagatcagaaagaaagtgagaagtatttgagggaaaggaagctacagagttgcaatcaacaggttatcactggacactaacgtgacactagtacctggatgaaaaagaacactccctgaagaccctgcctagacaccgtgctcagttactcatgagagctgaaggatctggaatccaggaatcagaaagtatttcttccacttcagtatggaatgaaggacaaacatgaaactcttgtcctccagaaagatgcactgctattaactagcaggtttggtgtggctctgcaggtctgctgtgccagaagcatggtcttgggagtcaagttgcctgaatggagctttccacgcagtccccatgcttggctcgttaagactctgaccttgagcactgccttcctgataagaaagactagggtgtgtcaggtctccccatgctccagttttcaagagagcatctgccaggctgggctggggagagtgggaatccagggatctatcctgttagagcacaatccctctgaacaagtctcaatggcttctcaactcggtaacagctgttgcagaagaaaagtcttcttgctatctactctaatctttaacttgccagggttctgaatactataatccagtagccagtcaaggaaatattgaaagtctgggcaagaataacttagaactaatcaatccacttaagtttttaaagctggtttgaaatgcagatgtaagcaagaacgatgggttgctttgaactaggaaatatgttaagaaagcctcaggatgacttttcctggtttagcagggaatatgtaagactgtgtcagatcttgtaaaaaggaactctttctagcaattaggtcaaagtagttggttcaggaaagtcaatgtgaaatgaagtagttttagtttaagaatctattctatgaaatatacttgaagagaagaggacaggaagataagctgtaagttgtaacaaccttttctggcttacaaaatgcatcagtctagcctgataataaataacctatttttcctcacataaaaagctagaaagttggacctttattttaaaaccaagcaaagaaagcacacaagactatcactaaaatactttatagaaaattaagatttgtggattttaaaaaagcctctcagatactacaaatgtatactttgtgcattttgggaaaacatttatagactactttcattttaagaattcactagtgaaagctattaacattggacctgccaaaggatgttaacagaattgtgttgctatagaaggttagtatgaagactacaatcctttcaagtgctgcaaaagtagaaattagtaatagtgtgttcatgtaaagtggtgtggtttgtttccaccttcattttcctatccagttccagctgacatgttattcagagtggtcttaggctctcgtatgcatggtccatcccccagactggttcataatgagaaaaaccatagttctgacacattactataggtgagaacaatagacactgcctctcagtgttaacagctctccttgcagaggctgtgtatgtctgggtagaggacatggggggtcctaagcatgcagcatgcactgtcagagcatctgtagccacagccaggcagaggaaggtagggaccatgcgggggcaaaacacaacaaaaaccaaaccaacaaggaagtacaaagaacaaaataaaaaccagagatactctcaatcttccctaataaccaaaacttactgcactgatctgaaaaaggtaaaagacatttaaaaaaaaaaagcttccctcaatggtgtattctgaggaaatgattaactctccagacaaaataaacagaccttcccatcaaagattgctataaaaccagaaagactgacaatagaaagtagttattttaaagctggccatttggacgtatagaaaaccaaaattcaaagccaggaaggatctattgctttgttcaatatctcccagtatgttgtgagaatgttaacaggtgttgagtgaaaaataaatgcaaggaaatgcatgaagtcggctttttaacttttaagatgtctcagagcctttaaatgccagtgggtacgaggatactcgtgaggggtctagggtttatttcccatccgctgcttgccttcatagtgccttctctcttagagcaagtcctgaattgagcatgctgaggacagcactttgggagatgctcatctaggccatccaaatcccctcattttcagaggaggaaactgaagccaggctcaaagtcatcattcatagccagacaggggcagcatcagaactcaacctgctcttcattataatttaagattctttaggagacaatcctactgcagtggtaattcaacaggtgagaaaatttaagaattctcttaccatcagaaacaactttcataacccctacacacaaattataaaaacctaaaagctaactttccccaaatttctccaatatgttgatctaattagaaagcactggtatctcaaaagcatctctgattagttacataatttactgaacaagtcaaaaaagtaataggaaatgtcttacctttccctcggaaacccataccagctggttttgctgttgttgaattgcttctttcagcgcaccataccaaccatcattcattgaatttaagttaattgtagctgaaaataaattaacgatgtagttttatggttagagcactgccaaaagtcagaattaattcaaccctgcttacagctaaatcgtcattactgaaagatggtatctgaggatgcaaacatttgaaatttctattttgctactgtatattttcttttaaccaaacagcaggtgttaacacaacaggaagctttccaagaaagtatcatgtaagttttagtatttgaacaccgtaacattttggcctacttaatgttgcccagacattgtaagctgaaagaaggcctttattaacatactcacttgtaaaaagatggtgattatttttacgaagtttatgagatcgctcgtataacttcctggcacttttccgagattctggacataacctcattctcattgtttttactccttgcttagaatcagggttaagaaatacaacaattggataccactgggcatagttaagacgatcaactgcatttggtgttacatctaataaagcatgtttgtcctagaaacagaaagaaaaatatatacaaagacacaagacatcattaattaagaatcaccaaattcagctgggtgcagtggctcacgctacgcctataatcctagcactttgggaggtcgaggtgggtgaatcacttgaggccaggagttccagaccagcctggccagtatggagaaactctatctctactaaaaatacaaaaactagccaggcatggtggtgcacgcctgtaatcccagctacttgggtggctgaggcacaagaatcacttgaacctgagaggtagaggctacagtgagccgagatcacgccactgcagtcccacctgggcaacacagcaagaccctacctcaaaaacaaaaacaaatacaaaccaaaacaaaacaaaacaccccatcacattcagaaaaagtcaaaagtctgtactatatttcagtggtaacagatctctttgtattctaatgtctcaggagcacatattaaaaaactaattgtaagttaactcaattccatttctagccaaatttctaaaaacctttctatgaagctcacttttaagacttagccctaacaccgcaatctgacagtattatccacgtacagttagaataaaaatgtttaagaatttaatgttcctgacattccttatgaatgtaaataacaaactacaacttgaattgtactgatataatatataagcagtctgttaattacatctaaaaatcatacacttgttttgtggtaatgaaaaatcatcttctgatgcctacagtaactattctcttgaaagtaatcattataatgcttttcagtaagggcttaattttcttatagtatgtcagtaatagtctcagaaaaactaccttctactttcaaattaaccaaatcccatcccactcaaaaccacaataacataatgaaatgggtcaagttttaataacttacttgatctatgatttgctttattgtatgcaggcgaataatgccagagctacgttggtcagttccagcgtctcgtggttcactctctattcattatgtcaggacaaaaataagacatcaaattttcactggttagacaggagtttctcaactactggccacaactgatatgccggactggatagtactttgtttgtggaaactgtcttatgcatgcagtacttaaagtgagttttaatatgcatacttccctttttttttttcactattttttcaactactttaatattctggaaaaaaacttagccattaaagaagaaaaaatatacaggaatgcacatttttttcttttgcctggggctctaatatggctcaacagggcactacttcccaccctttttcacactgtaacatccagagaaaatattatttgtatggcacactgagataaactgagggggctgctcctttgccaagctctaaccagccactactggcttaagaggtcaataccttggcatgtccatcaaccatcggtaatggtgctatagtggattgcctagggagttctgggttagagaccttagttacatcagtagaaggggaacctgggggcaggaagctgttcatctgtaactgtgagacagcctatggcttcatcctggcaacctgtcttcactggtgtatactgtgccaaatgcagcttgggctggtttccaaccaaccatctcagagcacagcaacgtttgtgactctggtcacaaggaaagtttgaaaggaaaggaagagctttggtgtttcagagatcagacaaaggcagagatctggaaagacaagtcacactgaggttcaagataaatgattttggagaatgagactaccataagacaaagcaccatgggcaagcagggcagaatttcaaatctagtgaacactggagaattaagaagaaagatcaactgggaattttggctggaaaaaaaatgctactaactcctcaactcaaaagactgtcattagactcaaagaagatataaaactaagctacctgaattccctgttgtggagtaaacctgattaaaccaatgtattaccctttaaggcagagctttgtaagtcatcatacttgcttttcccatatctaaaaatcctaagtttggttatgggtaagggttaccaccaacttccttcaggtgaaatgtcatctacagataacttagccaggtgcggtggcaggtgcctgtaatcccagccactaggggaggctgagacaggagaatcgcttgaacccaggaggcggaggttgcagtgagctgagattgcgtcagtgcactccaacctgggcaacacagtaagaccttgtctcaaacaaaagaaaacaaaacaaaacaaaacttcttctgaaaaaactaagaaataaacattttctaacttgctcagattttactcaaatcatttgtctgcaaatcttctgatgttcagaaaataaatatccttattcaacttcattggcaatgaaatgaaaagcaatatattaaaaaaaaaagatgatgttctgattctttaaattaacactatgcagtttaaagatgttactgagggtcggctgggtgcagtggctcacgcctgtaatcccagcactttgggaggccgaggtgggcagatcacgaggtcaggagatcgagaccatcctggctaacacggtgaaaccccgtctctactaaaaaaacaaaaaaattagccgggcgtggtggcgggtgcctgtagtcccagctactcgggaggctgaggcaggagaatggcatgaacccaggaggtgaaacttggagcctggatctgagatcgtgccactgcactccagcctgggcgacagagcgagactctgtttcaaaaaaaaaaaaaaaaggttactgagggtcatatagtgccagtgggaacaaaatccccagcacaactctctggaaagcagaaacttcatcataattatgggaacagctatattcttaaggatttaaatcctttgggaaacaaagcagggcataaacaagcaaacaaaatatggacagatttctgtatcttttgtaatagtaatataaattcgaaacaaacgatataaaaaaagcctaactgaaccaaaaattgcaggataaaatgaaaatatgccattacctatgaaaaagaaaaattggatataaacttttctaaacagtataaataaaactttgccaaaatatgcttaaaagagtggaagaaaatacaatggaataaaatttagggtggtgatatgtgtaaaaattaactttccaacttttccaaacacagaatggcacttttataattacaaaaacagtttaaaaataaaacaaaactgggtacagtggctcacacctgtaatcccagcactttgggaggccaaggccagagatcacttgagcccaggagctcaggttcagcctggacaacctagtgagaccctgtttctacaaaaataataataataataataataataaactagccaggcgtgttggcatgtgcctgtagtcctagctgcttggaaggccgaggtgtgtggactgcttgaacccatgagtttgggactacagtgagcaatgatctaaccactgcactcctgcctgggcaagagtgagactctgtctctgaaaaaaaaaaaagaggagcagtgtgaagaagaggcgagaacgacccccggaccgaccaaagcccgcgtgccgctgcatcccacgtccagcacctacgtcctgtcgccaccgccaccatgcccaagagaaaggctgaaggggatgctaagggagataaagccaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtatttctggtgactgtacagtttgaaatacttttatcaagttttataaaaatgcagaattttgttttacttttttttttttttttttaagctatgttgttcgcacacagaacacttcattgttgtttttgggggaaggggcatatgtcactaatagaatgtctccaaaactggattgatgtggagaaaacacctttcccttccagttttgagagacttcctcttggctcccaggaggagggattccttgactttgacacacatggccaccttggcacaaaagccttgtgctatggaaaaacaaatttgtttttatgtcctcttctccctttccacgtttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcgtttcacttcctgaaagtcagggttggcttgtgaaaagttgttaaacaacatgctaaatgtgaaatgtcaaccctcactctcaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaagaaagtaaataaaacaaggatctgtaagcaaaacgtatttggcatacaaagcactgcagcctcaatacttatacttactatcttattataaatgtctgcaataacaacagctgataatattagcaatgttttattaccctttttaactatttgtgtatttgtcagtttaatgactaaaagagctggaatggagcaagaaagggctgtggtcaaagccgagtcttgtcacttgttcactgagggccaccaggaagtttagactgaagaaactggaaaggatccacgcaatgaccatccaagtctcaggctactcaactgtaacatggatattatactccttacctcagagcatgactgggaggattcaatgacattgtatgttatgcaattttcatatgaagccaagagtttcctaaacggtgacttttctcattaaaagaattggtggaacaaggacatggtcactggggttttctcaccaaattaaaagaatgggataaactgctaatttttcactgacaaaaagtcttatttttattgaatgagtgaatcagaactcactcactttagaggtgtaactcccaacctcatttaagttagccttgaggctacttacttgcaatttgataaatatctggttcttctcttgccagcttttctctggcaacatcagctattggtccaaaaatggttacaggcctcagaaatccagctggagagaaattcacatgaaaaacagcatattttataccttttctttcttaaacatattgacgttaaagggtattaggttagtctgtagaaaataaactaccttctcgaagaaccactctttcataagctggaaactttgtttgaacaggctgagcggacaaatcctctctgctttttcgaagatttctcttggagctgcgaagacctctgaatctccagaagtcagcacggtctccgcctgctgtttttggaagtgtatactgtacactggctagctgctcagctctacacaagaaaggagaaaattaaaataagggcatttaaaatgcaaaatggaaaaagacccacaatgaaatgaaatatacaatactggatggaagttcacatacagtttaaatcttaatggttataataaagaggagtttgtaaacctaagtcagttatagatacgttgaatacaatgaaaaagaattctttacattaccaaaatttcccagtgggattgaaatgatctatcatcatttacttgattcactctatgagaagtatccaagcattcatacctgttcttattagggatgatgcctcgttctacctccttatgatttttaccaattcgaatagcaagccaagagcccagttttccattgtacaaggtatccacaacacggaacacctctcctttgttaaaactaagtccatagggagattccttttcatattcaaaatgggttctaatatagaaagaatctcctacatctgattctacaatgcgacgataaactaaaaggaataaaaacaaacacattatcaatatttagtgggataacaatctgaaagacagtacattatgtaaagatgctatgataatatcaataataatatccaacaaattcttactatgtgccaggtactgtattatttcatgtattcatcactgtaagaattgaaactcttagtacttccattttgcagatgaggaaactgatgcagaaaatacatcaagtaacttgtcaaaagccacatgcttgttttctattatatcatctaacttatctgcaaacattatagacatttccatatctaaatcagcagttctcaaataaaggtaattttatccctcgccatccaacattggacatttgccaatatgcagttttgactgccccatctgtgtactgaaagggtaaggggtgtgtgctagtggcatctcatctagtgagcagaggctaggaatgcccctaaacatccacaatacacaggacagcccctaaaaccacattatttggtccaaaatgtcaacagtgccaaggctgagaaacctggctctaagtgaaaattgtatcacagaaaaaatggagttttctcttgaattaatgctaataaacatctgagtgtattgcttagaaacatcagtacaaaatctgaaagctgctcatatatacttttgtatggttctgatggctaataaatcaacactttctatcacttgtaaagggttggatggcattttatttaaattagaatactataaaggttagtcctattagcatgctctgctaatgagaatcatctgaaattctgtgctcctaaatgacttagaattacataactttctttgagattaacaaattcattcatcactcaactatgagtgacttattttttaaaaatggaataaatccctttgtaagtcctcaaactctacaggtttatctcctccattttctgacagcatctcaccatccttcttcttctgagccaatatggtcacttcttctcctttagggaggtcaagcaggaaaaggacggcttcttctcttatgatatttgtaaaatctacgttgtttacctaataaataagatttcataaatcattcttggctgtttaagaatatgaaaataacatacgcaggacacagatactctcagtctacctaatttgaaaatatcacatctttttttttttttgagacagagtctcgctctgtcgcccaggctggagtgcaatggcacgatctcagctcactgcaacctccacctcccaggttcaagtgattctcctgcctcagcctcccgagtagctgggattgcaggtgcccaccaccacacccagctaatttttttatatttttagtagagatggggtttcaccatgttgggcaggttggtctcaaactcctgacctcaggtgatccgcccgctttggtctcctaaagtgctgggactacaggcatgagtcaccacacccggccgaaaatatcacatcttttaagaccaaaaactttattttactttggagaaaagaatacactctaattttaaaaaaacagaaacaaataaagtgagttaaaggtataaatttatttaaatagtattcagtgtgtcctgacattaaagatctgtgtaaaatttaaccagtttagatgaaaaaaggtaactttttacaagttgctgagaaaaaaaatcaaaagaaaatgggactaaaaagacaatctgcactgtagcaaccctgtaagagcatctgtgtaatgcaggctcagtgtttgccaagttaatatttacttctattagaagcttctaaatgccaaaatgaacttattaaaatgtcaccagtgactgtgtgcaggattacaggcaggttttcttctttccaccttttggaaattttccagattaaaaaagaaaaaaaaaaaccctagaaacaaaaaaacctgacacgcaccacttacttttatgatacaaaacaaaagtgaactattaagaaacattttttagccaggcgcagtgactcatgtctgtaatcccagcactctgggaggccaaagtaggtggactgcttgaacccaggaatttgagaccagtctgggccacgtggtgaaaccctgcctctacaaaaaatacaaaaatttgccacgtgtggtggctaatgcctgtggtcccagctactcaggaggctgaggggaagaatgtttgagcctaggtgtttaaggctgcagtgagccgtgatcacaccactgcattccagcctgggtgacagtgaggcgctgtctcaaggaaaaaaaaaaaaaaaaaagaaagaaacgtttaaaaaaatgtatgccctgattacttcaaaacagggttaagagatgggtaagaaaataggtctctttactttccttggtatagtgaacgttattatacatgttgtatttaaatgtttttgacctaacttgattgacaacaatgtaaacatcatcagaaagaatgaccatatcagatcagatggaaataggtctgaagtcaccatgatgccttgactttttgacatgctaagtttgaagggaaaaggaggaggattcaatgagaaaatgacagagctcaggaaattgctaagtgaaaagactttgattacgagctgctcacttgagcaaccaaacccaagaaagaggcagtgtagcaagagaagcagagagttaccaacattctccaagttttaaaagtatcagtaaagaggcaggaaaagaataaaaaaatgtaccagaatggcagtattatggaatctaaggaaaaaagtacttcaaaaaagattaagacagtcaaaacgctgctaaaaaataaaggaaaatgaggcttgaggatgacattaactcagcaatggcttattgaaaactgagcttcagtgtggtgaaggtggaagccaggctgcaaaactgtatgaccacaatgattgaaaagaaaacaggcaagggcctcaaccacatccttcaacaagttaaacagcaaaaaaggacaaataagacagtggaagatagatgaagaaccagtggagagagaaagacaagaaagtgaacaaagctacaagattctggagcagacaggaggctgaatccaggacactggcaagaggcaggctgagtacagaaagagaccagaatagagaggccacggcaaagactttgtggtagagaagcagaataaatgtaggagctcacaatggacagataccttctgattaaaatgggacatagtttaatctagcaaatcaaatggaggtttggatattttaaaaagaaacaggagacagattaagatggtactatgtcactaggtgaaaccgtttatggggaaggaagggaggactctatagactctactgatactctgcatctaacctgggctttcctgatttgtgtaactaatcctgtctcttgtggagtatgaagtttcaaagccaggcagcttacacatttgcctttgatgtgaattccatctccctgtgtctgagccattatctggggttaaaaaggtcccagaggttgtgtggattgcttcaagatgactcatatgggagaggaacacttgatgttgcttgctgccaagttgtggcccatggcagagtcctgccagtctgaatgtttagttgaacttccaaagactacctggtagatattatcatcgggatataagacttattttcttttatttccatgaacacgagtggtagaaatgaaatgttacattctttactaacacaaaatatagcagtaaacaagagcaagatacaagaatgggaagtgagaagtccagcataaggtagacctgatggattttgactttcaaagtttaactggctcaatggagactgcttacagattacaatctaattacaatagtaagcttgttgtttgatacctttttctggtgatccaaatactttttaacccacataagttgcaatactgacataccctgagaatttgatcaccttcctctaagccttccttggctgcagggctatcttctagaacgccagctacaaatattccaacatcatttccaccagccagccgcaaacccacactatctccttttctgaattttaccaatttcatgctgggcctgttaaaacagatatttcatttgaaacagttaagaagagcttaaaacgttatagcaatcactacagtgaaaactatattcagaattaaataaagaaccatcatttctaaaacttctctcataccactattttactaaataaaatttagtgttagaattcaaatcagacttaataacactattttctgattaacagttttggaatattcaaatttaatatgcaagtactattttacataactaatttataaaattactttgtaaaacaatgttttctcaactctcaaagagttatggtacattccaaatggctaaaaacatcttccattttttccaccccaattcacacatcatttctattaataactgaaaagtcaaattttttaaaataaaggtagaaattgaagtataaattggctaattttcctaacacgatggactcaaaataaggctccaagcattgtgatttctacatgtaacagagagtgatttttaaaaaaactttgcagttggtggagtctttcagtagttcacagagtagttcacttactctgctgcccctctgagttttacaatacaaatcatatagtcattcagcctttctacattagccccatatccattctgtccctttctagttctctgaatggaaaaaaaaaataatgcatacacacccacctctagcatcagtgtagtgttgaaaccttgtgacattccttaaaacaaatactaaaggatgccttctaagaactgactggatagaaacagactgtaattaaaaattacccactatatttcccttctagggattcataagtactctcacattcctagcaagaaaatacactattttacctattctgacaagaagtgtagaaaaaaatccctatactctttattatgtaatactaaccaaattattagaaactaatagataacaataacaacaacaacaacaaaaagtcaaataaatgaatgaaatgtgttgaggaaggagagatttctagtctctttaagccaactaaagagatcgccttaactttcagaacttactatttattcatttctgattgggttacctgacctggaactaacatcagctagtcataaaagtaagagcctgagaaatcagatgaggtctctcactggctggtggcatccttgatccctccatgaaactatttaccagctttactacaaatggtccaagccccttggttgtagtggtatcctagccaggtcaaaagcattctcatagattcctctcctaaacccattgtactgaaacctctttaaatatttcctcaaagtccttaagactccaggtctcagttgggtgtggcagctcaagcctataatgccagcactttgggagactgaggcaggaggactgcttgagcctaggagtttgttcccagccctgatcaacacagcaagaccctgtcactactaaaaaaaaaaaaaaaaaaaaaaaaaaaattagctgggtttcgtggctcgttgcctatagtcctagctactccgaaggctgaggtgggaggattcctcgagcctaggagtttgaggttatggtgagcaatgatcacaccattatactctagcctgggtgacagagtgaggccctgtctctttaaaacaaagcaaaacaaaaacaaaaacaaaagataggactttggaaatcctcttctaaccctgacccatctaatgtgcttcaaaaagcaaaaacaactgagcacagtatccaccctttagtaaaacatggcttctgaaaaccactgttagaagacagctttaggccatatctcaccaacagtgtcatgtgccttagatgactgacattttatactttgtcctgcctgcattatattaactacttgcagtagcaaaacagactcactaacttctgcatcaaatccattcattggctttaaatgaaaaaccaaacctttcctggcacagctactaatcctgtccacgtcctcaaatcttccttggtatttgttctcccagggaaggaggtctctggaatttttcttttttcttttttgagatggagttttgctctgtcacccaggctggagtgcagtggcgcgatctcggctcactgcaagctccacctcctgggttcatgccattctcctgcctcagcctcccgagtagctgggactacaggcgcccgccaccacgcccggctaatttttttgtatttttagtagagacggggtttcgccgtgttcagccaggatggtctcaatctcctgacctggtgatctgcccacctcggactcccaaagtgctgggattacaggcatgagccactgcgcccggccagtctctggaatcttatcattacagtttcctaaacctcaaacacttacacaagttttcaagcaattcccaagaaaggaaaagaaggggactatctatgcctgcacaatttataaaaggttgaattatcaattacctaatattaaaattgtacagttttaaacttgtaaaaaccccatctctttcaggaactacttctatctacctagctgggtctaaatctaacccacttgaggaaatctgccaattttctttttttttttgagacggagtctcgctctgtcacccaggctagagtgcagtggtgtgacctcggctcactgcaagctccgcctcctgggttcacgccattctcctgcctcaacctcccgagtagctgggactataggcgcccagctaattttttgtatttttagtagagatgggttttcaccatgttagccaggatggtcttgatctcctgacctcgtgattcgcccgcctcggcctcccaaagtgctaggtttacaggcataagccactgcgcccggcccggaattctgtcaattttcaattattcacatcatgtcccctttaccagtgccaataaaaaactaatttgggctgggtacagtggctcacatctgtaatcctagcactttgggaggctgaggttggtggactgcttgagcccaggacttttagaccagcctgggcaatgcggcgaaacaaaaccccgtctctactaaaaatacaaaaattagctaggtgtggtggtgtgtgtcctttcatcccagctactcaggaggctgaggtgggaggattgtttgagcccaagaggcagaggttgcagttagccgagattgcaccacggcactccagcctgggcgacagagcaagaccctgtttaaaaaaaaaaactaaccaaacaaacaaaaaactaatttgataatcatgatggtttgaaatttgtttacaaatttacatctcaattctaccaagtatataatgtaaagtaatgaaaggtgttaagatagtaaaaacttacttttgggttgctaactaccctagaacaggttctcaaccaatctcaaccatgattttgcccccaaggaaacatctggcaatgtctagagataattctaattgtcacaactaggggactgctactggcatctagtggccaggattgctgctaaacatgccacaatgcacaggacagcccctcacaacaaatgcttacctggcccaaaatgccactagtgctgagattgagaaacactgatttttttttttttttaatgctccattggaaagctgtggaaattctgatgtctgaatagaatttttttttttttctaattcctaatttaaaagctaggcaggagacagcggtgagaaagaaagcatccaaaaagttcctttgttgtctaatttctaactcactatcatatataagtagcagaatgttaaatataaaaataatcatagtattaggtggtatgtactattttaaaaaatatatgcaatatggtttacaattaaattcctactctgaataatgttaataatgaacaaagaaaacaatacaactttaaaattgtattaccgaagaatcccatcttcatgagttgaattaggtaggacaccatcagatggactgacaggtaaatccacatctggttgcccaacttgggcatacacaggctttggttctaagaaaaaaaaaattgagtaggactcactttagaaaaacatggaataataatgcaagcaaccaagcaatatatgattcataagttcagagaacctgatgaggaacatatctaccatatgtattagagtacattttatagtaataaattctgaagtctttataacaagtaggtatgttacacagtcacctgtgttttccatagttccagcaatcagaatttgaaaaatctattctttaagaacgaataacaaaaaatagatatgagaagagagaattcctacacttcccagttaagactgccaaagtagctacctttcctcattatgataaaatgtttttaaataaccatatttctgccactcagcaagcagagcaagaaagatgatttgagaaaaggaagtgaaagacatcagaaacaaaatctccaggcctcccaggcaaccgatcttagcaccttgctgattctgttttgtcttcacagacagctttaaaaggatgcttgggtcagacacagtggcttgcacctgtaatcccaacacactaggaagctgaggtgggaggactgtttgaggccaggagttggagaccaacctggacaacaaagcaagattccatctctccaaaacaacaacaaaaaacaaagaaaacccacaaaaaaaccccagaaaacccaaaatagccaggtgcggtggtgcacacctgtaatagggaggatcaggtggaaagacagctggagcccaggagttttgaggttacagcgagctaatcacaccactgcactccagctgggtgacagagtgagactctgtctcaaaaaaaaaaacccaaagacaataaataaaggtatactccataaaatgtttatgaaaacactttcaaaaaagcaaaataacttttctttttaaatttttgaagccaatctcatgtttctctttaaggagcagtgttggaaaacaactttactaattgcaagaagttgttaatgataaatattttctatctagaaagtaaaggaaaacattcatgaaaggcaactgatttgtgccaacctgctacccataaggaaaacgctggaagtcatatgcagacaaattcacacatgagaagaataataattgcatctttaaaatcttctgtaaatcctaacaattacttcactctacttgcaaatgtttcttgaacttagtgtttcgttatgcttacctggaagagaaggtgtttgtttctcatttctttcaactgtaacttcttccactgttttaggtgtgtgatcatcagcatgctttacaggagttgagacagccccaggtttagaaattctctcttcatctctactccggagactgtgtgtcattaaaataaaaaatcaagagcataagaatgattctggaaagcatctgtaagagaacagtataagaagaggcaatgcaacttcaaaaacaatgacaacctgctctaacagataccaaaatattgtaaaaacctagtaattaaaaatagagcattaccacagaaaaaccaaatagattcatgtaataaaatcgaaaatgaagaaatatatctataatagcaaaatttatcatgaaagtagcattccaaacaaaactgttggagaaggaacataacatttaataaatggtgtcgggacaactgtccacaaatgtagaaaaattagatccgtatgtttaacaatgacaaaaataaactgatttcagatgaaatcaagtcctaaaaaaagagtttaaacattcacataatcaacaggagtcttctaaagtaagactcaatgaagccacagtatatcaacaaaagtgattacataaaaataaagtacgtgcaaataattgggaaacatatataatactgggctgaactaaatgaaatgggaattctttagttcaaacagctcgatgttaactatttcatacagtttaactaaatacaaatgttgactatgtactgacctaagtaacatatataagaatttggtacttaaaaaaagaaaagacaggcatgatggctcacgtctgtaattccagcactttgggaggccaaggcaagaggactgcttgagcccaggagtttgagaccagctgggcaacatagcaaattccatactctgtaaaaaaaatttaaaatttagccaggcactgtcacttgttcctacagtcctagctatttaagtggctgaggtgggagaattgcttgagccgaggagttggaggctgaagtgagctatgatagagccactacactccagcctaggcaacagaacaagactccgtctctttgaaaaagaaaaaaagaactataaatcaatcaagacaactcaagagagaaatgcaaaaatacaaagaagcttttcagcaaaaaggatgtacaaatacgtaataaatatgcaaacacatttaacctcactaggaactagggaaatacaaattaattagaaactgtattatcggccgggcacagtagctcatgcctgtattcccagcattttgggaggcagaggcaggcggatcacgaggtcaagaaatcaagaccatcctggccagtaaggtgaaaccctgtctctactaaaaatacaaaaattagcccggcgtggtggcatgcgcctatagtcccagctactcgtgaggctgaggcaggagaatcaattgaacccaggaggcagaggttgcagtgagccaagatcgtgccactgcactccagcttggtgacagagcaagactctgtctcaaaaaaaagaaatcatattatcatccatgagaactttcacatgataacatcactggtagggaaagatatggagaaacagacatattcacaaaatgatggtaaaagtgtatgactatttgaaggcaaaatggaaattatcaaaacaaaaaatgtaactaggtcatacactataattccacttctatatttattctagagaaatacaaatgtactcaagaaaacatttataagaacattcattctagtatcagttttagtggcaagaaacaaaataaaactaaatgttcattaataatttccccagataaacagaaatcataaagtgtaccaagacaatatatattttaaaagaagccaataaatatatcttgaataaaaagataaatcaagatctataattttacaaagtatcacgtatatatggttttacagctgcattctcccaacctcggaaaaacaaaataatttgtttaattatcctggaccacagaaaaatataaaaagctctctaattcacttaaaaaaaaactttatttccaaacatatacagccatacagagaacagtatcataaaaccccatgtactcatcgtcgacaattatcaatactctagtcatcagcattccaatctgaggctaccagaacctttaacatccaaatcttgatgacaagagtacaaagagagaaaataatatatttttcattatgaatggaggaaaaaattctaaataaataaaatactagctaggagaatacagtagtgtattagaagactatcatcagggttatttcaagggtgcaagattagttcgacattaggaatttactgacacaattcattattatgcacaaatatttacagaaaaaagtgttaatatcaaactggcatgagaaaatttgcagtcattcctaaacaaaaactgaaataagcaatataattatgaaagaaactattttctaaaaccaagagcaaacatcctatcaaatagtgaaatgctgaatgtatttacactatttacaccaaactcagtaacaggacagtgatacctgtgaacactactgttattcactctgattttgaagacccaggtagtataatcacgagctaatggtcccaaaatattgaaaaaaaaaaaaaaacttaatgaatattaaagactactgaaaaatttcctgaattaagataattttaattacataaaaaaatcttttgtcaatatcgtcaacaatcagatggaaatgaaagggaaaaaataacaccagtaacaagaacattaaacattctaaaactttagactgggggaagcctttgcaagtaggatagaaattcggaagccataaaggcaagataaaaatatctgacaagattaaaaacttttacttgcacaggaaaagatattataaagacttacatttgaaacacagctatatcagtaatctggtactagccattaaaaattttgaacaacacaaacacactctttaaggactttagaaataaaatgcaccagcacagtacatgaaatcaggtacgaaggtgcttactgccatgttttcgcaggcaaatacctagaaacaagatgtccataatacggaaagtttcttatcaaaagaataaactggatgttcaccttgtattgttcaactgaaataatttagctgagtaataattcaaatcctgatctcttaattattaaaagaaaaacccaaaccctatatatgataccaaatgtcagtacgagtctggagaatggcttaattcaagaagagtgagaactgggggtgaactgggggtgaagtggagttggtggatttgatctatttcacttgttctaataagcatgcattgtttgtaaaagactattaaaattaggtgtaatgaaatagaatgatatgtacagacatgaaaactttaaaacggctgggcgcagtggctcacgcctgtaatcccagcactttgggaggctgaggcgggcggatcacaaggtcagaagatcgagaccatcctggctacgggtgaaaccctgtctctactaaaaatacaaaaaaaattggctgggcgtggtggcgggagcctgcagtcccagctactctggaggctgaggcaggagaatggcgtgaacccgggaggcggagcttgcagtgagcccagatggagccactgcactccagcctggacgacagagtgagactccgtctcaaaaaaaaaaaaagaaagaaaataacttcaaaacaaaatgccaaataagacacacagattacagaatacatatagcaggataccatatagctatttaaaaacttttctctaaaatataaacagacatgtttgcacatgcccatgtacagacaagcaacagataccaaataagcaacagtggttcaccttggagggaaaaatagccaaaatagtagccaagaggaattttacagttatctctactatttcaacttttacaaaaatttacttattataataaagattgaaaaaatatatttaaaattatttttaaagactaactttaaacataaaatttggttttattaacgtatattattagtagtctcttttcaggaaaaggtttctttctatgttgtcttcctgaaggaataaaaaataagtactttgcatagtttctatttttgtattcttttaaccattctgtggaggtgtattctacttttaagttggtatattcttaatgagctgcactgaagtagaacaatcttttaggaaaaaaaaaaaagccaagatattttctagctcaaacaaggatgagctacttttaaattggaaaagattggccggttaaatatgcaaatgatgtttaacatgaaacatcactcctgtaatcccagcactttgggaggccgaggtcggtggatcacctgaggtcaggagttcgagatcagcctgaccaacatggtgaaaacccctctctactaaaaaaacaaaaattagttgggtgtggtggcacgcacctgtaatcccagatacttcggaggttgaggcacaagaatcgcttaaacctgggaggcagaggttgcagtgagccgatattgcgccactgcactccagcctgggcaagacagcgagactttgtctcaataaataaataaataaatacaataaattgtaaaagatcaaaatttttagccattacttgtgtaataaaatatcacaattagctaagtataaatcaacaaaattaagctctatccccaaattgtgctgtgctcctcagattaaaagggaagtgcaaaatagtaaattatcctgcattgtttgcattaaaaaatatgattaatatattataaatacaaaattatttttaaaaagagaaaagtgaaaaaataagttaaaatgagtatttttaaagagaatgagttacccacaaaattttaatagttctacagatttctattgctctgtacaaagcagaatttgtttagaaaaggtaagaattccaattaattttcttctttcttgtaactgatcaaaacttctaaaaattaaaatgtgattaacagacattaccatcttggtattttaacttacaatattttaactcaaatgctctcctcaatgataaacgataggtcgtcattggctatacatgtagggctcttgctccatatatcacacaaaacttctgggagtatttttatctttggccaatttgcataccccattgctaattacctttttgtcctgtgatacaatcattataacattaaatgcaattagccttccaaaacaacatttcacataaatgggactcacaccattctattcaatttttcatacaattaatatttgaaatattagcttttgttagtgcatttccattatctaccaaaagatggaggcatttttcaataatacataaagatctagaacagtactgtttaagagaattataaaatgagctgcttacgtaattaaaaattttctagaatccatgttaaataaaataaggcgaaatcaatttataaattttattactcaatgtatctaaagtagtatttcatcatctaagttattaatgaggtattttacattttttgcatactgtgttttcaaaatccaatgtgcatttcacactaacaatacacctcgatttggactggccacatttcaaatgttgaacagtgacatgtggctactggctatggtgttggactatgcagatctagagttacagcacaaaataaaataatcaacttttccaaacattaaaatgttctttcacaagcaaatgtgactatgaagtcaagataaaatctgaatttacacatgaaattagtcaacaatcagtggcaattattgaaagaaattgtgaggttgtgataatgaatcacatttttcccaaaccttcctaattcttttttttttttttttttttttttttttgagtcagggtctcaatgttgccctggctggagtgcagtggcacaatcatacttcactgcagcctcaacctcccaggctcaagcaatcctcccacctcagcctgcaagagtagctggactacagatgcgtgccaccataccctgctaactttttctacttgttgtagagatggggtttcgctatgttgcccaggcgagtctcgaacttctgggttcaagttatcctcctacttcggcttccaaaagtgctggattacaggtgcaagccaccatgcccagcccttcctcacataattctatcctaatggctctccatatttaagcttaaaaatgtgtgtgtgtgtgtgtgtgtgtgtgtgtgtgcgcgtgtgtgcgcgcgcgcgtttgctattatgaggaaagctttctataaaaattatgtgttcggagtcaggttcatgtttacgtattccagctcctggtagcctagaaggaaactttgggcattttaaggtacctcaagatcctcttatgggcacttttgcttttccccagaagggtaagacgagtttctgttgtttttttttttttgtattaacttgcacgtattaatctaaaggtaatgaccttgttatctggaggctatgagctagttgaaagctctagacaagacagctgacaaagatggactggaaaggagtctctgagagagattttataggtcacatgaacggactcactgttaagcagagcctactttaggtcttacccaatcaaatgtgtgaccagtgtagccgattaatacacactcaattagattagcaaggagtaacatgctgtttcaagtaaaaaactttggttgtgaaattgcagctgtttggagccatttagtagaggcagagggcatgcagcatggtcagtacagggtcctggggagacgctgtaggagagaaggtgcatcccctcagcatgctcctgcagtgcccagcatcctaaagtactcggtggccagcagcctgctccagagactctctcaaacggttctgttgtgtgaagtctcccatgagatacctccccagcacatgggagtacaaataccatgcaagttcgtctggtgacataccacagcaaattctcggccactcagtgagcaccgttgttccctttccaagaaggccagatctcagccctgaggatgagtgagtgggagcctcttcctttggcactctatctcagcaccaaggagagtagctgctccttctatctgtggttcttttgtgctttgtttttgagacggagtcacgctctgtcacccaggctggagtgcagtgacgcaatctcggctcactgcaacctccgcctcctgggttcaagttattctcctgtctcagcctcctgagtagctgggattacaggagcatgccactgtgtccggctaatttttttttttttttgagactgagtctcggtctgtcacccaggctggaagtgcagtggtgcgatcctggctcactgcaagctccgcctcccgggttcacgccattctcctgcctcagtctcccgagcagctggactacaggcacgtgccaccacgcccagctaattttttgtatttttagtagagacagggtttcaccgtgttagccaggatggtcttgatctgccctcatgatcagcccgcctcagcctcccaaagtgctgggattacaggcgtgagccaccacgcccggcctaattttttgtattttagtagagacagggtttcaccgtgttgcccaggctggtcttgaactcctgagttcaggcaatctgctcgcctcggcctcccaaagtgctgagattacaggtgtgagccactgcgcccagccctatccgtggttcttaatcttcagagctctctttagttcttaccagtcaatccctcattactcctgttatgtttaatttctttacattcaactttctctgttcatggaaactgtgctttctgtctcctgattgataagatatgcctggtcgccatttcatagccctttccctcttacttctagctctatgaacacctttccaatcaacttgatgtgccttattttaaaaataaccttaatacaggaaataaatgaagcgctgaacattcactctagtagaatatccttttataaagccaactccccattacaaattaaagacttatactacaaaaacggatttatacatacttttcacaagttcattaattgcataaggtaggcaagaacaccacagtttaggttgaaaacaaaagctagctactaatccctttaaaaggcattggattatctcaaccacaattaacaataaaaatatgctaagaatttaagttaactgtattccaaagttttttccactgacaggaaaatttcagcctggaaggctctattgcaaaaagacagaaaagtgaaggcacactccagtttcatacttagaatgttgcaatcactgctaatcctctgattttatatggaaacaaatatatacacattgaagttcccccttcacaacgattaaaaaatggtctctctctgcactggtacccaaagaattctggggatgagaaagcaagagatacagggctggtacttgggaacaaaaggtaaaaaagttgcccaggaagtatgctgagaaggcaagaaaataattaccttaattccactttgtcattttgtaagctaatttctcacaatgtaaatctgtcctttacatgtaatctgctttctaaaacatacatgtgttcatgagcatgcttctgaaaaaatctgagtctatttcactgtgatattgtttttaggcaataatttagatgtatgtgtttgtggagcttattcttctgtacaagtgcttctcatcttaaacattcatctattaatctagtccatccgcattagaagaaaaacaggtctgtggttcaaaagtaattttcatggatatggacaacttttagtaagaaacaactgaggaaagcccaagaggacttttgtctcacttaaagaattgtgttgttacaccttcattggtggtataatgattattctgtactttgactaatacttatgactaacatagcactttgtgcagtttatttggtagattttatagtgggagaccaatgtcacaaatcttattaggattctctcagagaaaacagaaaattgtctcacatttaaaaaatctgcaaataagtttttttgtatatttactattttagacaagtggagcagtttgtttttaaatttgccatttttaaatattgtacttgtagaagaaaacaaatctcagctgatggagtaaataaactttatacttttactttttatttttgtactacttatttttgagacagggccttgttctattgcccaggctacagttcagtggcgtgatcatggcacactgcagcctcaacctcttgggctcaagcaggcgatccttccacctcagcctcctgagtacccaggatcacagatgtgcaccaccacgcccggctaaatacacttttttttttttttccccccagacggagtctcgctctgtcacccaggctggagtgcagtggcatgatctcggctcactgcaacctctgcctcccaggttcaagcgattctcctgcctcagccttccgagtagctgggattataggcacacgccaccacgcctagctaattttggtatttttagtagagactgggtttcaccatgttggccaggctggtcttgaactcctgacctcaagtgatcttgcccaccttggcctcccaaagtgctgagattacaggtgtaagccatcgtgcctggcctactttcactttttaaacgggatatatgataaatattgaagcctgcctttctgctatttgatccatgatctcctcttaagggttaaaatctaacagcaatcactgaataccccatgactatacttgggtttccattaactagagaaacttaatcaactaaaatcttccctcttttggcccctcacaaaagcacactgaaaataaaacctcacattggaatttcaatgaagtaacctgaaatcccctcaaactgaaaataacagttcgttcacaaaagttcaggatgtcatcgatattccactcactttgaaatgttagataaaacatattagcaaaaaagcatttaataacatttcaagtaataaacaacattaaaaaaactttcatgttctaaccaaattttttaaaacagaaaaaattcacttcttggatctccaaatcactttctcccttgctcttatgatgtagccacatgggctatattgctgcccttccagtaggtcgagtttccatctcaggagcagtacacgctttgccttattccagaatgaccttcacctgccagggtctttcttacccagttcaaaatgatgtgacctcagagaagctttcttccctgagcctgttatttaatattgtcccctcctgcttcactattacactaccctgattctctttatagcatttaaccactaacgaaaatttactttttgtattttcaaatttatgtatttgctttggatatagagcttacatccaaatgatagcagggatcttgcctaagattgctcaggatatggccaggcgcagtggctcacgcctgtaatcccagcactttgggaggctgaggcaggcagatcacgaggtcaggagatcgagaccatcctggctaacacagtgaaaccccgtctctactaaaaaacacaaaaaattagccaggcgtggtggcgggtgcctgtagtcccagctactcaggaggctgaggcaggagaatagcgtgaacctgggaggcggagctcgcagtgagccgagatcgtgccactgcactccagcctgggagacagagcaagactctgtgtcaaaaaaaaaaaaaaaaaaaaaaaaaagattgctcaggatatttatcgccatacactgataacatatatgtgacattagtaagtatttggcaaaggacgaatgagcaggataacatccacattactggtaaaatctttcaaccttcactacagaaggaacattcactgtggtgccgcctgttgatcactcagaactatgcacattggtcacggtgtaaggtacaggagccatgggaaagaagtcactgattcgactcgctgattaaccattgaaatacttaatgaatcatatctttctaactggcaccctttctatctttctcagatgaaagggaaacagaaaaaaaaaaaaaaaacaaaggtaaaggacctcatggtgagcctaaaaaagaacacgtagtactaccaacaccatgttcactaccaacaatatatgtaattcttgtttagaataaagcacttatcaaattggagttatgaaatttatttagacaaaagactaacaccaatgatcagtaaataaaatctgaaactcaccaatcagggtatatacccaaggaatataaatcattctaccataaagacatatgcaaacaaatgttcactgcagcactattcacaatagcaaagacatggagtcaacctatatgcccaccaatgacagagtggataaagaaaatgtggtacatatacaccatggaatactatgcagccataaaaaagaacatgtcttttgccagaacatgagtggagctggaggccattacccttagcaaacgaatgcaggaacagaaaaccaaacactgcatgttctcacttgtaagtgggagctaaatggtaagaacttacgaacacaaagaaaacaacaggcactggggtctacttgaggggggagggtaggaggagggagaacaagagaaaactattggatactgggtttaacatctgggtgatgaaatagtacgtacaaaacacgatgacacatgtttacctacgtaacaaacctgcatatgtacccctaaacctaaaagtcaaaaaaattaaaaagaaattcactagtcagaagatcgttacctctccacatttgaaatagaaaaaaaaatgctcatcaatattaggatgtttcaacaataatttttagcctattggcaaagttgcacaggttaagcatcccttgcctaaaatgcttgggaccagaactgttttggatttcggattttggaatatgtgcatcatactggttacccattgagcagccctaatctgaaaatgcaaagtctgaaatgcatttcccttgagcgtcatgttggcactcaagttttggattttggagcattttggattttgcactttcagattacctacgctcaacctgtatgtaagtttcagagaaaattaagcaatatgtgacagaaactatatacagtaagatgaaataatatttatagttctcaaatgctgacgaaaacaattatggaaggtagaggaaaaggtgtgtaaataaaaaactagatctttaatttaaaagctaagaccacataaggatattttaatcaacaatggaccccacagacaatagtggtccctgaagattaaaatactgtagttgtactgtcctttcctacgtttaagatacacaaatgctaactgctgtttcaactgcctacagtatttggtacagtaacctgctgtacaggtttgtagcctaggagcaataggctacaccatatagcctgggtgtgtggcaggctctaccacctaggtttgtgtaagtacactctatgatgttcacacaaggatgcatttctcagaaggtatccccatcaagtgacacgtgactgcacattatatgctctacctgcatgtttatttggacttactcagcactcttggaaaactcctaatatggagtggattgtatagataagaggttttgatcccaaatatatgatcttaacttggccaaacgtgaatttaggctaaaaatttctgattcagaaaattcaattttactgtcatgtatttgctgtatcataagctgtatcaatgctgacacaccttttactttagaattcagtagaggcatttctcaggaggaacaatgaatgaagagattaaataactgttacaaagtttcaatcttctgaaaacactgcttttaagtttctcagaactaaccattttcgtaaaatggatttgctaaatataaactggactgtttttctatttgtgaaaacacattccccaaacactttagaaaacagtttaggccttagatgaactctgttggtttcagggaatgagtgtaacaaatgtaaatgggtagaatgccaaatgtaaatcttgacaatccaaatttcccacatttcaatttcatcctgttagtctgaacttttactgtaatagaattttttcaatattgtacctgcttatgactaatcatgctcacttttataaaaatttatagaataaaaaaggtaaacacctgttgttccctctaacatacaatgttagagggaaacataaaatgggtctgttaaaatagctgtaaatatgaggaagaatacaatctaaccaagcagaggcctagatcataccctgcaaatcaaatactctctacttatgcagggactacaggaagatcagtgaaatctcttttcaatgatacccactcagtaatcaccaagaagcaaagtgtcaccatcaactgtgggctctctcagtattcccagctcctacagcccaagtcttggcccagactgggctctgcaacaatactaagtgaaatacaaaacaaagcaaacaagcccagcaacaagcatcaagttataagaaaaccactgtaattattttccctatgtatatgtattttttgaatttaaaaacaaaactattttaacattccagacaaagcatttggaaactttttctgtaattgactcccttggccatatagtctctcttataacttcttgattatgccattgtggaatgggtttccaataaaactttacaaaaggaggaggctggatttagcccacacagtgcagtctgccaactccagttctagacaacagtgaggatactttgttcatctaattataatgaagaacaagcttgtgtgtttttctcagaattctctccatatgtttgctctctaagaaaagaatatcacacagaggaacataagtaggtcatgacaacaatggaacgctggtagattttagtttcctgaagattaagtagtaattaagctatgaaatttctttctctacaccagtaaggtcaaagatttgggtcaaagagccaacagttttaatcctggccccaatcccaggtcaacaacataaccctggactttattgcaacctctcaattttagtttgcttaactatatagaatgaggaaatctcagaaaatggttaaatacaagcagataagaaagcacatttggaaattctaacttatgatactattattactactatgaatcaccataataattacagtagcgaacacatgtgccaggtattgtaataactaatttctcaccattctgtaacgtatgacctgcctgcttcactgcatatggggatgctgaaacacagaggtttcaaggttatgcaagtaaccaaaggcaggctgggacatgaacccaggaagtccggctccaaagccctaagaattcactatattctatcacttctcacaaaatgaagatgaagaggttattattctcagcagataatcgcacatcctaaaaatatacaaaagtattcagaaatctaggaagagaacagggcagggctgatgtttgccaagacagacttccttttacactcaagtgaaacctttctcacagagaccaggtcatttttttatcacttctttaaagataatttacatacaatttgtaaaacaaaaagacacttatacagccaaaattaaataaaaaaaacaaaagactatatatggaagtcctttagtgtttttttacactagcattttactcttataatgtatctaagttgtttctcaaaatgcagggaatgctctaaattaaaactccacagttacaggatttgaagattcaactttggggtggaaatgaaacctttaagcaactggtactatttatatcttgtctgtaggcagattactaaattttcaggaattaaattctcaccacaaaaaatatgaaaagaacctgaagagatttttccttctgtagttgaagttaccttttcttttatacactatactttctaaccattagttcccacatctagcagtgcacataagagaaagatgccaggagcttaaaaacaaaaaaatacagttgacccttgaagagcatgagatttaactgtgtgggtccacttacactcgaattttcttccacctctgccacccatgatacagaaagaccaacctctcctattcctcagacgactaaatgtgaaaacaaggatgaaggaaatgagcagtgaaggaaaacgaggatgaagacctttatgatgatccactttcacctaatgaacagtaaatgtattttctcttatgattttcttattaacactttcttttctttagcttactttaagaatactgaatataatacatctaacctacaaactttgtactgtttatgttatcagtaagcttccactcaacagtaggctattaatagttaagtttttgggaagttaaaaatcacaggtggatttttgactgtgtgtcgggggtgagagggaggttttggtcccccctaaaccccaggttgttcgagggtcaaatgtattgcctgcttccgtctcagatcagctgaaagcaagccccagaagtttgtatttttaaaagctcccatattactggtgctacccatgaaaatacttaagatacctaggagaaaaaaaaatcacaatataacacaaaaatagtaattttaggggggaaaaaccctccacttttaagttaaggttacagattctaagtgctgaggaactctaaatgaagaaagtggacatcaaaaagaattttctaagattgaaaattttttacaatctaaactaatggcccaacatttgagattttgattcagattgcgttatttaaaaggggaaatcatgtccaaattacttaagcatggtttctagctgagaaatagatgttaaaattacagctgctcccgtgaatcatcaaaggtgctatatcactgtgtgtgtgtatgtgttgcggcagtaatccttttcctgataacaatctatgctgtgccaggaagatttttagaatatattaactgcagcaattaaaaatcatcatcagttataagataagccaactttacacgtaacatgccataatattcctttaaaaaatcattacatccttaaaataaacaccagggttctcataatttataaatctaggtttgaaatttagaaataatcagcttcacaaatacataaaaactacagtagatacgaattagcaaccacattcatagctcttacaagttatcctcttctcttactagttcccattttagtagaatgcgaaacactttacagttttaactaccactgtcactgcggttttttacaaactttaaaaaagctctctcctggctaggtacgcctcccttttcttacttctccctcgcctcttcaccttcctaaaagaacgtgctccctgttatccagttctctgccttctttccaaactgtttctcttagcaattttagtgacttctatggcttcagctaacacctctatgcaagttaagtctcaattcaacatctctaatcctaaatcatctcttcagatctagacccaaatttactttttctttccagctttactgaggtccaattgacaaataaacattgtatctattaaaggtgtacaacagtgatgttttgatatacatattcaaatgatgaccgagaccaagttaattaacatatccatacctcatagttacttttcttagtgtgtgtcaaaagaatgccttaagatctactctcttagcaaatttcaagtatacgttattaactcttgtcactacactgtaaattaggtctccagaacttactcatcttataattgaaactgtgtaccctttaacaaacatctccccattcctccccacccctaacccctggtaaccaccattctactgtctgtttctatgagttcaacttgcttaggttccacagtaagtgaggtcatgcagtgtttgtctttctgtgtctggtttatttcacttagcacaatgccctccaggttcatccatgttgttccaaatggcaggatttccttctttttaaaggctaaatcacatttcattgtgtgtgtgaacattttctttatccattcatgtgttcgacattcaggttgactccataccttggctattgtgaataatgctgcaacaaacatgagagtgcagatatctcttcgagacagtgatttcatttcctttggatatgtacccagaagtggaattgctggatcatgtgctagttcgttctggttttaattttttgaggaacctccatactgttttccagaatggccgtatcaattacattctcatcaacaacgtataagggttcccttttcttctaaactgtctcttcagccctggactcatgtttcaagtgatcttcatgtggactgcagttaaccatgggtcaggtggtggcctatagagccttgggagtctccagaaattgtatgcaattgctgcgtgtatgtgcacatgcacatttttctggagagaaggatcataattttcttcagattctcaaatgtacgtgtgactctaaagaaagataaactcaggtaggtcatatactaccagtataccagaacctttggcataaatactagtgttttgttttgtttttgagaaagagttccgctctgtcaccaaggctggagtgcagtggtgcgatctcggctcactgcaacctccgcttcccaggttcaagcaattctcatgtctcagcctcccgagtagctgggattacaagcatgtgccaacactacctggctaatttttgtatttttagtagagacagagtttcaccatgtcggccaggctggtcttgatctcctggcctcaagtgatccgcctgcctcggcctcccaaagtgctgggattacaggtgtgagccaccgcgcccggccaacactagtgtatttttaaaagagaaaacaaagtccaggttaatgtgtttattaaaggacttctgtagttaactttcccaagcagtagatttctgaagcttgctagcatcttctaatgcaatagtatgacaaactgcagctgcggatcaaccgcttttgtaaataaagttttatgggaacatagtcatgcccattcatttacacattgtctatggttgcttttgcagttgagcagtgaaaagaactatatggcctgcatgattgaaatatgtttactatctggccctttaagggaaagtttgcggttattttagatttaaaaaatgtctaagttgagaaaaacagatctaatcttgaataatcaaaagaaatacatcttttaattttatttgtaagcaatttcagatactggtatcaagcaaacaaaacccctgtattttttaaaaaaatagggtgtcttacctgccattgcttggctgctgcggcgagtgcctggaatgatcagaaggctctgaccgctggtcaggagatcgtgaccggctgcggcggggaggcctatcgtgtgatcgaccagaatgatctgatgccagtgactgaatttctgaaatgtctgttaataaaagggtgctacttattttcccacaaaaataattacagtcaagtataaggtactccagtaataatgaagataagctagtaagtaaaattatatataaaatggaagatttatgcattaatttcacctgccagcaatcatatcaatagtggtgagttgtctacaggaaaaaatgtatataaaacttatagattttgaaggtgtttggctggtagaaaattatcatttcattcaaagatgttcaatctccctagtattttaagaaaataggtcacttagagggaacgttcaaacagaatcacactcaccgtctctctcagaggcattagcagagtggatgctgtcagaaagatcagggacattcaatagcgtagcccgttcatctctttgaactaccatttttaatttgcctttagacctttctatcaatgtctttgcatctgtcaatgacatattttctgtcacagtaccatttatctgcaacagaaaataaattacagcttgaaagtaaataataaaatacaaatgttaacttagtttgttataaacagaaatatccaaaccactccttgctatgaaaaccaaaatattctctctacacttttccaaactgtcaaagtattccaccttcttgagatgataaaatctttactgtactgttgctgtcagaaaaacccatagtagcatcccctaactccttctttgaggctgtcactttctattacttataaacaaacgaataaataagcatttcaatagtatctggaagcaattatcagaactttttaatgtgtaagaacagacatatctatctacaaagtagtaccggcctgtgaataattatctcaggatgaccctgtgatacctaaagcattggtgtcgacatgtaataatgcataaagggaatttatatccctctcccccaaacactgatttttaattctctttggcaaaactgcttcaaacaagagcacagactacatggtaactctagaacttgttttctatttcagttcattaaaaagtaagaatatgattataccttcaatacaacatcaccttcttgaatattgccatctcttgctgccaaactatcttgtgaaatttccttaacaaatatatggcttgccaatcgaagaccatattctgaaataatgtaagtaagtgtttttagtataacatcctaagacacctaaatagattttacaagtatacaactaaactaattaactactgcatagagttttcaagtacaatcaataacaagaaatatttcttggccatcctgcaaataagacattccctctaattagcaagtctgcaatgtctccgtgaaagccaagggaaagtgtatggttcaaacgaaggactgatagaccgtgttcccatattactgaaaaggagaaaatccccaagaggacaccatttctttttgaccaagcattgatacactagctcttcagaatgattaaggaatacaattttctttaagagacagggtctcactatgttgcccaggctggacttgaattcctggggccaaaaaaccctcctgcctcaggctccagagtagctgggactaacagacatgtgtcacactatgcctggctagagatataattctaaagagtaaactgcttgaggtttgaaaaactttgaaaagattgaccattttattgatgactattatcatgcatatactacttctatttttcccagctcctagaccaaaaatatttctgatcctatacaccccatgacactggatagacatactcagagtactagcatgtactaagcatgagtgcaaaggcttacaaccagccaggcagatgtgggcaggagttataatgccaatcctttcctttaaacaaccaacaaagtatccaagagtgagaacatcactccgtctgtgggtaaggaatgttggaagttgaggaaattactagcagagtccagagaactgcccaggttcctgcaacagctgcagaaaaacatattttaagaaaaataagaacaatgactacaactatcaatataatgtcaatagtaaaaggattgcccctggttctgtgaggagagtcttactgcattaaaaacaaaatcaaaaaccaagatggaaaacagaaaactgttttaacatgggataaattaacagacctattacctaagtgtttaaaaattacataagagtaggctgggcatggtggctcatgcctgtaattccagcactttgggaggccaaggcgggcggaccacaaggtcaggagttcgagaccagcctggctagcatggtaaaaccgtctctattaaaaatacaaaaaattagctgggcatggtggtgcacacctataatcccagctacttgggaggctgagggaggagaactgcttgaacctgggaggcagaggttgcagtgaactgagattgtgccactgcactccaagcctgagagagagagtgagactccgtctcaaaaaaaaaaaaaaaaattacatcagaattacagtttaacttaagacaaatatacaaagagtactcacagccagaaatagaatcagggtgaagaaaacggccttttaggatatctgggcaaggaatgaggcagtcatccatatggtcattacatcacagaaggatagggtattggttaaaagactgttcttcaagattaaacacttataaatgaccattacacagatgaccccaaaatatttcttgtatattagtttgttcgttcattctaaatatttcttggggtatatatgaactaggtaccaggcattagggagaaagcagcaaatgagatagttcctgcactctggcaatttgcagtcagtgaaaaaaaggatgttagcatggtaatcccaaatgcggtgagttcagagggcagaaacacaagggttcttcacttactagggggaaggagaaggccgccctgaggaagatatactaaagttaaaactttacctaagaaagacctaaacctgaagggtatgtttgtgggggaggggatgcatggggtgagtgacggctgaaaagttcaaaacaaatgcatcaaagtaatgaagaaaaaaacctggtggacctaatgaagtcataagtctagtgtagctgagactgagaactaataaagaaaggggcaaaagagtaagacagaagtgtcacagaggatctatgaagaaatctgcagaatcaacttaaagggatccaagagacaacctatgagaccaaatgagtctatgtaagagatgacagtggcttggaaaagggtggaggcagtggagaaagagtgggatggataagagtggtattcaggagtgaggacattcatcatgcatgggaaaaaaagagaaggcaagggtaactaccatgtcatctgggaatggcctgagaaactggatcaatagaaacacattcaactgaatacttcatgagaaatacaaagaaaaattttaagagggagatgagtttcatttgagatgtgctgtgtttcagggacctacaggaacatctaagtgaatatgcctaacagttggaacacaagagtgtaaagatttgggctggagaaagaggttctgccatcatcagcagtgactggaagcaggggagcagatgagattgcctaaattaattgttattcaacctgaggaaaagaaaaaaaaagttaccttaagtggaaaaaaagattctaggagagaaactgacagaacgttataaagggcagggtgaggagaatgagcttgcaaaagatacagaaaggtgggggaaaaaaacagaaagatacagtactaccaaagaagacattatttttgaaaataaggagtggttaaccatgtgaaatgatactgaaaaggcaagcaagctagagactgaaaaacttccactagatttagtgtgaacatttttgggggcagagcggaaaagataccagaccagagaggattgaggggtaagtagtgaagtaaaaacagcaaatgttgacaacttcactgagacttcactgaatgggggtatggaataccacctaggagatatgccaagtggtaaagcagatcaaagtaagtcttgataatattccaactgtaacaccctttatatcaaaatgatcagtcatgcatgcccacagaaggagcaagccacagtcagatccattttttatcaaatttaatgaggcatgagggaaagcagctgagtttcagtttcaaaaacttcaaagaagtactgcattatggagaaatgctctataaggggttcctttccttaaattcctccatttaaaaaaaacagtctggagtgagggggaagaagtcccagcagggcacagtggcttcccgcctataatcccagcactgtgggaggccgaggcaggtgaattgcctgagcttaccaatttgagaacagcttgggcaacacggcaaaaaccctgtctctacccaaaataaaaaaattagctggacatggtggcatgtacttgtacttccagctaccagggaggctgaagtgggaggactgcttgagcctgggaagcagaggttgcagggagctgagattgtgccactgcactccagcctgggtgacagagccagaccttgtaacaacaacaaaaacaacaacaacaacaacactcccaagatttctctccatgattacactactaacagttaagaaaaacactgaatttccatttggtgatggtgtgacatttcttgttagcataatttgtacctggctattctcatcacaacaaatccaaaagccaagccctggacaattcacttgaagtgttatctgttccaacggaaaaaatgaacagtccctgaagcctgccataacaggatttgacttacagtgatagaacacaaacacaaagacaacaaagcaaagacatgaagagacagcaactgtacttctcattaaaattagttttaaattttcatgtgaaaaaaacagcaagagttggcagagaataccttcatttttccgggatttcaccagtgtgactttagtaggtttagcaggctggctggaagccactgaccgcctgtctgaccgcggggacaagctcctctctctacttgcacttctatccctcggccaaatcttctcactccttctgttaaccacaccactccggccacttcttggatcatgtatttcctcatcataactatcttcttcattatcagatactggttcaggatcaggacgacttactggtatttgaactttcttcttccttctaattgtctgcaagttaaaaaggttaaaaaataagttgactgattttcatatatgtacgttcagttccaaagagaaaggaatattacacttctcatcccatattaactatgaaccagcaagaaacaatacacaaacaactacaacaaatttctaaggaatacatttccataaaggctgtgttttctgttctcctgataaacagatctggttaagcacaaataagaacgagtgggcctaaaaacctctttatttacttcacacagaaagatcttcctggtgtaataatcacaagcttacagggaaactaacaactgttggtggtttgaataaaaaggacagcactgtactctaatgccatcaaatatactctaggtgctaccaaaaccacagcaaacttccatgcccaacttgcttccttaaaaattttagaatgcatcaatatcaaagcccacaattgccccagacctctaagagataatttattctatagccgcactaacattcaataatatgttggagctaattaactcagccgtacttcaccaacacaaactgctttcagtctctggatctcttcaatttgtactcccagtctaggtgcaaattcttccctctggcgttcttttctcaatgattctggtaactggctctgtattgcctgtccacttatttccttcattctctgcaagctgacgatctacatgtattacacctgctgactgaatggccctgtaatctgtggactacactttgccttctcacaatagtatacacttgacctcactgtagttctacaggatctccttgtgtatcactccttgtcttctatgtcggacaccttgagctactgaaacttttcactatcttatttccaattccttcatcttagttcatcagttccatcctggtttcactcgcattccccctaagtttgcatgagacatcctgttgccatatttaaatgactttttcttgacccctcaatcatctgccctgacaaactccagtcctattattaccttcacttccacactttgctgatgaggccctctgtaaattcattttacagaagtcttgctcttgttcagcaatcctttcatctacatattgttgcctctctgtggaattcgctaatgtaggtattctacaaccattcttcaagatcccagccactcagcctgctttaagatcagtgccattttactccccctcccctcctaaattttttcagtatttcccctcctaaattttttcagtgtctcatttatttggtcctctttccttctggtctcaaagaccaaggcaatcttctccctggatgaacaaaacccttgtatttgagctctcattctcatccctacctacctctaagacttttttcttcatcaattaccatactccaggttacctgaaacttcaatctctttatttacctaaaatctgtcctctacctactaagctcccccaattaatcttctatttctctgtcttgctattcacctgcatgttatcatcttttctctcttctctatgtgcctaaacttcttcaaagggctgctctacacttaatactactgcttcctatgactactactattattatcagatactggttcaggatcaggatgagggcctgagcagagggccattctgaggaaacaacgctgaagctcaaggatgagaaacagcagaggccagcatgtgaaaaggaggacagccaatgccctgttatgaactgaaagagaaaggctgcccttctcctattggagcaacccacagctgaagtccttatagggtaatattttctgtaaagcattcctaatgctagctgcctgcttttacatctcacttctatttaatttccaacatattatattggaagcaatacctggtattagtattttaatcttcagttcctccctagtaataaacaaaaacaaagttgagcagatgagcactcaaggctttccctatcattcctgtaagagtgcgccacctctttgggatcctactgtacctgacctatcaacctgagatgacgtgcattatatggttatcagtatgtatacctatccagcccactaagatttgagttttttgagaagttccttaccatgcatttaactgtacatataatgcaatgcttgcatctagtaggtgcttaacttattgaaaggtaaccagtcctattgtgattctctacttatgaatcaacagttataaacatgaataataattagtaggtgtgacaactatgctcgattttaacactatgaaaaatttggaatcaaaatatttaggaaaaaaaatgcctacttcaaaatagtttagcttaactaagtctcaaaggtaaaataaaacaaaatgatgccatgtaagtactagaaaaaaatacaacagagaggcttttgcaattaaaaggcttttggaagcatgacaccaaggcagaaccaataaaatgaaagtctgacagacatgacaaaataaaaatgaaaacatttcaatgttgtaataaaatgatacaaaacaacaaacacaaacaacttacaagcattcacaaaagcaaagaggataacaacacatgaggtatgtatgacaaaaggctaataatctgactacagaaaacactctagtatgaccatcaccaccatataaatgcaaaggacatgaacaggtaaatgaaaaaacaaatgggtagtaaatacaccatgagaggatcaaatccacttgtgatttaaaatgtttcatttgaaacacttgtttagtttatcagtttggcaaagatttaagacctgttgaaaactgaactctcaatagcctattgattttctgaaggacaaactggcaatacatacatcaaaagtcattcaggccctttgactctgaaaagtcactcctagaaaattattctaaacattaactaaacaagtaggtagtaatatgatgatttttgcagctgaattttaaaaaaatacttgcggactggacactgaaatgcctgtgaatgagtgggttggataaatatatatgcatagtgaaatgctgcatggccatgtggatacctacacagtcatgcaccatgtaaaacaacggacagcacgtactgcaggggccccataatatcacaatggagctgaaaatctcctatcacctagggacgccacagggtcataatgtcgtgggtgcactgcagtacttatgttggtggtgatgctggtgtaaacaaagctactatgctgccagtggaatagaagtgtagcagatacaatatgtacagaatataatacttgataatgactatgttactggtttatgtatttactatgctaaactttttatcattactgcagagtgtactccctctacttatttttttttctacatgttaactgagaaaacagcctcaggtaggtccttcaggaggtgttccacaagaaggcattattgtcacaggagatgatggctccatgcgtgttactgcccctgaagacctcccactaggacaaactgtggaggtggaagacagtgacactgatgaccctgatcctgggtagccctaggctaatgtgtgtgcttgtgtcttagtttttactaaaaaagtttaaaaagtgaaaaataaaaaattttaggctaggtgcagtgcctcctacctgtaatcccagaactttgggaggcggaggcaggcagatcacttgaggcccggagttcaataccagcctggctaacatggcaaaaccccatctctactaaaaatacaaaatacgggcttggtagcggtcgcctgtaatcccaaggctgaagcacgagaatcacctggaccagggaggcggaggttgcggtgagccaagatcacgctactgcactctagcctgggtgacagagcgaaaccgtgtcttaaaaaaacacagcctgtaatccaagcactttgggaggccgaggcggggcggatcacgagacagcctccatcaggagatcgacaccatcctggctaacatggtgaaaccctgtctccactaaaaatacaaaaaaattagctctggtggcgggtgcctgtagtcccagctactcgggacgctgagcttgcagtgagccaagatcgcgccactgcactccagcctgggtgacagagtgagactctgtctcaaaaaaaaaaaagaaaaaaaccaaaaagaacccaaaaaattttaaatatttttgtacagctgtacaacgtgtttgttattacgagagtcaaaaagttagaaagtttataggttaaaaaagtttcagtaagctaaggtttattattgaagaaagaagacttaaataaattttataaatttataaaatattaaatacattaaaaatattaaaacgttaaaaatttagtgcagcctaaatgtacagtgtttacaaagtctacagtagtgtacagtaatgtcctaagatgtcacattcactcaccactcactcgctgactcactcagagcaacttccagtcctgcaagctccattcatagtaagtgcactaaacaggcatataatttttttatccactatatatttttactgtactttttccatgtttagacatacacatacttaccattgttttacagctgcctacagtatccagaacagtaacataatatatctattatgagaagtgaattatcaggcaattctgtctttgtgtgaacatcacagaacgttatcttcccaaacccagatggtatagcctactacacatctaggctacttggcatagcctattgctcctcggttacaagcctgtacagcatgttagtgaactgaatactgtaagcgactgtaacacaatggtaactatgtgtgtatctaaacacggtaaaggtaaatacagtactataatcttatggaaccactgtcagatatgtggtctgttgttgaccaaaacattgtcatgtagcatgtgactgtagaggaggaaaagaggaggaaacattaagccaaaaagaggtaactatttggccgggcgtggtggctcatgcttgtaatcccagcactttgggaggccgaggcaggcagatcacgaggtcaggagatcgagaccatcctggctaacacggtgaaaccctgtctctactaaaaatacaaataattagccgggcgtggtgtcaagcgcctgtagtcccagctactcaggaggctgaggcaggagaatggtgtgaacctaggaggcggagtttgcagtgagccgagaccgtaccactgcactccagcttgggcgacagagcgagactccgtctcaaaaaaaaaaaaaaaaggtaactatttaactgtcccctttcctttttcaattgaaaaaaatcctggtatctaaactgagaaaatacacgtaccagtgacataccacaccagtgttagaagaaacactcaagtgtaaacaaataactttggaactattgtttcagttttccttaaatgggaaggataaattcaaataccagaaatgtatcaacaataaagttggggtacctttactaaattacagagaaaagatacttacaatttttgcatttttcccacttttccttagttgctgaacagcaaaagcatgttcaacattatccattgaaactccgttaaccattgcaactcggtcattttccctaaggggaaaagggcacaaaataatatgttagagaaaaacattctggtaagtttatgatgatatttccaagataggtacttctaaaatgtaatctaattatgagccaattaattaatttctcttcagatcaatgataaaataatgtcaactgacttactttcagatttctctgcagaatgtttaacaagtaactaaccacaggtccttaatttttttaagtcattaacaaagtatttccccaaaagactgaacagatatcacatacacgaaatgattcttggtagtacagttacagggcattaaatgatactaagtcatacagctggaaaacttactcccttttaagtttttcatcttttaattctcttttaattcttctaattatagtgccactattttgctagtgtattttgtgtttctctttatcttactaatcttcatagggaataaaaagggtggcaagacttggggaggaggcttctgaaggctagattctacccaaaaggagttatacattttctttttcactatttttacagttacacattctatttaaagtgagtgatactagctttccaattttcatagggataaagcttcctttattttctttggagacagggtctcgctctgtcacttgggctggagtacagtggtgcaatcatggctcattgcagcctcagattcttaagttcaagggattctcctgcctcagcctcccaagtagctgggactgcaggcacaagccaccatgcccagctgatttttaaacttcttttgtagagatggggatctcactgcattgcccaggctggtctcaaactcctggtctcaagtgatccccctgcctcagcctcccaaagtgctaggattacaggagtgagccaccacacctagccagtttccctcttaatatatgttaatttaaggaaaaatatatgaagcatggcacaggtggagtgtgaatatgacaaaatcactaagacagtgtaagacagtacgccagtgcctgaggagaggaacactgcttgttgcacagtgcccacgataagcagcactcttactgtagctgtccttcagctggtcctcctttcagcacatctgaaatcactattgacgtttccccactctgaaaatgaggattatctcgtccaccagatattgcaattccaaatccaaatccaggagcctaaagtaaaaattacagtaaaatattgctattaaggacaaaaataattgttatatcatactctacaatctagagaagccaaaatataaaaattacaatcttaatatatctgtgatccataaacactcacctgcatggttacctattagaattatccttgtacaagaatgcatgctctaataactactggacataacagaatattaaaaatcgccaactatatacatgttctttaaaaaccaaaagacaattaaaaattattaacactgagatcctgactttatttttgatcagaagaggtcctgaggagactggcagagcccagtgtgatcatcagccatcctggcaactgatttagaagatgacagacttatccagcatacacaccctttgtcattttacataaatatcaattgctttgaaaatcaagtattagttatttcaacttctttcaacaacttctgccaactcctaaaaatctctgtagaatataatgccttgtgcacactatacaatagaaggtgtacattagccatattgaactaacattgtaaaattacctttttaaaaaactaaattataataagctacacacttctgaaagagccaagaatctttaccacaatgactcaggacaggccggtatagaaaaaattcaaaatattttccaggttgttaaaaaattacctaatctcaaagaaatcactattccctagaaaggatatgaagtacttaagagtagtttaaagagacaatatacattttcttaaggctacagaatcattaagccagaaatgtatgtttttgtataaaactgtacaattcaaactgcctgaggacaaaggtaacaacttcctccctcagctttccagtccgcaacagaggagactattttcaccatgaatagtgcatacatcacctttcctcccatcccaaagcctatagaagtagcaaaagaaaaaaaaaaatcttcttaaaaatgaataaataccaactattccaagtgtccatcaactgatgaatggataaaacgtgatatatatccatacaatgaaacattgtgtgtaaaaaggaatgaagtactcatacatagtataacatgaatcaaccttgaaaacatcatgctaaggtgaagaaaccagtcacaaaggttaatagattctattattccgtttatataaaatgctcagaaaggcaaatctataaagacaaaaacctgaatggtggttgtctagggctacagggattggagggggtgataattcaatgggaggtgttttttttttccccagtaatgaaaatgttttaaaatggactctggtgatggtcacacaactcggaacacgctaaaaaccaatgaactgcatactttaattgtttggcatgtgaattatatggcaataaagcgaacacaaaaaagttaatatgaaaaaagaaaataataaaacagggaaatttctgagtaactgaagataatggcaaccatctgaatctgtttctctatatattctcccaaaatttaatagaacaaaaatagaccaactacagtggttctcccttatcctcggtttcatgttctttgctttcagttacttcaggtcaactgcagtgtgaaaattttaaacggaaaacttcagaaataaacaattggtaagacttaaattgcacaccgttatgagcagtgtgatgaaatattttgccatcctgctacgtcccatctaagatgtgaatcatccctttgtccagtgtctccacgccataggggctccccacccattagttactcagtagctgtcagttatgagatcaactgtggagaggtaacacaatgcttgtgttcaagtcacccttattttacttaatcatgaccccaaagtacagtagtagtgatgctggcaattcggtataccaaagaaaatctgtagtgtttccttcaagagagaaggcgaaagtcctccatttaatacagaaaaaaaaaaaaaaatatgctgaggttactaagatctacagggagaaggaatcttctattagtgaaattgtgaaggaaaacaaaatttgtgctggttttgctgtcacacctaaaattgcaagggtttcgccacagtgcatggtaagtgcttatttaagatggaaaaggcattaaacttgtgagtggaagacaggcacagaaatgtgctccaattaacagcaaaactgggtttgatactatccaagaattcaggcatccactgggggaacatacaccccatggctcagaggggactactgtacacaaaaccatacactcatcataattcaaagacaatatccaaatttcaaattaaaagcaggactaaaacttcaaaaataaacaattagagacaaatgactattagaacagcattagaaaacataagacactacagaacaaattcaaataaatttgaaaacctaaaggaaacataattcctgaggaaatatagatggccaaaattgaccctattataaataaaaggcttaaacggcccaatttctggagaaaaaagcagcaaaatttatgagggaattatcccacaaaaaggcaccaggcgcaaatgatttcccagagaaattgtgccaaaacatgcaatatccagacagcctcagtacaatatattgtttcagaacactgatatcaaggaaagcttctaaattctttttatgaagcaagtataatactgacactgaaagctgatgactgtccatgataatgactaaccccccaatattacagctcaacataatttatttgtatcagtgcaaaatacaaaataaaaataagcaaacaaaggccaacactacataaatactccatgaaaaagggattaattccaggaatgcaggattagtaggaaatccactggcataatatatcctattaataaatctagagaaaaaaattatatgattatctccaagatcctgaaaaagcctttgacaaaatttgactttcaccgctgaagagaaaacaaagtttgtgaaaaggcactgtaacaaaccctgtaagtatgttgctttttgttaaagtacacaaagaaaatccagcttttcatacacagatacagtcattgaaaaagaagagttattttagtagcctttttaggtaattacgaaaattcatgtttgactttatgccaaaaacttaataaatgatagtttcctaaaggagagtaacaatgtacagtttgaaaccatatcattcaactgtctgtactgttgcatgaattatctattggcctattttacactctgaatgagtattttatccatgtataattttactatagcatgccttagtctttcggaaaatactggttccctgagttaggtaaatcttccaaatgatgccacatttcaccacacagtgtattttaaaatcatgtgttaatatcactatcaaggttatcaaaagagtctttaagtactgaaaagctactgagcttatggtggcagataaaaatttctcaaattttaaattttgttttaaaaatcagttttcattgttagcaacaaatactatcaagaattgttctccttgaagcaaggtactcattcattttggagaaatatgtttgtcaaatattcaagtttggataaccatacattccttcaagtaaacaattgttcaagtaaaagtgatgcctgccttccaccccccccactcaatacacggctgcaattcaaataatcacacaagtactttagtacaaggcagaagtactttaggcacacttcctgtttgcatacctagactactgaaaacgtgtgtattcaagggttggaaagtaacaagacacagttcttactgtttcaagtcattcttaaataaaactgaaattgttcttttaatctacgagtgtgtgacaatgactattatacggtttggtgcccctgccttgatttgggctacaaagcccacagttttaaccgccattgtttctgaaccttcagtcaaataattacacagcgaagaagataagaaataccttcatattgaataaaaagagttttgcccttgaacctaaaaaggtttcagggacctttaggagtccacagaccatactttgaaaatgtcgatattaagaactacttaaacatgaagggagaaaaataaataaataaataaaacaatgaaacaatttacaaaagatatatgagatgttaaaacccacagataaatgcaaattaaaaccaaagaacaccaagaacagaaacattaaagtataacatatttcagaaaagggaggctatagcaaacagtctactactgatgggcacacaaattgctacaactttcaggagaggaatttggcagtaacctaacaaaactacaaatgtactattcttttgacagagcaaactaacttctagaaagtaccctaaagatacacatacctctctcacaatacaaaagtaacaaacgcacaaggttattcattgcagactgtttgtaattgcaaaatgctgggaaaacacctaaacaccccagccttagtaaacgattatcctttccctttttttctccttcaaagaagttggggctaatctttgtaatttagtaatttgaaaaattactctatgtaattttacagtatgaacttacatcttgtttggtagttattttattttcctcttttatttaaaagttaaaaacataaaaagattaaaaaaaaccaaaaacattaggaactttcaataagcaaggcagggatgcgagcatacatttaaaaaaattacttgtgagcaagtaaatgcagttccggcacctagtagggcaggtaatcctgctacatcagtgcttaccacagttcacttaatgactatccaggagccctgcgacttcttacccaggctgcaggtaagaatcacttgggaacaatttcaaaactgcttgctgatgcatgatcctcaatctataccaattaagtaaaaatggagaagaggagttggtggacttaaaaaaaaaaaaatagcccccaggtgattctaatgagcagccaggaacgagagctgcagctttcaatgttttctgaatataagatcagttcattaaaaatttcaaaaggttcaacttttccccactttcccttccctctaccttcataattgtcttatttggccctttcaacagatttctcacctccactgcactacaagtgttggcagtgctgtccctctaacacaaagaccctaatccaatagatccttgccccaagtccaaattccttagcatgcagtgcctttgaatacaactccaaacttgcttcccagcaccccagtctttgctctaaacccacctaaatactgattcctgcttagggagatcatgcaatatcaaactatggcttaacatctcctctctccctaggatttccttactaccttatcaatcttgcaagcttcagctcatctttcaaaacccaggttccatgtcacctcattcataaaactacccttggctttcacagaagtggtccatcctgtacatgtgctggggcacatgtacacacttgtgctacttaacacacagcacaagtagcctcggttagcaaggccctatttgggaggaagtcacatatttaaaatcgaaggctaacctgattaagcccgccaaacttaacctgtctttttcatcgcttacttctagttgatctattttaaactccccactagcaagtcacatagcaaatctcccacgaacttccttacagataacttccgaatgtgggtcactacagtaacggttgcttaaagttatttccaggaaccagttggcagctcttgtccacttcaagctgattaagaccaccgaaccttcaactgggcctgcatgaatgcccaaagagaggtgactgtttgatgtcagagggccaaaacctccttcctcagatcatggtgatactgccatttttcaaacatgcattctatgaagagctgtgtaacttgactacatgtatgcagatcctaactaactcacttttccttacccccaatctttctcccccacaccttggagaaccttggtactctattccaaaaacatccttaaaatcccatctttggagaggtgggtttgagatttgttctcccatctcctcatttggcagtcttgtgagtaaaatcttttctctttgccaaaacaagtcatcgcagtgactggcttgctagttcaatatattcgtatacatctttcaactcaatgcaaccctgcagaagcctgacacaaagtggttcacgaagttagtgaacctcaacaagtatttgattgattattcaatttaactttaattctatttccctttatagagactctttttttaaactagccctaattagagcactaaaaacagaattctggaaaaattagcagcaatgagagtaggcatgaatgaatcttcctgaataaaaacaggcagtcgactacataacaaaccaagaatccaagtgcaacatttacaacaaaactagggggtcaatgtatcccccttgaagtgcaaaatgcaacgaggaggggataaacaaccagctatggagacttccttagcatgtgaacgaagccatattctaaaacaaacaaacaaacaaacaaacaaaatcctccccgccacctcccgaaggaaaaaaaaaaaaaccaccacaaattacaggcaaaaatgagaaaaaacgatcagaatcaaaccctctataccagcagtcctcaacctctttggcaccagggattggtttctttgaagacaatttttccacagaccggcaggtggaggggatggtttcgggacaatccaagtacattacatttattgtgtactttatttctattatgattacactgtaatatatgatgaaataatcacaaaactcaccatattgtagaatcagtgggagccctgagctagttttcctgcaactagatggtcccatctgggggtgatgggagacagtgacagatcatcaggcattagattctcataaggagtgtgcaacctagatcccttgcatgcatggctcacaacagggttcacactcctgtgagaatgtgatgccgccacaggaggcagcgctcaggcagtaatgagagcaatggggggtggctgcacatacaggtgaagctttgctcacttgcccgccactcacctcctgctgtgtggctcagttcctaacaggccaaagatccgtacatctctgtggcctgggggatggagacctccgctctacataaagttactatataatggatactgagtagcagaataacatctctgcagacaataaaagtatgcctgaaagaaggcttaaaagagggagaggattaaaactgttattagcacaagaagatacaagacatgaaagaattagaaaaaatgtagaaatgaagaggaagaattcgagaccaaatctgaaattttaaaaggtcattttagataggaatataagaccaaaaaacatcttaagagaaaaagtaaaaaagaaatcaacctaacatcctaacattaaatcaacaatacatacgacattaacaacattacatacattaacaacctaacatcacaacaaaaagaactataggaacaagagcaaaccaactccagagctagcagaagacaaaaaataacaaaaagagctgaactgaaggagccaggcacgaaacaccattcaaaagaccaacgaattcaggaattgtatttttgaaaaaaaatcagtaagataaactattagctagacaaagaagagagaagatccaaataaacacaattaggacaaaggggataccactgaccccacaggaatacaagtaaccatcagagaatactatgaacacagccatgcacacaaactagaaaatctagaagaaactgataaattcctggacaaacccaccctcccaagactgaaccaggagaaactgaatctctgaacataccagtaacaaacgccgaaagtgaatcagtagtaaatagcctaccaactaaaaaaaaccccaggaccaaatgaattaatagctgctctacatgtacaaacaagagctggaacaatttctactgaaactattcccaaaaactgaagaggaggaacaataccccaactcattctatgaggtcagcatcatcctgagaccaaaacctggcaaagacacaaaaaacaaaacttcaggcaaattatctttgatacacattgatgcaaaaatcctcaacaaaatactagcaagctgaatccagcagcatattaaaaagctaatccaccacaatcaagtaggctttatccctgggatgcaaggttggttcaacatatgcaaatcattaaatgtgattcattacataaacagaactaaagacaaaaaccacgtgattatcttaatagatgcagaaatggctttcaataaacttcaactcccttcatcttaagaactctcaataaactaggcattgaaattgaaggaacacacctcaaaatagtaagagctgtatatgacaaacctacagccaacatcatactgaatgggcaaaagctggaagcattctccttgagaaccagcacaagacaaggatgccctctctcatcactcctattcaacacagtactggaagtcctggccagagcaattaggtaagagaaagaaataaagggcatccgaataggaagagagaaagttaaactaccctgtttgcagatgacatgattctgtatctagaaaacctcatggtctcagtgcaaaagctccttaagctgataaaataacttcagcagagtttcaggatacaaaatcaatatacaaaaaccactagcattcttataaaccaacaacagccaagagccaaatcaggaatgcaattcatatggaaccaaaaaagagctcaaaaagccaagacaatcctaagcaaaaagaacaaagctggaggcattaggttacccagcttcaaactaaactacagggctacagtaaccaaacagcatggtactgtaacaaagacagacacacagaccaacggaacgtaacagggagcccagaaataaggccacacatacgaccatctgatcttcgacaaagctgacaaaaacaagcaatggggaaaggattccttattcaataaatggtgctgggataactggctagccatatgcagaagattgaaactggaacccttccttataccatacatagaaatcaactcaaaatggatgaaagacatcaatgtaaaacccaaaactataaaaaccctggaagacaactcaggcaataccattctggacataggaactggcaaagattgcatgacaaagatgccaaaagcaactgcaacaaaagcaaaaattgacaaatggaatctaattaaactaaagagcttctgcacagcaaaagaaaccatcaaaagagtaaacagacaacctacagaatatgagaaaacatctgcaaactatgcatctgacaaaggtctaatatccatcatctatacacaattttacaagaaaaaaaacaacccccattagaaagtgggcaaaggacaagaacagacacttttcaaaaaaaaaaaaaaaaaaacacgttgccaataatcatatgaaaaaatgctcaacatcagtaatcatcagagaaatgcaaactgaaaccacaatgagcggccgggcgtggtggctcactcctgtaataccagcactttgggaggctgaggctggtggattacctgaggtcagaagttcgaggccagcctgactaacatggggaagccccatctctactaaaagtacaaaaattagccaggcgtggtggtgcatgcctgtaatcccagctattcaggaggctgaggcaggagaatcgtttgaacccgggaggcagaggttgcagtgagccaagattgtgccactgcactccagcctgggcaaaaagagcaaaactccatctcaaagaaacaaacaaaaacacaaagatatcatctcacacctgtcagaatggctaatattaaaaaaagtcaaaaaaaaataacagatgctggcaaggctacagggaaaagggactgcttatacacgttggggaaggcagtatggcagttcctcagagctaaaaagaaaactaccattcgagccagcaatcccattactgggtatatacccaaaggaatataaatcattctatcataaagacacatgcacgtatatgttcactgcagcactattcgcaatagctaaaatgtggaatcaacctaaatgcccatcaacgaaagactagatgaagtaaatgtagtataactatgcagccataaaaaagaataagatcatgtcctttgcaagaacacgggtggaatgggaggccatcatccttagcaaactaacacaggaacagaaaaccaaacactgcatgttctcacttataagcgggagctaaattatgagaacacatggacacagaggcaacacactggggactaccggagggtggagggtaggaggtgggagaggagcagagaaagtaactattcggtactaggcttagtactaggtgacaaaataatctgtacaacaaacccctgtgacacaagtttacctacataacaaatctacacatgtaccctgaacctaaaatgaaagtttttaaataaacaaataacatttttaaaaaaaagaacgccagagattttataaaaaggatttgaggaacattacaaacactaaagacaagcaaaagcagcatgatatatatgaacagtaggagtccctaaagaagcaaatcaaaagaagggaagagaaaaattagtttaaaaaacaaaaaaaacttcgctgatactatttttgaaaaaattgaaactaggtactgaaagagtttacatcactgtaaatatgtgagttatctgagaatatcaactcaggaggactaataccaaaaatatatttaaatgactaaattttaagaaaaaagaaatagcaactcaaggattttttttttcttttgagacagagtttcgctcttctcctccaggctggaatgcaatggcttgatctcggctcactgcaacctctgcctcccgggttcaagtgattctcctgcctcagcctcccaagtagctgggattacaggtgcccaccaccaagcctggctaatttttttttgtatttttagtagagatggggtttcgccgtgttggccaggcttgtctcgaactcctgacctcaggtgatccatccccggcttccaaagtgttgggattacaggcatgagtcaccgtacccagccgagtcaaggattttatattcaacacaactgaccttcaagtacaaaaaacacaaataaaccagtcaacatgcaagaacacaggaaatattgtctttatgatctcatcctaaggaatctaataatattctgacaatcaaaatgacgagatacatggataggactggtgataagcatcacatatatactgtacttatttataacaccaagattaaacgaggattaaagggttaaatgatgtaacagctatatgatctagatatggtaaaaaccattttaaaacagagaaataaatgatagcatgtgcaaaaaaaaatttttactgtttccagtaatcaaagttgacagaggtagattactctgaggcaataatatgctctctgtattagacttactaagagactatcatggtaccttcccaaggggttttcaaaagaaatggaaaatgtgccatttttttctcatctatcttcaacgtaaaaattgtatagttctgccaagacagttgatttttaaaagtatgtttacatgagaaaatgtacaggataacttttagcttctggggatggaagaaagagcatcaaagacttgccgtatttcaaacttttgaaaccttaagcaaccatgagcagcaataacttctgtgtttatatgtctacgcctggctagacaactgaatttatgttagaacttggaaacagggtcctggaattttttcagttatgtgtcctgttttactggacactagccatgcccattcctttacatataattatgactgcttttgcactgaacagttccaacagggaccttgtggtgcacaaagtcaagctatttacaatctggcctttcacacaaaaggtctgcccacccactggttaaagtatttcttggttccttaaaaaaaaattcctgaaagttgctcctgtttcagaaataactgcttaatttattctccaaagattcctctctgttcctattgaatatgcccaattacctacttaaggattccacttgttgccttttattttattcttccatttttccatattaggcttgtacaatccgctaattataactttcctcactaattctagtcttacttttctcctcttattcttcctattaacctttcaatggaatttcaatgaacattcaatggaacctgttctagccatttgttttcacagtggccactgagatcacagaatttgaaaaccagatggagcctcagcaattgtctgttccagctcccttcttacagctgaagtcagcaggcctgggtcctgtgtgtctctatactacttgccaatcatgaccttatggaagacctccacagatttgagttccctcatctgaataagagagattttaatgttatcaactttaatatactttgattccatggggatcccaagagatttaaaggccttttcaaaattagttagtggtaagcccaaacagattagaagtcacaagatccaagcactgcagattttctaccaacttggtagttctcaaaatgctgttcaatcttctatgactgtcagattgattcggttttttaacagttatgtcccttggctagtcaaattgtgtgtgtcttcctgtttattcttactctcattcttttagttctgatacccaaatcatagttttcatttctcattcctgttccattttcttatttccagcttcttacagaatacctccaagtccccttctttaagactgtcattttctctataaaattagcctcaccaccaatgttctaaacaaacattggctcctctattgccaaattacctaccctttattttatttactttattgcatgtatagagagacctttgtttagtttatgtgaattacatgagttcttaatttcagaaattatgttccataaactttttgttttttagagacagggtctcactctgttgcccagaatggagtgcagtggtgcaatcacagctgactgtaacctcaaactcctgggttcaagtgatcctatcgcctcagcctcctgaagtaactgggactacaggtggacacgaccatgcctggctaaattttttgggggtgtgtagagatagggtctcactatgttgcctccactggtcttgaactcctggcctagagtgatgctcctgccttggcctcccaaagtactggaattacaggtgtgagccactgtgccagccacatttaaaaactgtaaattaaacgtgacatataaatggaaagagcactgtatgctgagtccaaacctgggttcaagttctcgctcttaaggggcattttactagacctttctgagacttaccttacttcacatggttaacacctacttcacagacaaatataatgaagggtctgaaaaacttataatgtactaagtacaaacaatagccttctaccagataaagggagtgtatcttagattacatgtttgcttcagcttaaatactttatcagacagcagtttggagctgcttgaccgataaaattccttttatcactttactgatatataattcatatatcataaattcactctttaaagtgtatgattcaatggtttttagtatgtacacagttgtaaccatcactggttacagatggtgccaggacagctggttaaccacatgcaaaataatgaatttggacccctacctcacaacatctacaaaaattaagtttaaagaaccataggtctaagtataagagcttaaactctaaacctctttgaagaaaacacaggaataaatcttcatgacctgagttaggcaacagcttactgaatatgatgtcaaaagtataagcaacaaaagagaaaacacatacattggaccccatcaaaattttataacattttcaccaccctaaaaagaaactccgcattctttagccatcatctctcaatcccctagcctcatcaaccactaatataactctctattcacctattctgaatacttcttataaatggaatcacataatatatgttcttttatgactggcatctttcagttagcataatgttttcaaggttcatcaatgttgtggcatgtatcagtacttcatttctttttattgctaaataatattccattctatgtatatatcatgtttattcattattcatcagctaatatagccagatctattatgaataatggtgccattaacactcatgtgtaacttattatgtagacatttgctttcatttctcttgggtgtatacctatgagaggaattgctatgtcccataataattctatgaggaattctcaaactgttttctacagcagctgcaccattttacagtcctatcagcaatgtacaaaggttttaatttctccacatccttgccaacctttattgtctttctgagtacagccatcctagtgggtgtgaaggggtatttcactatactttttgatatacatttccttgaaggctaatgatactgaacatcttttcatgcatttattgcacattcatacatcttctttgaggaagtatctattcaaatcatttgctatttttcaactgatttgtctttttattgttcagttataaaagttctttatatattctagaaacaaatcccttatcagatgtatgatttgcaagtatcttttcccattctgtggaatatcttctcactttcttgatggtgtcctttgaagcacaaaagtttctaattttgatggggtccaatgtatctgttttcccttttgttgcttatacttttgacatcatatccaataaaccattgcctaacccaggtcacgaataattatccctgtgttttcttcaaagaggtttagagtttaagctcttatacttacacctatggttcatttaaacttaatttttgtaaatcttgtgaggtaggggtccaaattcattattttgcatgtggttaaccagctgtcctgggtctgttaatgactgttcttccctccagtgcattgccttggcaccccatcccaagtttacctcttatgcaatcacctccctagtttaaacactcactggctcacccttaaaattacctgactagtttccttgctttctatactcatcttttaatactttagtatacaaatatttaatcttttacataattctattttagaaaatgaaaaagcagagtaacgacgagcaactcattcctgaggaattcacttcatttcccaaagaattagaaaaatgtatgcattttctaagggcgagtatctgaaaactaaaaaggtgtgggtgtgttacagcagcaggagaggtgaacacatgtggttaccatctgaagctacacacctacactaatacgataagcatcagacttgtgactattaagcacttcaaaaatggctagtgttacctgaaaggtgctgacattgaaaagtgaacaattttgtaagatcaactcatcaatttttaaacttatcacatgttgaaatatattttgtgcatactaaataagacctattataaagttagtttcacctgtttttctttttttttacagtttttaataagaagactaaaaaatttaaatttacatatgtggtttatattatactgctactgggcggtgctgttgtagacctcccaagagtgactttattcgacatggttagtgtcctagggaattaagttttttggggcagaactaggtaccaagcactaaggagatagaaaacggacttaagatttccaacccttgtgaaagttataatgtagtaggagatggggtaaacaactatctgatgtacatattcaactgtcactgaggaccagtagagagatcagaatccatgaggaggcaaattctgcctgtttttttctgatataattccagggcccacaagagtacaacagtgcttggcatacagtagaacactaaaaaattacttagtctttaagaatgaatagggtttcaatggtttctagaaatataagatgaagaaaatatcttctggaaatacaaatgaaagaatgaagcatatattattctagacagtaaatagcagaaaatgttaggttctcatcaattaaatggcttttttataacattacctccaactttcataaaattgactgtcagatgtcaaagaatatggatttgtctttatttggcaatacagagtatctatactccaggttattgccaaaagaatacagtttcaaattatccccttcacttactaccactgccaaaagcccacttgctcacctcagagagaacaagctttctgattcctctgtgtttcttaaaagtgggatgccagaggccatagccctccatttcaaactgaagcctatttaaaatacgtgttagggatcccagcccagacaaactgagtaagaatctctgatgggcagggactgtgcagttgatccctctttacaataaaacctggagagccactgctctaatcagcagtcagcacactatggcccacagttggaatacagccacattcgtttgcctgttgtctatggttgcttctacaatacggctgcagggttgagtagttttgacagagatttatggtctgcaaagcctaaaatacttatttactatctggctctttatataaatactttgctgatcctgctctagatagtctaaattttattcggcatcatcttagaacaccaaacaactaagacagttgaaagtaccattctgtagcctcagagaatgaagtcaattaagttatgctttggcataactcagctcccactggcaagactttttcattgtccaaagattttaaaaatgtttttatttttaattattatagtaaacagtagttgtatatatttatgggatccacatcatacattttgatacaagtataatgtgtaacgattaaatcagggtaactgggatattcataacctcaagtatttatcatttctttgctgttacgaacatttcaattccactcttctagttactgtgaaatacacaataaattaacgatagttgccctattgtgctactaaacactgtatcttactccttctaaccatatttttgcacccattaaccaagtcttccatccctacttccctaccacccttcccggtctctggtaaccatcattctactctctgtctccgtgagttcatttttctttttttttttttttttagttcccacgagtgagaaaatgtggtattcgtctttctgtgcctggcttatttcatttaacgtaatgtcctccagtctcatttatgttgttgcaaatgacaggatttcattattttttatggttgactaatattccatggaacatatttacattttctttatcccttcatcaactgatgtacacttatgttgatactataacttggctatcacgaataatgctgcaataaacatgggagtgcagttatccctttgatatactcgtttcctttttttttggacggagtctcactctgtcaccaggctggagtgcaatggcgcgatttcggctcactgcaatctctgcctcccgggttgaagcaattcccctgcctcagcctcctgagtatctgggactacaggtgcacaccaccacatttggctaattttttgtattttagtagagacgggatttctccattttggtcaggctgatcttgaattcctgacctcaggtgatccgctcaccttgccctcccaaagtgctgggattacaggcatgagccaccgcacccaggcctttctttgggatatatactcagcagtggaaatgctggatcatatggttgctctattttcagtttttgaggagcctccataatattctttttttttttttttttttttttttgagacagagtctggcactgttgcccaggttggagtgcagtgcagcaatctaggctcactccaagctccacctcccaggttcacgccattctcctgcctcagcctcgcgagtagctgggactacaggcgcccaccaccacgctcggctggtttcaccgtgttagccaggatggtctcgatgtcctgacttcatgacccacccacctcggcctcccaaagtgctgggattacaggcgtgagccaccatgcccggcctccatgctattcttcatagtgactgtactggtttacattcctatcaacaacgtataagagttctcttttttctgcctgctcactagcatttgttattgcctgtctttttgataaaagccattttaactgggatgaaatatttcattatactttcgattagtatttatctgattagtgatgttgaccattttttcatatacctgttgaccatttacccatatgtcttcctgagaaacatctattcagctcttgtgcttcagatcttttgcccatttttaaattggatttctttttcctatcgagttgtttcagctccttacatattctggttattatctcatcagttgggtagtctgcaaatattttcttcattctgtgggttgtttcttcattttgttgactgtttgttgtgcagcagctttgagcttgatgtgatcccactgtccattttgttgtggttgcctgttctttggaggtcacactcaagaaaccttagcccataccaatgacctttagtgtttcccaatgttttcttctagtagtctcataacttcaggtgcttaatccattttgatttgttttagtatacggcaagaaataggggtccagtttcattcttctgcatgtggatgtccagtcttcccagcaccatttattgcagactgtcctttccccaatgttcttagtggctttgttgaaaatgagttggaggtaaatgtgtggatttttttctgggctctctattctgttccactggtctgtgtctgtttttatgccagcaccatgctatagctctggagtataatttgaagtcacataatgtatgtaatgtgattccttcagttttgttctttttgcccaggattgctttgcctactctgggtctttgtggttccacaaaaattttaggattgtttttccaaccctaaaacataattctgtgaagaatgtcattggtgttttgacaagggttgcaatgaatctgtaaattcctttgggtagtgtggacattttaacaacactgattccaacaatactgaatccatgaccatggagtatctttccactttttggtgccgtcttcaatatctttcatcagtgttttatagttttcattgtagaaatctttcacttctttggttaagtttattcctaggtattttattttattttatttgtagctattggaaataagattattttcttggtttattttctagattgtttgctcttggcatacagaaatgctgctgatttttatatgctgactttgcatcctgcaattttactaaacctcagttctaacagttttctggtagagtccttaggtttttctaaatttaagatactattgtctgcaaacaagggtaatctaaatttttccttccaatttggatgccttttcttttcttctcctgtttaattgctctggctaggacttccagtaccacgttgaagaaaggtggtgaaagtgggcttccttgccttcttccagatcttacaggaaaggcttttagattcccccctcatgatactagctgtgggtttatctgtctgtggcttttattgtgttgaggcatgttccttctacatccagttgagtttttatcatgaagggatgctgaattttactgaatacttttttggcatctatagaaatggacatatggttatgtccttcattcttttgatgtgatgtatcgcatttacagatctgaatatgtattaggtggttctcacattgctataaagaaatacctgagactgggcaatttatataaaaaaagagttcattggctcactattctgcaggctgtacagcaagcatgacagcatctgcttggcttctggtgaggcctcaggaaatgcataatcagggcagaaggcaacaggggaacacacatggccagagtaggagagagacagagagcagggaggtttaaacaatcagatctcatgagaactcactaactatatagtagcaaggggagatggggctaaaccattcatgagaactccactcctatgatccaatcacgttccaccaggcccctcctccaacactggggattacaattaaatgtaagatttgggcagggacacaaacacaaaccatatcagagtatgttgaaccatccttgcatccctgggatgaatcccacttgattacaatgaatgatcttttaaatatgtagttgaatttggtttaaggattttgcatctctgttcaaagatactggcctgtagttttctttttttgttgcgtctttgtctggttttggtaccagggaaatactggccctttggaatgaatttggaagtattctcttcttagcttttgtgatataattcttctttaaatgtttggtagagttcagcagtgaagccatcaggtcctgggcttttctttgatgattttctttttttcttttcttttattactgcttgctctgaaaatatttcttttttaattcaaaaaaccaaaaacaaacaaaaaacaaccaaaaaaccattcctggagggatggctggtgaggactttgattttgtcatagtctctctgtgatgaggctcagaggaaacccagctgttttcctagtacaacagttagcatattcaacaactgaagaattgtgagttatatacctctcttatctcaatgtatcttctgatgacattttctgggctgccctctcatggcaaaaaaataactgaggcacagaaagaagccaggtacaaaatggaacctacattaatcatctaaaacggcattatcataacagacttgcctgagccattacttaccacaatgaattggtatgacacttctaacaaggtcagaaaaatcagattctgttttcttaatattgaggatctttcccactttccctgagctaatgagacacaggtctgtggcaaatacatttagtattttcctacacatgaattcctaacaaaaccaagcaagagcatacaaagggaaacatactttagctaatttaaaggtgtcttatgttattttgcttattgaaaaaactgaaaaggtagtaaggaaaagatgtaatgtggtaatagcaaattgcatctgtggtctctaatgaataatctcgcttccagtaaaaaaaactatcaaaagagcttaaactcaaggtaaacaaaaggatgaaaatattaaaataagagcagaaatcaatgaaacagaaaacagaataaagaatgtcactgaaaacaaaagtaggtattttgaaaagatcaataaaattgtcaaacctctagccagactgaccaagaaataagacacaaattaccaatataaataatgaaacaaaacaaaacagcattatagaaccatccaaaattaaaaataagggaatattatgaacaatgttatactcataattttaacaacttacatgataaagacaaatattttgaaagacacaaactaccagtcaggcatggtggctcacgcctgtaatcccagcactttgggaggctgaggtgggaggattgcctgaggtcaggagttcaagaccagcccagccaacctggtgaaacaccggctctactaaaaacacaaaaactagccaggctggtggtgcatgcttacagtcccagctactcgagaggctgaggcaggagaatcgcttcaaccgcagaggttgcagtgagccatgatggtaccactgcactccagcttgggtgatacagcaagactctgtctcaaaaaaaaaaaaaaagactaccaaaaaacaaaacaaaacaaaacaaactgtaacaaggaaaaaatacataacctgaatattcctatataaaattaaagaaactgaatttgtaatgaaaacccttcccacaaagaaaactctagcaccaggtaactctactagtgaattctaacaaatatttaagaaaaaaataaaatcaattgtacatgaactctaccagaaaccacaaaaggaaggaacacgtcccaactccttgttttgaggtacagcttttccatgataccaaaaccagatataaacaatgttaaaaaaaagtactgaccaataaaacaagaatcttcacaaaacatcagcaaatcaatccagcaacatctggaatggataacatgtaaacaatcaagtagaatttatctgaggaatgcaaggctgttcaacaaacaacaagaaatccaccatatcaacagattaagaagaaaacccatataatcccagtcatacacacacaaaaaaaagcactgacaaaaattcaactttcattcatgattaaaaacaaccatctctcagtaaactaagataaaagggaacttcctcaatctaacaaatggcaaaatagaaatacaagggaacttccttaacctgataaaaggcatcaaccaaaaaaaaaaccacttactggtgaaagacagcttttacccagtattaagagtaaggtaagtatgcctgctcaccattcctaattaacaacatcctgaaagtccaaactagtgcaataaggcaagaaaaagaaataaagagcattcaaaaggagggaaaaaaactgcctctatacacagatgacatgactgcctacacataggaaaacacccaggaatctaaacaagaaagttcctacaactagtaattttaagactgcaaggttgctataaaaaaaaaaacaaaaaaaaacctgcatttctacacagtaacaaggaacaatcaaatattgaaatgaaaaaaaaaaaactatttacaatagcgccaagaaacatgagatatttaactataaacctaacaaaaatgtgtgcaggatctatttgccaaaaactacaatacattaaagaaataaaacaatgaggagataacattatattcatagtttggaatattcaatattgttaaaatgttaattatccccaatgatttgtagattcaaatgcaatcccaataaaatcccagcagttttattttctttgagggaaggaagataaaagttgacaaaattattctaaaatttatacagaaaggcaaaggagctagaatagccaaaataattttaaaaagtatttggaggatttgccctacctgatttccacgtttaatataaagctacagtaatcgatgcataagtaactggtaaaaaggcagacacacagatcaacagaccagacaagggagtccagaaatatatggtcaattgatttttgacaaagcgagaaaggcaattaaacggacaaagtataatctttcaaacaaaatgcttcttcaaaataaacactggacatctgtatgaaaaaaaaaaaatctctctgcccgtatctcatggcacaaacagaatttaactgaaataaaacttttaaaggaaaacagaggaaaaattattcttgattttgggtttggcaaagatttctgagatacaaaaccaaaaacatgattgataaaggcaaaaattaacaaactggactttatcaaaaatttttctttctttccttttgagacagagtcttactctgtctcccatgctggagtgcagtggcacgatgtcagggtcattgcaacctctgcctcctgggctcaagcgattctcctgcctcagcctcccgagtagctgggactacaggcacatgccaacactcccagctaatttttgtatttttagtagagacaggctttcaccatgttggccaggctggtctcaaattcctggcctcaagtaatttgtctgccttggcctaccaaagtgttgggtttacaggcttgagccactacacctggccagagctttatcaaaacttaaagcatgtactgcaaaagacactgtcattaagagaaagaaaaggcaaatcacagaatgggaaaaaaatacttacaaaataatacctgataaagaatctgtatcctgaatacgttaaaaaaaaaaaaaaaaaatctcaaaactcagtaacttctgtgtaccaaaaagaataatcacagagtaaaaaggcaatccatggaaaggaaaaaaatatttgcaaatcatatatttaacaactggttaatatccaaaatatataaagactactgcaactcaacaactaaaaaacaagcaacatagagcttaaaaatgggcaacagtcttgaatacgtgaagtctatgttgtattttgccgcaattttataaaatctcaataataagaaaaacccaattaaaaatgggcaaaaggtttgaatacattttaccaaagatatatggacaacaaatgagcacatcaagagatcattaatcttcagagataagcaaactaaaaccacgtgtgataccgctagatacccactgaatggcaattggtcttgctctgttgcccaggatggaatgcaatggcgtgatctcggctcattgcaacctccatctactgggttcaagtgattctcctgcctcagcctccaagtagctgggactacaggcgcctgccaccacgtccagctaatttttgtatttttagtagacggggtttcaccacgttggccaggctggtctcaaactcctggcctcgggtaatccaccagcctctccctcccaaagtgctgggattacaggtgtgagccactgtgcccagcgtttttttttttttttcttttctttctaaatctgacaatacggattgagtatcctttacctgaaatgcttgggaccagaaatgtttcagatttcaaatgttttggatttgggaatatttgcgttatacttaccagttcggcacccataatctgaaaatccaaaattcagaatgttccaatgagcatttcctttaaacatgacgtcatcactcgaaaagttttgaattttgcattttagatttcagatctgggatgctcaacccatatcaagtgctgatgaggatacgcaacaacgggagctcttatacactgccagtggtggtgttagatggtacagagaatttgaccatttctttaaaacttaaataattaccatgggacccacagcaagtcttttcctaagtatttacccaaaagaaataaaaagttatgttcatacaaaaacctgtacactagaggtttgttcataatcaatggaaactgcaaaacacaaatataccacaactggagaacgaacacacaattatacattcatacaatgaaatgctactatgcaataagagaaactactgatagagtaacatcatggagaaatcccaaatgcattaggctaagtgtaagaagtcagcctcaaaaggctacatgttgtatgagtccatttacatgacattctagaaaaggcaagaatgtacaaaaagaaaccatatcattggttaagtggacgtgaggggaccgggatgattaaaaataggtgttaagagaaagtttttgtattgaagttgtcttgtattttaattgtggtggttacatgactgtatatgcttgtcaaaactcagaactgtaagggtcaatttcactgtatgtaaattataccaataaaaacaataaaagtcttaataaaaataaatgtaatatgataaaaaaaataccaaatcattgacatcgccactagtcataaggtaagaagttattttatatgtttaatcatatgtatctgatttaaatatgctacctatcaatacatttcaaacaaaggaaggccatgttgcaggtttatgaaagttaaggttagtattagataatgatttccttcaccatttaataatgaaacattaaaaagttgactatatcttatcagaaaaaaaaatttttttttttttttgagagggagtctcgcctctgtcacccaggctggagtgcagtggcatgatctcggctcactgcaagctctgcctcctgggttcacgccattctcccgcctcagcctcccgagtagctgggactacaggcacccgccaccacgcctggctaatttttttgtatttttagtacagacagggtttcaccatgttatccaggatggtctcaatctcctgacctcgtgatctgcctgcctcagcctcccaaagtgctgggattacaggcgtgagccaccacacccagccaaaaacaactattttttaataattaatttacccattatctactatgtgcagatccaaacattcgtgagataatcaggggcagagtccagcaacatgattctttcccctttccatcttcctaataatggatatagctggtagaaatagtaagtgtaaagtgcaaggccagtatttaaatattctctctttccatacattctctaagaaagggagtaatcagtagattcagctctcttgaaagagaggaaagagaattttgagagacacttaactttacaaattggtaaagcatgaactggtgtcaacttgttccattttaaacttgtgaaaaccaaggttttcgaaggtgactgaatcacttccccatttctaaagcaagagaaaggcagaaccagaattcaaattgatagcagtctcacttcggacaaagttcttagtcccaccaagtaagaactcatctcttactactactcatctctcttctcgcatctgcaattgtttaagcaacagcttgggtcaacatgtttgaaatcaattaagtatcttttaggattttattatgcatacaacctggtttaatttcaaacttcactcccacaatggatgcatatatactcagaaaggttgaagcagtttataataatttatactaatgtacagagtcttttatctgatcactcaaaattttaaaagcaaatcactttttaagtcaggaataaaaacagcaaatactcaaaaggatatatgaaaaagtaatcatgctcacttttgaccttaataaaaaattattgtaactctaattttaaacaaaagaatatagaaaaagtttcctcctccctctggcttcctgacatctggctttcctctattgttttcaaagctgccagtatcctgagttatacacagattacttactgcaacacaaacttaccctgtgaagcgtcactgtatgttgttcccatatagctgtttcctccattgctgtgctctgataaaggaaaagaaaaacaaatcatttaccttttaagaaaatgtccttaataaggtgagcaagaacatccaacaattcagcacactgaaataccaaaattcacagttaatattagagacactctgaaaggaccttaataattatggaaagttttttgtttgcttttaagagacaggaaacgacacacaggaacttcctttgtttttaacttaatttggacagctgctctatattcatttcatgcaagctgaaatcagtattcaagctaattctgcaactttatacttagaaaagaataaaagttggagcggtattatcttaaaatatctaatggcacgtaaacatttaaaagcatctcttatgttttacaaacgaagggaaagttaaatgcctctgaacacagtaattataaatatacatgtcacaggaaaacagataaaaccattaataggtttggcaaatggctgctttaacgtcacaaacatgactactctacctagtttcagttttgctacagaattacttctcaagcttcatttataaccaaaagaaaaagaacagcttttctagtatatgtatcacacacgtagatacacacaagaaacaaaaacaaaaaagaacaatctcccaaactcccccaagaatcatcataaaataaaagcagtaagagctccaatacaggtcctgcccaaattatagcgtacttcagttttacctcctgtcatgagcctctcaatagagaggaaaataaattattattttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtacagacggggtttcaccgttttagccgggatggtctcgatctcctgacctcctgatccgcccgcctcggcctcccaaagtgctgggattacaggcgtgagccaccgcgcccggccgaaaataaattattatctaaggcaggggtgtccaatcttttggcttctctgggccacacttgaaagaagaagaattgtcttgggccacacataaaatacactaacactaatgaaagctgatgagcttaaaaaaaaaattacaaaaaaaaaaatctcataatgttgtaagaaaatttacgaatttgtgttgggccgcatgcgacctgtgaaccacgggttggacaaggttgatctaaggaattagcagtaaggaattcaaaataaatttcttttaaatggggttaattgctcttggagacttaaaatatttcagtctctcttaatgttaccattttatgaaactgggactcctaaaatgtatttacaagtaaatttaaaaaagattcttcagagttatcaaaaggtaaagtaaaaagggagaaggctaagcatgacactctcagatcactagtcacccattactataaatgcctatttcataagtgaggtctgttttctcttactgctgtcattagcatcatgagaatatgcctaccaaggtgccatgggcccattctctcctttcccacagcgactttaattgaagattaatgccattttagaaagtaagtccctataaagaaagcctgcttccctaaattcaaagcaactagattatcctgccagatgaataagagaggagagagaaaggatctctctgttcactcccatagataagaactgccaacctcaccagcatttgtttcaatcttccaatgaagtgcaccaaaacctccctttaatgagacctccactggaaacaaagctgtttttttttttttaaacaaacattgaccgggataatgcactaaaaaaaaaaattcttccatcaatgagaagcaacaatagtatgagtaaatcagctaaacatcaacagtcccactaacatacacatgataaaagtatctgcaagagttgccagtttgtccaatctcagctgatattaagaatgagaactgcttgcatagctctcagttcatcttttcttgatctatttcattaaccagtgacattgttttactgcctttttaatctttttcctatcagtccaaatggcaagtgatgtgataacatgcacttaactctctttgataacatactctatggtatgaaacagttcatcatcctctctaaggtcttaatgaacacagttttccattttgtaagaagatgttaatcaaatgggaaaatttatttaacattaaggggggagcaggttgtaaaacagcgtgtacatggttatcctaattttgtttaaacattagtagggaataaaggctcaaaggataaacaaaatgttaacattgtttatcaccttcaaagtaaagggactgtgggtgacatttttctatcaggtgttttatcttcctgctttcctttctccattccccatcagaacaaactggcaatgtattttaaactatattcacaaaatctcattcctatttgacatttcgaatacagacagtccctgacttaggatgggtcaacttgattttctgactttacgatggtacccatacaaccattgtttttcatttccactacagtattcaagaaattatatgagatattcaacactttattgtgaagtaagcttttgtgttagataattttgcccaactatatactaatgtaagtgttctgagcatggttaaggtaggctgggctaagcttatgatactgggtaggttgggtgtattaaatgcatttttgacgtaaagtattttcaacttacgatgagtttaatcaggacattgttctaagtgagctgagaagcatctgtatctgtttttccacttggcttttaggaaaatcaaataatgcttaagaggattaatgttcttattgttaattataaaaaatgtttattctcctgttagtaagcaatctatacattaaggtcttaatgtacagtctccaggaggagtgcaataagagaaacttgctttgtacaagggagaagactaaaatactaaaacataattgctctcaccattccacatcaaaatcaatatagtttttctttggaggactggaaaagtccacatctcaaaaaacttctctgttaaacatcaattatagcttgatttatctgaaggaagacctatgtagaagaaagtaattgagaatgaaacatcaaaagaagtggttaggctcttgaccagccactaaaccaacttaatccataatataagtgagttactatgttttaccactccttatctttaaaaaaaaaaaacaaaaaacagaaaaatatattcctagtttaaatgatggaccatgtcatctctctccattctctagcctttcatttgcttctgtggcaaaagtagcaaattctatccatggttgtttatataaccaggcagtactgatgaggagttctgaatgaggaatggaaggatgaacaaacacgtaaatatgtaataatgcaaatacagtaaaatgataatggtagaatcttagtggttgggattcaggtaaccatggcagactgctttcaatcttgttacgtgtttgaaagtgatcataataaaatgctgaggaaaaactaagaaatccttctagtaaatcactcagaaatcaaagctaaaattgatatgagacatttttagtaccagtaaatttattaaccactattttaatgagcattccataaagaaaaaatgttcactaatgactgagaattttgatgcattagaaaagcaaggggtgtggaggttcctttggaagaatacctaagaaacgcatggcttctggagtggagaaaggaaaaccaggtaggaggagtctcacttttcactgggagccctttgtacttttaattacattcatctattacttatcaaattatttttaaaacttaatatccttattgtaaacttgcttgtcattttctcatttcaaacatgcacaagggataactgcataacttgcacaaaaagcttctggtaaattaccagtctcaggttcaagacatttaggcttgtaggagaccaaggggaaaatgtattactcctctaagcatgattctagcactaccattccctagtaactcagacagatgctggtaaacaggaaatgaactagaccaggcataaggagaccagagccgaaaggtatcatcaactagaaacgtgatcttaattttcctcacctacacaattagggaaatgggtgaaattatctcaaatgaaaagacttttctagctccaaaattctatcagactataattccaatgaacaggctacaaattcaataattagtgaagcactgcaggcatcaaaagtgactgcaattcatggttgctggattctgagttctgcgcacatttctaagtcagcatcaactgactagaatcacaatttctgaagaagcaaaaagctgtatttcacaatctgccaagagtttgtttagtttctttgttctaagctccagctggcaaagacactactcagatcaccaactctgaagggcttcctgccaaaacttcagatcccagttctaggcagtttcactgtccttcaggactgattactgaatggggaaagataggagggcacaataactgaaaagacaggatgagcctataactgggagaagaacaaatccaaaagagaagatataaagtatactccaaatgaagaactccttaacattatctaaatacacagccagttaaattttactaaccttatggctgtaatttcaaaaccaatccatgtatcattcattcattcattcattcaacaaacatgtatcagacatggtaagtgttggggaggccaaaaaaaggtccctctccctccctaggggctcaaagaagcagctgagaacactaaatggtatttaggttggtgcaaaaataactgcagcttttgccattaaaatggcatcaaaagatatgagctttttgcaccaaaataaataacttttgcaccacatagataagagctgttatggaagatgcaaaaggactgtgtctgctgtgaagatcagagatctgttccctgagacagcaacgttttgagttcatcaagcttgaaggatgtccaggaaaaaagtggagaaagatgtttcagaagaaacagcatgtcagcaagattgtgtgatgctacacatgacgctggctttgatatgactaagttgtacaatttatggaacaaggagagagtaaaaggagagaaggtgcaagggtaccagatcacaacaggctttataatataatgccaaggactttaaactcaaatggaagacactaaagaattttcgacgatcaaatgatataagaattcatcctgaaggctgtaatgggaaaatgatttgagaaagggaaaccagttagaaagttagtgagaagtgtgggtggagttcaaaatggctcttgagtagtcaaccaagtagcagtgctgaagtcaaaaggaaaagatgtaattacccaaggactaagataaccctgtggacaaccaaaggaatttgagaagaagcagacaatgaggatacatgaaaaccaatggagctaatacaaaacactacttactgtccagagaatacaccaaagcttaagatccctcaattttttagatcaatacacctcatttatctgacatcataaaataataaaatttccacaaatcttcaaggaacaccctttcttgatgacatgcagttccccattaggaaaaccaatagtaaaggtattaagaacactctgtgaaccctccaagttccttctgtgagcaaagctgctacactgaacggcttctcattccttctgaactccaaagtgtttctgttttggtctttttggcttttttccatccaaattgaaagcaagatcatctatggagatgaggttgagccaggaacttaaggagaaggacaaggtaggtttcagtgaataaaacagatgacccctgcccttcaatgaagtttcaattacataatttcaaattgtgatcactgcaacacaaatgaagtacaaagggaatagtgctacatgttaaaaggtaaggcaaaatatgtatatttggactgatctgatgggccgtcatttaaattcccaaaatagaaatgtccaggaggtagtaaaaaagatcactctaaaataaaatgaagaagggtcctaacgatattcagggattcaacaaacttcatgaatagaagataaaaattcaggaaacataagaattaaaataatgatcaaaataagaaggcagcaaccataggataaaagtctcaatagaaatttagtaaatttagcatccaacaccccactgtattcaacactggttaaatttacaaatgtatcactgtgtccatcccttggttaacagtttaggaaacaaatgatgagatggatatgattaggaaatattagtcggaaagacagacacagtgaacctgtaattttctggttgatcaaagctgaaggtctgctaaaaacattaagttcacagataagctgctacattagctataaagtaagagtgaaagaacatcagcttaaaagttaccattatgtgtacattaaatattgagaaaatctcagtagggacagttacaaatattcttggaaacttaaaatctagagtgctttcaagttatcaaaaataaaactatttttaggtatagcatcttctaaaggttgaagatagatacaaagatctctcacaatttattcaggtagacaggaggaggaagggaatggcatagcagagatgaagagagagtgacagtcctctgagtatatctttttgcataactctctttcttagaccacagtattgtttcatgacattacccttcacagatcaaaaaattaaactattaaaaccaaaaagacatgaggggaggggaggaaatcaaaaacagaataaagacagtaacaaatgaacataactatattacagatggagaatgtaaccacactaaagaagagtttaacttttctataaatctaatattttaaaataaaaagtttaaaaaagttataatggtatagaaaaatgcagaaagataccaattttggaaaaaatatttacgtactcagaaaaaaaacttggtttcagagttgtatattttaagtttttatatatcctacaatgaacacatgaatttcataatccttgaaaactggtaaacatcacatctgaattacgaaacaaaaaatgggcaaaagtggccaggcatggtggctcacacctgtaatcccagcacttttggaggctgaggcaggcagatcatttgaggccagatgttcaagatcagcctggccaacctggtgaaaccccgtctctactaaaaatacaaaaattagccaggcatgggggcacatgcctgtaatcccagctacttgggaggctgaggcacgagaatcacttgaacccaggaggtggagtttgcagtgagccgagattgcaccactgcactccagcctgggtgacacagtgagactgtcttaaaacaaaaacataaacaagaaacagggaaaagtgatctacactgttagaagttgggacagggttacctttgtgtatgaagtaactcgaagggatggaggtgggggagcttcgggacgtaaagtaaatgttcttccttgatctgagttgtgggcaaataggcatattcactttgaaaatatatcaatctgtgtacacctatgatttgcctaatgtattatgttatttaaaaattcaaaataaagtaacctgacagaactgtaagtaatttgactgcaatggattaaaataaatcaaatatgcttccatccatccatatgcccacagtgattttaaaaaatgataagtgctggcagaactcattattttgagaaactggtacgtatagggaaagaataagatatttactctgtctttcctatacaaacagtaccagtgggcgatcaaaatagtagatgaaggagagtttctttttttagaagcactccagctaaccaatgaaaaaggaataataaaaattgaatatcatcattttgtaacacctagtgaattaagggatctacacactgatcatcaatggctgcagacatcatccaaaaacaacagaaaaaaccctgggaccgaatgccacttatgaagtagaactgtaaaaacaaacaaaaaaatcaaatctgaatctgatcaaggctctagatctgtgctatccagtacagtagccaccagccacatggggctactcagcacttaaaatgtgggtagtccaaactgagatatggtatatgtaaaatatatatatgatacgaaatatgtgatatgtattatgatatgctatgtgcaaaatatacatgatatgtaaaatatacatgcaacagtattcagagactgaatatggaaaataatttaaaatatctcacctataattttatatcattgcatgctaaaatggtaatattttggatatgtgtgttaaataaaacatgaaaattaattttaccttaaagttttggtgtggctactacattagacagaattgctctagctacagttaaccaatttacaggaaatacagtgggccaaccaccattgtaatcaccacaaggaagcaaataccaaaattcatactgttaaaatttctacaaataatcctgtttctcaaccaataaagctgcaagggaagaggggaaagagagagacagaaatgggggacctcatatgcctaagagaaatgttaaacaatcacagtaagaggacctcatcaaggaaagttgacatttaacacaattagaaaacactaaacatggctgggcgcggtggctcacacctgtaatctcagcacttgggaggccaacgggggtggatcgcctgaagtcaggagttcgagaccaggctggccaacacggtgaaaccccgtctctactaaaaatacaaaaaattagccaggcatggtggcagatgcctgcaatcccagctactcaggaggctgaggcaggagaatcccttgaaccagggaggcagacgttacagtgagccaaggtcatgccattgcactccagcctgggcaaccaggagcgaaactccgtcttaaaaaaaaaaaaccaaacacttaagtacttgatttggagtttattttaaaagtgtgctaatgataatgtagttatagtacttttaaaaaagacatcttttagagatatatattcagacacatgttgagtattccattctatctcttctctgaaatgcttcaaaccacgtgtttccgatttcagggtgaaccatccaaaatccaaaaatctgaaatctgaaatgctccaaagagaattttctttgagcattatgtcagtgctcaaaaagtactggattttgaagcatttcagatttgggatgttcactatgtactaacagatgaaaagatatctggcatttgcttcaaaataatggggaagagaagacacaatgaatgaagtatagatgaaatgagactggctgtaagttgttaaccatactgggtgacagtaatgtgggaattcattatattccccacatccacttttctataggtttgaaaattttccacttaaaagaaggtaacttgaggggactagaaattaattactgatttaggaaagacccaaaccaagaatgcagctaccatgatgccaggatattaagtagtatttccatgagctggctattccagcaactgcttcccctcccctttcagaatagtaagaaaaatgcaactagtcctggagatggattagtaccttccttctgctgctaagctgaatttaaggtggtctaacattaccagtaagtgagttaacagcattgaaaaggcaactcttgtctagaaggggtaacagatactaatcaaataatagcagagaactaagtacaggttatcataagtgctataaaggggtacacagagtttaaagcacagagttttgacctagtttctgggctctgggcaaagtccttgaggagaagagacagctatgaggtgcatgaaagatggaggtggcaaggtttccgggtagaaaaaacagcacgtgcaagagcctagtgtaggaaagtgcatctctcattcattcaaataatgttttgagagtttcctatgtactagacactgtgttaaactacacgaataactggacacaactagtatgacctttgttctcaaggagcttacagtctagcaggagaaccaaatgatcgaaaaactccatggctaaatatatagtcacaaagttaaataagtactatgaaagaaggaaaaacagtgccatgaggaactcaaagagaaagttgacaggaagtacacttgctaggaaccaaaaagaggaaagcacagtttgagaacaagaaacaaggaggaaaaagatacgatgtggctagaggggtaggcaggggccaaataatccactaggagcttactgaccatattaaggattttgatcttttactctaaaggtagttaagcagcctaggaattttaggatgagtgttcgcatgtgtgtgtagcggggcgggggagagcggagagaaactaatcaaacctggattttgaaaagattatttcagaaaaacagattgtaaggggaagaggggggtatgatacttaggaggctattacaggaatccagagggaggattacttgggtgggggtgggggggtggtgggagggagaatgtaaatggttgaaagtacggataaaacaagtagaaagacctgaggtgctcagcaaatcaaagctgaatagaacttgctaatcaaccattcaccatactaggtagacatccaaattgagccaggtaccctggatttggaatagtctttcaactctattgcctaatccatcagactaaggactgtatctcttatctaatgccattgtaataattttttcaaaagtatctcaggaacccaaggaaccttcctctgaaaccataaaacatcttgctgggctgaaactactaacctacaggctgattgatctttgtccagaaataaataaatgaatcctccttctgaaaccacaaaacatcttgctgggctgaaaactactaacctacaggctgatctctgtccaaaatgaatgaatgaatgaatgaatgaatgaatgtcttaaataatctacaggccaacctttgtccataaataaacaagtaaataaataaaattcctatatgcctcctctctgatattaaaataggcttcacttaaaatgtttttagaagacacagctaacataatagcttagtatgtgctgagcccacaatcactctgagatgggtcttgtttgcatttttacatttgcattttgtgtacagatgagaaaacagccatttagtggcagactcaggattcagattccagaggctaaactcacatataagtaaaacttaagagttgctcggtgataatcttttcagtccttattttacttgacctctctgtgcaggatctggcctgctgacaggtgaatggtgtttacacgggtgttcactttataataatccattaatgtacatttgctttatgtacttttgtacacatggcaatatatttcacaataaaaagatataaaaaactaagtcaactagcaagacttaagtcagggtaacttacatgaaaatccggatttgcaacctcttgaaaaactgggagatctggcctgtcttcttccaagaaaacaatcagctggggctgagcaagagctgcttcctttagacaaactggcttgtgctctgatggagcagtgccctctcttctggctttcatgattcatgctgcttttctggtctaagacttacctaacaccatcccatactcttctccctggtgctctcttacaacacacgaacataaaaggatgtgaatgtatgacttatagaacatgtaagtagatgtatgattacctatggcaagtaaatttaacctcagatccttcacctgtaaaaacagagataatcgtagtatctaacagaattgtgaagattaaatgggataatgcacataaaacacttagctcagtatctgtcacagagtcagcatgcaatataaggggctactgtttgttttgacacatatttctcacacttataactaaaatgtaagcctacttgccatggctactgacttgatttttataggtgatacagcatcaaaatagtgtacttctgtattaacactccagtaagtattaatactccaataactgccactgttagaaaaaaaaaatcagtaaataaaccttccttagtacctttatatgacattaccaggaaaaacttccacaattatattttgaaaggcagactcatttttgccagattcatgtatttcccctgattgtggcttttggtggtctgatcagtcaggtaagtggatatcttactactaaaacatacttcaatacttactactaaaacatactttagtatgacaaacatcttagtcataaaatatcctccaaactaagaccaacttgatttttcaagataatcataggaacaccaaaagaagcttactaccttttgctcagctgttggtactccaatgactgcctcataatgcatatctaattcttgcccctcagacagacatatacaatatttttctccaaaaagccacagaagtctaactgaaactattttctcccgaaaccaataaagtcctcatacaatggaataccatgaagtacaagaactgaatgaaaactaatgagctacagttctccacaacataatcttacaaacataatgctgagcaaaagaagccatatacaacagaattcacactagaagattctgtatgcgcaaagttcagagagtcaaaactagtgctttcagaatgcataattaggtggtaactataaagaaaaactagaaaatgagaaacctagaagacaagatacatgcaatctttgaagaagggaggatatgacccagaaaaggcatgttagggattctagcacttatcattatggacagaattttatttgctgctctctacccgcaccattaaaatgccctatcagtacagagatgtgttcactgctgcatctccagcacctacaacagtgattggtacacacgaggtaaccaacaaatatctgctgaatgtaaaattccgctttaggaatccaaattgttacatatttcacagcttcttgaaccctaaatgtaacagtaacagctagtatagtgttcatttgccttgtcagtatattcaaggagctgttaagcatataagccaattactttataattcttaatgtctccctcctattgagatattgataccaaacatatgcagaaaacacttacatcaatgtatccagattcaattcaaacatttaaaaacattaacaaggaaaaatacagaaactctgctaaacagcaagcccaggtttagaaaatgactttgtcacctcctccaacgaagaaagcacacaagaatgctctgttattacaggatgaccataagtttgctcgtatttttaagagtaaacaatgcaaatcctttgtttcttcaacaatgagttacacaattcacaaagtgatcattacagcgtatagcagttgaaaactgtaaatttctaggatcgggatcccaaacaaaatgtactcatttaatatgtgttaagctaacaaaaagaattagtcattactggtatcctcctgaattttaaaattacatactaaattaagtgagctaatcttatattaagtttaactggtgatattcagttaccagaaactgttgtacaatctccaagataatgacaattccaaaagcgtgaaaattcctaagataaccaagaagaaaaatgaacttttcagtctttgggaatttacatttttttaaaaaggaaaaaatatttcggtaagtcaaaaaaaattaattaaaccaggtatacgctaatcttatgttcctaattagaatccacagaaagtaatatcagcttctgttttacctcctttccggacatgataaactagaattgagatcattcaccagttaactcacttcccagtattttcagtatatcaactgaaatatatccgcaacacaaactaataaaaccttatctcttgatctatcccaaagtgagggccacctgagattcagtattgagcactacatatatgacagggttttgttatcacatttcaaatggtgttttacagtacaaagtttggtaacattggtgttctcatgatctaaagctgtgttcttgtggtaaaggcaatcattcagagtccatttattttcatccatgcttaggatataagataaaactccctacccacgtattccccacatactgctcattattaagaatttatctgtttaagaggaatggaaataaagcacctggctagcccataaaggagcaacctgaagccactcttctctgcaataaataaataaagatgcactctaggtcagagagagcaaaagtcttatttttattgctggcttatgcaagaaatactgcaacacaccaattttataggattaactttaaaatctgtaaactatcctaatgtctatttctttctacaagactaaaagttgttaaagtaaaaaggtttttcaagatttgctttcaaaattcagaggtgcaaagcaagttccagtcaaatattccaggaggatcattctagacataaactatctttttatttaacatatcaaaactttgctaattagaaatgactggctcattccactagcttgtcttcagctactataatgctcagtcatacacaatgctgagcacgtgaatgctttcaggcaggcctgaaatgagcaatgactgagcagtcacagatgggtggcactacacatgaatttacagctggactcatggtctttcagtaaggtgaatttttatcatatcaggggtatgtcaagtaacaggattacgtcttcaaattttccaccaaaactattatttttaaagacattttccttagcagcatggtgatctatcatatttatacacagttttattcttagaactgtacagagtttacatttggtctctaaacagaaaagagattaaagagcaagtaaaagtcagagccagaccttgtttccaggattggaggggaaaaagggagtggaactactgtactttttttccttcaaatcaaacgggaagcagtactacatatactgcgttacagccctcgaagccacagattggtttccacctcattatttattggtgtctttccttttttttttttgagacagactctcactctgttgcccaggcaggagtgcagtggtgctatctcgactcactgcaaccttggctcaactgcaaactctgcttcctgggttcaaatgattctcctgcctcagcctcccaagtagctgggattttaggcatgtgctaccacacccggctaatttttgtatttttagtagagacggggtttcggccgtgttggttgtgctggtcttgaagtcccgccctcaggtgatatgcccgcctcagcctcccaaagtgcagggattacatgcttgagtctggcaaattggtgtctttcctaataatataatgtaatttgtgccaatatataacctgggggggaagaacaccacaatttgaaacataactatcttatgaagctgtcctgaaacaaatgtaagagttgtaaaatgtagttaggattatcagccaactatataaattaaagctttaaccatgatggtctaaaatgccaaacacacacaaaaattattgctacagtgaggatcattaaaagttggcagccaaacttcagtgacttctcacaaactacagtgagtttttcacttttaaaacagtatgaagcaagtatgcattgatcagtaactatcataattaaaacactgcatcactcactcaagaaacaatccctatatgtaatgactgactcttgtcattaatttttgttcattagcttggccattttctgcagctcttaaggtttcaaaaacgttaagatatcaagaaaagcccactgtatacacaaattaactcaagatggattaaagacttcaatgtaaaacccaaaaccataaaaaccctaaaagaaaacctaggcaataccattcaggacataggcatgggcaaagacttcatgatgaaaacaccaaaagcaattgcaacaaaagctaaaattgacaaatgggatctaattaaactaaagagcttctgcacagcaaaagaaactatcagagtgaacaggcaacctacagaatgggagaaaaacttttgccatctactgatctgacaaaggtctaatatccagaatccacatggaagtgaaactaatttacaagaaaacaaatatccgtatcaaaaactgggcaaagaatatgaacagacacttctcaaaagaagacatttatgctgccaaaaaaaaggaggtatttatgcggccaacaaacatatgaaaaaatgctcatcatcaccgatcattagagaaatgcaaatcaaaaccacaatgagataccatcttacacccgtcagaatggtgattattagaaagtcaggaaacaacagatgctgccgaggctgtggagaaataggaacgcttttacactgttggtgggaatgtaaattagttcaaccattgtggaagatagtatggcaattcctcaaggacctagaaccagaaataccatttgacccagtaatcccattactgggtatatactcaaaggaatataaatcattctcctataaagacacatgcacacatatgtttactgcagcactatttacaatagcaaagacatggaaccaacccaaatgcccaccaatgacagattggataaagaaaatgtggtacatatatacaccatggtatactatgcagccataaaaaagaatgagttcatgtcctttgcagggacacggacgaagctggaagctatcatcctcagcaaactaacaccagaacagaaaaccaaacaccacatgttctcactcataagtgggagttgaacaatgagaacacatggacacagggaggggaacatcacacaccaggacctggggcctgttacccgggttggtggtggggggaaagggagggaaagcatttaggaaaaatacctaatgcatgtggggcttaaaacttagatgatgggttcataggtgcagcaaaccaccatggcacacgtatacctatgtaacaaatgtgcacattctgcacatggatcccagaacttaattaaaaaaaaaaaagcccactgtgctccacttgatacaataaatcaattcctgggtatcatgtaaatcagtgtaacagtaaaaaatgacataaatcattttcatacttacattataatttcagatagccacagcgggcaatactactattcccgagacttaacaaaaacatttaagtattcagcaaaatctaataagcatatacaatagcacaatcttaaattaaattttattgcttcctccaaaggaaaacagcttgaaaacacagaagccactgaaacttccttcagccacttttctgtgattcaaccaatgaaatcgtttcttaacaatgattcataccactttcttacacatttaaacaattctttggtgacgcagagaaccaccctaattcttgtttttcaactttctaataatcttaaatcaaatacaccagtaaacaaaattctgactgcgaacgcagacgtttatcacacatataaaaaacgtttttttcctttatttatttatttgagacagcgtctcgctctgtcgcccaggatggagtgcagtggtgcgatcttggctcaatgcaacctctgactcccgggttcaagcgtttctcctgcctcagccttcccattaggggggattacaggtgctcgccaccaggcccggctatttttttttttttttttttgtatttttagtagagacggggtttcaccatgttggtcaggctggtcttgaactcctgacgtcgtgatccgcccctcctggcctcacaaagtgctgggattacaccgcgcccggccacgttttttccttcattactttttgtttttgagacggaagctcactttgtcgcccaggctgtagtgcagtggccccgatctcagctcaatgcaacctccgccttccaggttcaagcaattctccttccttagcttcccaagtagctgggattataggcacgcgccaccatgcccggctaatttttgtatttttagtagagacggggtttcaccatgttggccaggctggcctcgaactcctgacctcaagtgacccacccgcctttattacttctttagtatcatgcacggaggattcttttcaatctaggtacatacatatttttaagtagtattctacattttcttctattttagaatttttattgctctttgtcatttagatttcctttgattttttttagcctatgaggcagaaaacatttttaaaaaatggataaccaatagtcctagcaccatacattgaacaagccactttctccaatagtctacaatattattttttaccacatattcgtagttttccaccttgctggctaaatgaacttaaaagttatcgtatctctgtgtttcaatttcttcaccaaaaagtagagataatagttcacttcatagggttactgtgagaattaaataaattgagcacttagaacaatacctgacatgcaataatactgatgatcataattactaaaagcccataaatgcacagatgtttctggacctccctggttcctgaactgacgggctgctttaaatgactgtgaatttctaacaagtttcctgatacggccttctttttccaaaattttgtcgctatcattttatcatgtaggttttcttatcaatatgtcaagttttctacaatacaacactagaagacactgacttggggaaaattagtaaattctacaacagtgactgtctccatccagaaaatacattgtttcatctcgtttattcagatctcactttatgtccttcattaagattccagtagctcaccaatatttgttatatttatttctaggtagtctttttagagaaacatttagtagtatatatcagaatttaaactgcacatagcctttgcctcggtaattccatttttaagaatctgatatacagtaatatatgtgtacagatataaaaaggctactattccaagaacaaaatcctggaaacaaatgtctatcaagaaagcaaagataatctaaacagcagcatattcataggatgacaaactattcaaccattataaagaaaaccgaatcaaaagcactggcttattagacaagagtttcccaaactatcatgctaaaacagtaacagcgagcttccaaattaatgttgcctttttttttttttttttccaaactgaaaggagggtggggaaaacaaacgcatcatatgtaaagcactgagtccagcctggctcttagtaagcattttaatcaccttcaaaaattaaatgtgacttacggaaacaggtcactgaatattatttcatttcacttattcatttatggcctgttttgctctatataaaattctgaagtggctccataatacagcatcttaaaaaaaagctttcaacttgccctttactcgcaaatgtttacaatgcaaaaaagtccctacaacgtaatatttaacgagtgatgcttttcaatatgccatacaaatctcaatactataattcaggagaagtactcctcctaccttactgtggcaatccattgaaaacgtatttctctccatacttgaaataacctcttaaaaagtgtgttgtcttgcatattaagtaccagagatcacacttcaggaacaaagtgacattctgtgtaatacggaaacaaagcctttcctcctaggaaagaaagccccagaaaagacaaataatgggagcttattttaaaaccaaagcaaaatgttgccttttatcctaaatctctggatcaagttttacctttagattgttcttcctcaatgtaaggtcaaaaggtgcaagttaaatttttcttaaacgaagaatactatatcccttaaaacaatctattcattaataagtgtaaccgctagcttctcccagccagcaaacaagcttctgtgagagttcaaaagtttcagaggcatagtattcctgctcccagatgttacgggtaagcatttcaaacaaaaatacacacagaaaaccactacctgcccaagtatctcgatactatttgaagtaatgaattgatattctttaaaggggagattttttactcctcacatttctgtattcctttgtttgaaataacaagtactattttatgatgaaaaaattaatatacaaaatgggaggagcatcctagctgtttttcaggaactttggctttttaatgtaatacacaagttagtttcaaagcaatgggaaaatgcaataatatttcagagcacataggaaaagtaacaggaaaaacgttacttttttcggctgaactcaccggcctttactaatttttaagtgctcatcttattgtccattcgtaggaatactttgtattacttgtgaaagtttaattcaagttaaattattaaatgttaaagaggttattttcaaagttaccttaaataagtaatacagcatgaaagaaaacccgacctactacgcctcacaggctgagtggagtgttttgcagtctcaaagccttatcgctggcgtgcgcataccgcagggagtgacatcagatcgaaactacagggtttcgccggggaccaaccactcctccaaagacagcagctcccggccagcaggaggtggcaccccaagccccgacccgctgagagccggcttccagcccccgaaccctcactggagccgagtttctccgcgagggacctgttgcgtgtccccgccctcagcgagccgcagccaggcacaggcgccggcagctatgcacctgcccagtacggcggccgggcgcccgcagccccctccccggccgcccccagtgcggcccgcgccgcccccgcccgaggggctccccgcggcccgcggcccgcggcccgcggccccgcgccagccctgcccaccccgccgccccggggcccagacagccgccagcgagggagggcgggacgcgggccagatgccggtgggcgggcggcgacggtcggcccggtctggccctggcggccgcggaggcgctcaccttggcggccgcagctctggcggacatcttgtctctctccagcgccgcgcgaggctcctcggacccgaaactccgcggcgctggcccgcccgctcctcacgccacagcccaaataaacatctcccgagagcgagcggggcacgggcgggggcggccggaagggcccggcccagggggagggaattcaactcggacaaaagtccgggaagcgcccgccccgcccgggtcttctccacggggcgcgcccgaccggcacctccctccgagcgcggccacccactcggcctcccgcagctttcgcagcccggccacgtcggcctcgcccggtcgcccgcccgtcagcagcacccgtggcctcccggcgtctcctcggaagccggcttcgccacgtaacttcccgggaaccggcggccgccaaggaacgcggcgtccgctggctcagccggcgccggcaactcagcggccacgcaaacctgccggcccggcccactgagcatgcccg

SEQ ID NO: 2206 - DNA, 122351 bp, Homo sapiens; identical to SEQ ID NO: 2205

SEQ ID NO: 2207 - DNA, 1151 bp, Homo sapiens
cagagaggaacctggagggaccctgtccctgacaccttctgggttgttagctccagatcaaaagaactcctgatttggaaaaagcttcttgaaaagaagaggggaggtgaccttggtgaagcctctggggacatgagctatttttagggcttttggcaggaaaagagcttttgaaaacggagataaggcatggtattaaaaaggcttacattggagaaagaaatcataaaactccatacagttagggcaatagttttgttttttactaggacagcatcagtttattggagtatttatataacataagcaaggtctcttgatattttaacaattaacaactggattttattttctactataggtgcagtttatcattctgaatccaaagccaaggaatataaacatgtatgcaaacgagcttgtcagagagtatcaacgcaatgtgtatcatctatgcttttcagttttgaacataaagcagtggctctgagcgcgactcggagggcgacgccgcggccgcagccatgggtgctgggcctgcaggggcgcgggggggagggcgacgctaggacctgcggggccgggcgggagagagggctgccgggaccggccctagacactgagccgcggtgggatccccgccggctctgcgaggccctgcgagcgccagggaggcgcctcgagggagccgggcagccgccggccacttcaggggggcccgccacttcagggcggtcgaaagagccttgggggcacatctcggggtgcggtgacccgcccggcgcatttcgggggtcggggcgcatttgccaggggacatctggagcccggccctgcttctgtcgggctccagggtacccctggatggctgcgctgtgccctcgccggcggcccgggcgccacagcggctgagttcgccgggatcgccgggccgccgccgcccttgccaccggctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgttcgaggacatggacca

SEQ ID NO: 2208 - DNA, 3716 bp, Homo sapiens
gaggaaattaatcctttgttgatttttgaaagaatgatacattggcatagtccaaacctcagaaggtacagaagggaaatatcttcccccaacactgttcctctctcctgagttttttatgaatccttacaaacatgttttatgtatattaccataatacgtacgtacacacacacacacacacacacacacacacacacacacacgtacatgtgttccctctctctacacaaatggtaacatactaaagatactcttctgtaccttcatggtacaagtaccctcaactccgcctaggatttgaccaaggccacagccaagtatgggtggggtgggcacttggcctccgagctctgtgtccagtgctcgctccccacagcgccccgcaactcacccacagcagctgactcagccccaacctgcctctaacaaccacgcacaaaagcagcaagaaatggcccatgctgtcttctgggcaggacactgcatcctgcagaagggacctttaggctcattcctccatctgcgaagctgggctcccaggggaccgggtaggtggttggactcaccttgtccgccctctcgtgctctgcggacatagcagagagagcccgctgtaactctcctgcaaagtgccaggaatgatgcaggcgggctgccagatccttggaatcttctggaatgagagaggttgagctgcagcccaaaggcctgtgaaagtgccaggttgaaggatgacggggtgcccagattcccaccttcaaatttcctggcagcatcctggctgtcatggagcgctgtctccagttcagttttctgacacataaggattcgtatggtatgatcctgggcctttgggagacaagaaaagcaagtgctgaaagagaagcaaagaaaccttctccagaggacaggagggaacttcacaccctccactcacctctagctgcctccttagggcttgctgatgttggtggcttgccttattttcctatagaaaagaagaggaagacagagctcttactagagggaggcagagatggcacagcaagagacatgcccccagaatggccccactgtcccaggacaggcccacccatgggaccaggttatcagggaccctgtggggatggggtggaagctgggaggtgagccttcctccccaagctgggagtaggcgagacgagactggggcctctacatctgagtgccccccaaacccagcggtcatgtcgtgagcaaagaaagaaaccatgttacctctttcagctgagctcggttctgttgtttctgtggggagagtcaaaggaaggtgactgagggtggtccctcgactctattccccaggccaggaagcggtaggcaggggtcaggaatggattttaagggcaaagttctcagacccaatgggaacacaaactggtcaactttccttaacgcccaaagaaaaaggatttgggtctttgttggcttttgcccacagccacagaactgaaagtctgaaactagattctctggaaaagacagtaacataaaccttccgacataagagtgtgagaaaagcccacccttctgccagcttgtgatggagaaagatgtgttcattcaacaagcattgagcaagcacataggggccggggacggttcttcactgctgggatataggacggaaaaggcagacaggagcccttggccccaaggtttccattctagtgaatctttaaatctcagactctcagagcaaacagaacctctgatactctaactctacctcctcaggaaacggaagcccaaagaggaggggagcttacagcaggccctggactagggattaacacaaaaacaacagcaacaaatctgatttaagcttcacacatgtaagtaaaacattaccatccccattttacagatgtgaaaagagaggcccaaagagctcgagcaattttccctaaaccgtgtccctcgcagttggagagagaagtaggactcaaacccagaattcttagccagtacccagcagttcttccttccacaatcttaacagttaccctcgacctcccccttgtgccccttgtcctcaggagaccggccagccaagactcacatcctcaggcgagtggcagccccccgaagtggttgtctcagggttagcgccatgatttattttcttctttttggtgtcggttgctccggtaccaacaccagcactgttccactgatgatagtctgtaaactgtggaaaagaggagcagtgatactcatgagaactacaagctcctacagtcactttacagtttatacaaaatactctcatagacgatctgacttaatgccaccaacgactgtacgaggtgttgtcgcaatcacttagtgactgagagggattgataccatggctaaaagaaaggcaataatggaactgaaactcagtcttctgactctgagctctggggtgttgccacaaatcagcagctgccagagaccaaaaccagaggcagaggtagaaaagtaaaaagtaggcaggaaggtgtacactgtgtggtttacagtcgtacatcctcttagagtcatgtatcctcagggcagaaggcagcctttctgttaaatgtgggaattaaacagaaagaggacaacccaagctgcatttcagagagaagtcttgtatactctttgaaatctatgtgactatcatccctaagaacattaatgttttgtgtctcccacgagaatcaaggaaaactgatgcttcagaaagatgccccatatgtatcctgtggcactcaaagtaccccaggttgagatgagatgaggaagattcaagttgtcaagtccagtttcccaagatctcttgcacagaagatgagcaaatctcacttcaaagatcactgactgatgggcactctggtcccagaaccatggagaattcaaatatgaagtggagaacttagaaaaaactgttaaagtctctctggagagtagaagcctgggagaaaaccaaaccaaacccattatcccatcagtgctgtgcccaagttgcctctttgagattggcatggggtcacagggttgggacccaggtacttggagacgtgagcccaaagagcccagggaagtcaggcttggggcagcggtaggtgagggccgagtatggagtggggagccccaggagtcacctgcccaaagtcaccctggggtgactggtgagggcaggtgctggggcatccggttccttgggaacgtgagcccgaagggcccagggagatccatttttggacaataggaggtgagggcagagtacaaagcagggagccccacgagtcaccggctgaaagtcaccctggggtgaccggtgagggcaggggcaggactgctgaggggttggggctgacacaagattttggttgggggagcccagaggcactggggggggcccggccctgcgtgcctctggagtgacacggattctggcagctgttctgccatcagaggggacctggggctgggttggggttggggtgctgcaatccgatgcgttttacctttttcttggtcccagccaattttctttgttgggttttttcggacatcatggggtggggagggtggtggggttggggtcacattggcgtgatccaggcgaggacagtgatatgcctccagtcacgtaccacacagctatgtgactgagccacaggaggcgtcaccggggctgcact

SEQ ID NO: 2209 - DNA, 1669 bp, Homo sapiens
cttaagtgcttcaaaaatacagtatttattgtaataactacagtagcaagaagaaaaaaacgaagtggaactacgtgtttagcagcagagctgaataattatgaatataaacaattactattgggagaaaatacattacactcattgcttggaaccatgaataatacttatatatgtacgaaatatagaaaaataaaataggttaacataataaggatataggcaattattttttttaattttataaaaacttttatttttccttacaaactggggtagttaggagacctgataatagcttttttattttcttggcaccaaagcaacttacttatgtgttccttcttgcattatctgttccagatcatagtcaagttttccaattcgttttactaagctagcaaaattttttataccaaaaagagtaaaatcaaaacaaatgctcctttgtttatagatgaaaatctggagcaaaataacacaacattaaaaaaacaaaactttgcaaacacatcctaaagctacacacattgaagcgtttacagcaatatgctccctgggttcgttctcccttcccccaatcctctaaactgtgcctttgggtctcagacccttgtcccgggggtccctctgaatccacctttcaagaggatggagctgggccactaggctgaggtctggccctgttctcctcatctgccaaagcctcacagtactgcgctggccagtccttggggtcttgattatggaccttggccacaaacttaagaactttcatcttgctggtttccaggttggttcgcgggccccactggaattcgtagtcgacggggtcggtgtggggtatccgccggtattccaggtaacgctgtcgcacaaagtcctcagtaatgagtttctttggatctccgaaaattaaatgcttcttggtggggtagacccctaagcgccgcagaaagtcccaggcttcagtttccttgatggtgttgcccttcataaagatgagccctaagacgatcatcaggaggcccgtagtgggcgtgccttggtcacccctcatctcggcatcctcctccacaggctccagggtgttgatgaggatgtaagtgttgctcttgggttcaagttccaccagcttatacccgaagacgtactggaggcgctcggcggcccgtttgaagaggtcggggaagatgtccttgtagtccccgatgacgtgcttcagtatgtcggcccgcttgatcggaatcttcttctggtctttaatcagcaagaactgcaccagctcggacactttcagctccagctgcttctggctcctgggccccacggcgggggcggcctgggcccggcgggcgccctgaggcgaggggccctgcgacccctgcgagccgcccggcccgcgggacgtgctcggggcctcctcggcaaagccgtctctgagaacccgggcgtcttccccggcccgcgaagccccggggtttccgctatggctccagtctctgtccctctcggcctggccgccagagcggccccggttcctcggtttttgcaacatgtctccggcggcaggtgccggcgcacactccggtaggcaagcagccgcggcggggattgcgggtcggcgacccgctaacgccggtgcctggaggcgcgcgcagtgtcggct

SEQ ID NO: 2210 - DNA, 22064 bp, Homo sapiens
gtatgtgaaagtagatttttattacagagcaaatttttctatcaattcaatgctttaaataaaacaacataataccataaactgacaatgacctgggagcatgtaaatacttaaggctggagaggcatttttattcttgataaatttatataataaattcttatgacatttgattccaaattgtatgtacgaattggcttgacataataaatataaacataagggcaatttaaacattggcagtagtttatgtaagtcaattcaaggtcagtgactggagaactatattaagagaaacctgaggtaaaaaaaatctttaggaagcagccctgtaacaatgtacatttgtagatcaggggctaaaaatccactctgaatgaataccaagaagcaaaggatgtacaacatccatcacacatctgtttcaaaaacagcatgtttctaaaatgataatctctttacaagtaaacgttacagtattaataactatagagacaccattgggatgagctccagatgccctgctgacttccaccaagcacccctgggccatcgcttaaggcatccatcttaatcctggggctttaagaacatcttctttgctttaattggtgttatgtctccattttcatcttcttcataattggcatggtctctctttctggcaaactttttcccaattgtccccaccaaggtctcatatctgtcaagaggacaggcagcacacgtttaatttcaaataaaaaggtagggatcaagccttgtcaagaatatcagaccaaatatgcaataaaaaagattacgaaaaagaaaactatcattaaaagaaaccatctgatttaacaatttatgaacttctctaagagtgattaaattccttgccattttggtgtttgcattaccctaaataaatagagatgtacattttaaaatacacatttccagcagctctggaaatgggccctcaactggcagcctgagacaggtctgtggcccccgtaggccattaagagaaggccgatcacagtcatcgtcctactgggggactcccttgaaagctgccgtgcactgtggggtaagaggagcattcctgggagagccaatgaatgctaggtccagattagaaggctgctgcgcagcacggttaccttctagccatctcttcatctgacacatcaagctctactgtttcatcttcaacttcttctgctttgtgcttagcattcatctgaagcatcaatttctgaaaaatacaccagtgctgaccttcaggctagaaaacgcttgtgaaaggaactgatgtcaaacttacctgaaggcagagaaactgaagtcaaataatctagagaactagtcaaaattgataagggactctctgtaatacttgataccacaatggtgtaagagaagtaagctctgagtcaaaaaaatagtaaggcaaagccccactgaattatacttagggtgaatttaaagtgtatttaagatcataaatcttagtattagttactcatatttaaagcaggcatactgctgacacattccggtgagtgggggaagaaataataaactttcagattttccctgaacttcccccacccatctttaagccatatggaagaaacactagtcgtcagtaataattttaaatgcatctcttggtggtggtggtggtgagtggaggaggtgggagaagtggaaggctggccctgtttaatggagggaatctgcacctcagccttaccctcctaaactttagagtggataatgcatcccatgtaacatccatgcaccacagggtctctcctccaactctttcacataaacctttttgtgataattatcctctgacctttttttttttaaatgtgtaatctcttctttttagcaagaggagaaggaataaaagatgagaaatcagtcttaactagtttttctaaggcttaaaagagtgataatagtttaaaaccttttcctagggggagtgtattcagtgtttcagaatccagtaattagggccattttctaacacccgtccctgccccccatcaatttctgcgggcagtggcacctctcctttcccattgcagcagacatactttggaatgctcgcctatccaaaccctactctttgaataccacatcttcataatccctgcctttttcttccctcttcaccccactgcccagcccctctccttctcaatctgaagcttaattaaagaaagtcaaagcgagaccagcatatattaaaaacaaacacttctaacataacaccttaattatcacacatgcctcctcccactccgccaaaaaagaaaaggaaaactaacctagaatctttcaataaactctggcaattggcttagttaactgtggctcctagagaagtggttcttaactggggatgattttccccaccagggaacctgtgaaaatgtctggaaacatttttggttgtcacagctgggtaggagggtggggtgtgtgtgtgctactgatatttagttggtagagaacagaggacagggatgtggttcgtcattctcttaggaaagccaccaccacaaagaattatctggccccaaatgttaacactgccaagggcaagaaacactggcttcaagtaatatttaccaaactaaagatttatatctcatgtgtccatttggttcatcaagtacttgataggatggcttttaacatatgagccagagttctaatgaatatttgttaaataaaggtctgcttctctatcctggagcaggaaaattcaaatgaatagctcagttataaggcaaatattcatttttcaaacaaactgtcgaaaggattcatttaaaaatctacttacaagcttggattacaacagtccattaaaaagtcaaatgacataattctaaagtaacatttttccgttagaaaaaatacatgtataggtgccagaaaataacttttcataatagcatgatatgaataaaatcttgacgttcctgtaaaagacacaacttgaaattttaatatttatggtggctctgtcaagggctgtatactgctatatgaaattatctactcacctctaccataaaactagactgcaatgcctccaatttctttaaatagctatggcgatatttcaagacttgttattttctatataatgagtagaaatggtacctggtggagaaacacctaagcccaattattagcagaaaaaaattcaattggaaaaatttttaatttgaagcaattatatttaatacctcaacctcaggattaaatcctctgaatgacattcttccatagagaagatcttcacatagtaagaaactctgctcttctattatgaaactcctaaatgggaaaataaaaatagcatttctccatatataaagcacagcaaacaaaagccaacactttgaataaaaaaaataatcaacctatggttctcagtagaatgaagtaaaaatacagtaagatttctaacttagggttaaaaataaaatctgattaatttggtcagcaaaggcattaggagacaagagcagcaagctagaggcacagcctctcttaaacaccacatttaatttgcataaatatctacataatataaagatctaaagtattgacaataaacttgaatttgccaaagttgaagcaaagtttcttttgtgtttacatcccctcaccatatttttttccaattctttttcagaaaggaaataatatgtatgtaaaaatacacatacagtatacagtgacacactactccaaatcattttaataaagtttctggcatattttgtctttcgttctcagggatttcaaaaattccattctctaattatcaaagcagcacattttaaggaacgtaatttggaaagcagaataaagtatgagtttataaactgcctgtaagctccttaccaagaggataaaaaggactgttagtatatttgaatatttccttccagtcttttttgtacttgcatttacgttgattcttgaacacaggtctgagctgtgtggtgcacttatacacagatttttttcaaaaaatttcaatagtttttggggaacaggtggttttttggttacatggataagttctttagtggtgacttctgagattttggcccccaccaaattcttattacaaatccaggagaagtagtgggaaatcagaggcttgagcagctttaacagtgttatcagtcagagctcttagctataaacaccaaaggctgaccctggatgacttcagcagagaaggaatttactgtaagaacactgtaggctcttcatttccaagggggactggttccaggaccccttgtagatatcaaaatctgtgacacaaagagccagctgtactgggcatctcagaatcaccgggaaggctgaaggggcagaattggaagacgggcagaaataacggtcgctaggtggttgcaccagaaccaaaatcatgctagagaatgaccctaggaaaaccactgttgctgctgacggggctgagcacgacaccactgatggcattggggcaggttgcgttccctggaccaggatgtttctgtctgcagcagaatttctctgctgagtcaccaccacatgaccgtaaatccaaggtgacatatctatctccagcctggccataaaccctaaagcatggcaggaaagcaaacatgtggcttttaaggcttgtttgccggagtaggctctgattctcataaagattcccttatgcaacaaacacttattaaaccaaactgtgtgtattaaatcaaactgcggaaacagccaccagtaaaagagcctcagctgggcacagtggcggatgcctgtagtcccagttactcaggtggctgaggcaggagaactgctcgcatcccagaagtggaagttgcaatgagtcaagattgtgccactgcactccagcctgggtgacagtgtcaaacactcacctccaaaaaaaaagaaaaaaaaggagcctctgctctcctggaggttacagtctatagaaagaggggccaaataatgaatgaaacatgaaacatttatatcacacaatggatgaaaataaagcaggttattccatccctagctgtaggggagtaattggtatggaactagctttcctgcaccataattatataaaacaggacaaaatataaaatgaccattttcagataatgaacaaatccaagcatatgactgtgatgcctgagagaagaaaatcaaatgaagtagaccccatgaatgcggagctttctgcctggaggcaatttccagattgtggagcagggagtgggggactcacacaaaaccctgtcttgctgagcttaagagacaaactgtttcattggggctttagttgaaaaaaataaaggcacaaactgaagtttggggttatggtggtggctggaatatctgggtgaggataccactgaaagggagctacactatggaattcaggacctgcatactgggttcccttgaatctttggctgaccatgaagctgcacatgtgcaggatgagtctttagacttagggaaaaagtaactgctggagagatgatttctgggagaacacctgctgcattagcttcctgtggctgctgtaacaaatttaagctgacaaaattggtggcttagagcaacagaatttatgctcctacagttctgtacaaaatccagatgttagtaggcctgggatccctccagaagcttccacggttacaaggccttctgtgtgtcaaatcttcctcacctctcctccttataaggaaaagtgattacatttagggcccacccagataatccaggataatctctcatctaaagatctgtaatttactcatataccagcaaggtaaattttgccacataaggtaacactcacaggtttcagagatgaaaacctagatattatctgggagaccattttccagcctaccatacctggggaaaaaaaatttaccctgcaattgcatgttgaagaaataacagagcttgcacagagcaaggaaatgtttgagttctgcctagccagagaggagagaacaagctaaacactctgtgatatttagtagaaaggccacaccttaggagtagagacaatttagctacaaaacacaccctaacaaaatcaagctgattggcatgtaagtcaactgcctaatgaaacaaaattcaacactctattaagaaaaataacaaaatccaggtagtcagcaatgtaatacatacaaatgtacagcacacaataaaaaattcctagacatgcaaggaagcaagaaaatgtaatcccctcatagaaagaaagaaaacaactgaaaatgaaattagtagaaatggactttagaatagttactgtaaatttattcaaggatttaaacgaaaacatgcatgcaatgaagaaagaaacagaaagcctgaattaagaaatagagactgcaaaaaaacaccaatagaacttatataattaagggaaaaaacaatttaaaaaaataaattatataactgaaaaaaaaactgcagtgaaaaactggatcagtcctatatctatcaaataaatggaattcattactaaaaatcttttcacagagaaagcttcagatccagatggcttcactggtgaatttcaccaagcatttaaggaagaaataatttcaattttacacaaaccaagaactaagaagaggaggtaggaacactttccaactcattttatggccaaaaccaaagacattacaataactctacagtctaatatcttttttaaatatagatgtgaaaatcatcaataaaatgtcagcaaattgaatttaaaaattttaaatgttacatatgaagaccaagtagagtgtatgtcagaaatacaaggctgttctgatattcaaaagtcaatagttttcaacacattaacaaaataaaaatcatgatcttctcataagaaattatttgacaaaattcaacatcatttatgatgaaaaccctcagcaaactacgaaaataaaggagtatctctgaccactgatcaggggcattgacgaaaacagcacttcatgtgtaatagagagaaagtaaatgctttcccaactgtgatcagaaacaattcaaggactactcttgtcgtttctattcaatactgtattgggtccttagccatgaaataaatcaacaagaggagataaaatgtataactgtctttttttgcagatgacataattatgcatgtaaacaatcttaaggaatccacaaaaaaactacttgtcagtgagtcaatttagcattacagaatacgaagtcaacgtacaaccttcaatttctacacacccctccaccccatacatacacacaacaaataagtttgaaaaaactctatttatgatatataaaactatgacagacttagagataaacaatgcaataagcaaagaaaattttttcaataaatgttaataggtgcagtggctcatgcctgtaatcccagcactttgggaggccaaggtgggcagatcacttgaggtcaggagttcaagatcagcctggccaacacggagaaacagtgtctctactaaaaatacaaaaattagccgggtgtggtggggcagcacctgtaatctcagctactcaggaggctggggcaggagaatcgcctgaacccgggaggtggaggttgcggtgagccaagattgcgccactgcactccagcctgggtgacagagtgacactctgtctcaaaaaaaaaaaaaaagttaataggatcacaggttatctatgaaagacatgtcctttgatttctacctcatgctgtacacaaaaagttagaggcaaaccatggataaaaatgtcagcactataactacaaaatttctagaagaaaacagaaaatatcttaccatcttggcatagccaatgattcattagacgagagtcataaggaattaaccataaaagaaaaaattgataaaatagaaactcatcaaaagacaacattaacaggctagaagaaaatattcactatatatatatgtggcaaagaacttgtattcagaacataaataactcctacatgcacagatgtatgtaagttttgtctcaaaaaaaccctagaaacactgagcttgagttaatgatgtgcatgctgcaatatttcagaaagaaatatactgatgtctgcaacttactgcatcaaaaatacaataaactgatggctggatgggggatgaacaaatatgtgatataaaatatttaaaaaaacaaaacaaaaacaaaactttctcaatttttaaaatggccaaaatatttgaaaaggcacttcacaaaggtagatatggaaatggccaaaaaggaagaagttcttcaacattatgtcatcaggaaaatgcaaattaaaaaccataataagatgccactaaaatagttaaaagtaaaaagatacataactccaaatgttggactctcacacttccttagtgaaagtgtaaaatcatagaacaaactagtctgaaaatttctgttaaagtacaattccacagttacaaaagaaatgaaaacataacaaaacaaaacttgagtatgaatgtcataccagctttatccataagcgtaaaaaaacaggctgggtgtggtgcctcatacctgtaatcccagcactttgggtatccgaggccagcgatcacctgagatcaggagttcaagaccagcctggccaacatggtctctattaaaaataaaattagccgggcatggtggtgcacgcctgtaatcccagctactccggaggctgaggcaggagaaccgcttgaacctgggaagcaggctgcagtgagccgcggttgcgccagtgcactgtagcttgggcaacagagcgagactccatttcaaaaaaaataaataaataaaaataaaaaaataaaaaactggaaacaacccaatcatgagttctttaacattattagtcatcaggaaaatgctaattaaaaaccacaatgagatgccactagaataaaattaaaaagatatctaactccaaatgttgaactctcatacttccttagtgaaagtgttataacacttctctattaatgtccattaatagaagaatgaatagatataccgtggtgtatctgtaaaatgaaataccacttagcaacagaaacaaattactgatgttccaaaacaaggatgaatatccaaaacattttgctgacacagttaagcacatattgcacaattccttttttatgaagttcaagaacagacaaaattaatctacggtttaagaaatcagaacagtgcttgcatcagagcaggagtgagactgactagaaagagggatgaagatctttacgtgatgatggaaatgtttccttgataggagtatggtttacaaagatgcatgcactatcaaaacacatacagctgtagacttaagtacattccactgaatgcaaccaccacccacacacccacacgtgcacacagtttaaggggagatactgagggcagactagaggagaggcgtcttttaaaagagtggtctggataggcctcttgtcaggggtgacatctgagcaaggaccaggaggcagtgaggaagcaagatatgaggatgcccaggtgaagaacacctgaagtccccataagtgggggccctgagaagggaatctaacctgcctgagaaacataaagcccctgcagttggaatggagacaatgcagagtagtagcaggaggtcagagttacttgcatgataacattaagatgtcatcttttactgtgttgacatttgcagactgtgcaaaagcaactctgggtaaaacgaatcttagcatgagtgaaagcagcagtgataccagactaccctggtagttacattcttcactgccaggccctcacagttcaaagaaaaatgccagtttcacattagaatgttcttgatgacacagcacaaatttatttctgttaatcttagccctcaattactttaaaaaatattcggtatacgaaattgaaactctatatataagatacttcttagccgggcgcagtggctcacacctgtaatcccagcagtttgggaggccgaagcaggaggatcacgaggtcaggaaattgagatcatcctggctaatacgatgaaaccctgtctctactaaaaaaatacaaaaaaaaaaaaaaattggctgggcatagcggcgggtgcctgtagttccagctacattggaggctgaggcagcagaatggtgtgaacccgggaggtggagtttgcagtgagcggagatctcgccactgcactccagcctgggtgacagagcgagactccgtctcaaaaaaaaaaaaaaaaaaaaaaaaagatacttcatcatagtcaaataatctaactgcacttgtgtgactgaaccgagagatgaattagacactttttttcaatgtcacaccgtaactatggttttgcgggtttgggttctttggcagacattttcttgaaaataaataaagtgaacctgacacttcaaggggaataactgacactatttactgccaataacaaaattcaagctttcaagcaaaagttagaattccgaatagcttttatctgtcatcttgggcttgatagcttcccaacacttaaaagacttttctgttgaaacccacggtgatactaatgaatgtgatttttgatattgtataacaagatgagttaacactgggaaaatctatacaactcattttccaaatgacagatgcaggatgttaagaaatcatatacaggtaaaagatctatttggaatacaagacagaccaagacatgaaaaattcactggtgttttcagattccacgttgcaatttactctgaagaaactactactgactgagttttggagttgtaccaaagaattatctgaaaaggccattgagatactcctctcttttcaactgtatcacctgtgtgagggggattttctttatatacttcaaccaatacaacatgctttaacaggctgactgcaggcgttcagagtctagctgtcttctattatgccacaatgttaaagagatttgcaaaaacagaaaacagtgccactcttctcgttaaattttttgtcttgaaaaagttatttgtcattaaaaatgtgttaggtaatgaatttgttatttaaataatttttaaaatttcttacatagtaaatattaacaaatataaatcacacaaaacactctttaggtgttctaaataaatttttttttttgagatggagtctcattctgttgcccaggctggagtgcagtagcgcaatctcggctcaatgcaacctccgcctcctggattccagtgattctcctgcctcagcctcctgagaagctgggactacaggcacacgccatcatgcctggctaattttttttgtatttttagtagagacggggtttcaccatgttaaccatgatggtctcgatctcctgacgtcgtgatccgcctgcctcggcctcccaaagtgctgggattacaggtgtgagccaccgtgcccggcctaggagttctaaataatttttataaatgcaaatagcttctgagttccaaaactctgagaaccactgtgattttggttcctctctcactggccctctagtctggctagaaactcacttacttcagaaccgcctctccctgagggaatctaaatttgggcacagaacttgctgttcagctttttctatgaacttgggattccctctcaattgcccaatcttattccttatagagggagcagctgatgagacctcctcaattccaaagtaaatcatctctctcaggaaagcaccatacatcaaagctttcacttaaggcaaaggagggacccagagaaagacaacctccagaggtcaggactggattcagagcaggactactggcccctcagaggtttttcccacgggtttgcattgacaccgtatctttaatataaaaaggagcacaggtgttttgtatctacatgcatggttttaagaattagaaaaattaattacagagttggcaagcaagtgaaatatttcaaaacttacctctttttgtattttaattatccaattttcattaatgaggataattttcaggctaaaacacacccacaaaattatttcataaatttcgcagatgagaaactactgctcagaaaaagctggacttgcctaaagccacaaataccatggcaaaactccagttagaaaacccttctcagtgggtctcacattcctgcacattttttgagtgaggcactaactgcccggttgctctggactatctttgcaaggatatctgcatagcgagcagccttgaaaaacagtcttcctctaaagcgaagggcagatttgcttactgtccagcataatacagatgcctctcttggggccgaaggcaagtctgcttgtggtccgttatccaaggttccagttttctaagctcaggagatctcagctatgatgcaaatccactgggtgcacagcatccacctgggccacttcacgccatccctcataggagttggggacaaaagagaaatgacgcaaacttgatgcttgtgctgcttgctgtacagtaagtcctttgtttctgatggtgttcaggagacactactcccaaaatatggcatcttggcatactgaaaattttacactggaggaatctgaaaaatgacgtgcaggtaggattttctgactgtcccctgaagcaggtcataaaagcatctcacataagaggtgccctccctacactcagaggaaagcaacatccttatctcagaagaagggacagagagaggaatctgaacaaaagacttgctaagtttctcctggcttattactcttcgttcataccccttgctcccatcatatttcttcacaactttccactcttcatcaaagctaacataaaaacactcaggttcaaccagttcttcggtattcattttcttatgaaggctcctgtgtcacctaaaacttttgtgaaataaaagtgtatacctttctctttgttaatctgtcttttgttacagggaccccaactaatgaacttcaaatgggtggaaggaaaggctattgtccctcccctacatctcagacccagaaggttcctatcttccaccagcatcagtgaaagtgtggcaggctaacttgttagtttcaggtccctatagcttctgactccaaacagaccacaaaacacaagtataagatgtacaatagccaaaaatacttcttaaacaacttgctacggcaaaggaggaattaaactgcctatacttgcacactctttctggaccatatccttggggaaaaaaacaataaggcaatagatagcaaaatctttcatctggtaaatttcactcctaggaattcacactatatcgggttccctggaaacagactctgagacagacatatatgcagaaaacttagcaggcagtgttgttcagcagatgcccttctaggaaaacagagaaagaaggattgggcagagggagaagataatgggcaatgtggctacactaaggcctcagccacatatgagagctctggagtcaggaatgcccttcagttgttccaagttgaggcacagcagctagatcatcattcccctacatggtctagccactggctaaaagtgtcccctgtgaggcagtgttaacactgaatagccctaattatcttcactgaattacagactgatacggctgacattaaaaatgggaaagtcgagactttcagagcacagacacatgcaatctccaaattcacagaatagttaagacaacactagcaaaaaaggatacacaaacataagtgagtagaaaggaatgggtgtacttcatatattcagatataaggaaatacacacaatggtgacaatcactgtgctttatgcctggtgttatggtgactgttttacatatattacctcatctacttctcggaatgtactggacaggtactatcatcatacccaatacacaaatgacacaaaacaggttaagtaactcacccaaggtgacaagtaaacaactggcggagctgggcatcaaacccaggtctgcctgacttcagagcccatgtgcttaatcaaccaatccattccatgatctccctatttagagtgttaaaaacaacaactcaatacaacacgtataccaaggacatgtcatccattcacccctccagacctacttcccgtcttcacctgtttctctggcctgggaggctgacttgaacgtaatgcacggaagggctcctttgctgccaggtacctggctcccttgctaggatgaccttgggctggccgtacccgtgaatggaggtagcagctcctgtaaggtgctctctctacacaacttatctgcagattcggtagcagctattccccacccacccgttgactctgcaagctcaggtggtaatcactcccactacacatgctaggaggtgctgcactgccccgaggggcccccctatgccccacccacaccttgatagtctctcctcagtctgagagtgtcatcttctcctgccaacatcctgagctgatatacacacctatacataaacaggatgctgagtaatggcaaaaaggcattatttaccttcccagaaagaaatgtaaaggtcattttctgggaataatatgctgtattaggggaaaaatactggaaacaagatagaaacagtcctgctctttaataaacaactggaaggaacactttggcaagtttacttaaggcataaaagtaaattatagctccagcagcaaaggtcccttcctccctgtgaccctgcccctggcactatcttctccctcctcaccaacatcttgcttcctctgagaagcagagaaaaaaagtaccttctcccgatccctcctggtgggacatactttctatctttagagaagggtatctaaccttcaaacaatgtccagaggtcagccaaatgaacaggggaatataacattccaaatcaaagcccaaacatcaggtacagaatggaaacacataaatgtgcctcaagacagtaagcagcatcttcagtcatttgaccaaagtttaagtaaaactaccatacaacagagcttactaaggtgaggaaagtatcagggaaaaatgaaaaatagcttccagaaggattcagctaaattaatggatgaaataaatccaacactccttcattcaaaattgttgatcaggcaccagccaagcttaggggtgggccagaaactgtctaccccagccttcagcactgactagctgggtgaagctgggcaagttaccctcccttaagctcagttcctcaactacaaagtgacagaatcataggaggcagttcctaagtttgctacgaagattcaataactacagatgtaaagtgtttagcccagttcctggtacacactatagattcagtaaatgttagctaaaatggatggtattacaagtagtaacaatttaaaagaagaaacaaaaacttctgacctgccttaaaatgctcaacctaatgaactctgtaaccgaaacaaaactggagagacctgaagtacacccctaatctttagaacttaaggtgatagagagaacattacagcttccccaaaggtctgctgttactatcagagatatgtgggctaggttccttcattcaatgtaaaaaaggacaaaatagtggctgggagggggagtagtaaaaatgtataaatccatgtacaacttctataggtttaatattttttagttgtgctactaaatcaataaactgaacagaaacaatttcatgggctttatgtcaccggaatgatgagttaaatttaccaggagtttccttctgaatgccacaagcatcatcagtatcaattttaataaacctactctttctctttaagctctggcaaatccaagtaccagtgctcttcactaatgattttcttttcttcttcttctagttgtttcttggtttctgagtccagtcccctttgcataaactgtgaaaacaaacaaaatcaatgtcagaaacttttcccattttagaactgaggaaaccccaaataattttcttcttctacttgttctccttcatttatctatggaacccatctcaagattgagggttggggcaagtgatcaaacggtttagctctacccttccaactttacactagacgatgagggcttgtgtcagggcatgagaaaatgcacaatgtatatttccttcggaaaacttaagggctaagacaccacattcgaaggtcttgtgctcacccacagagcccactggctttggcacctgctgatctggggttgaaatgcccttcttatcctcttccacctggccaactcctcgcccgtctgacataggtaaagctactagacttctatgagtgccagtaaaatcagtgcctctgtcctaaatgcttccatggctccctccaatagactcaccacatctgaactttctgagcatctatcttttctggagaccttaaggactgggtgtctgggtcatctccttcatctgtcccaatatgatgactgaagcacagtaagagcccgataaatgtaggcagaagcaaaggtacatctataagtctgctcttcgtttttatttttcctctgaaatgctgctaaactcttgagctgctcttatcaaatctgcagaaagttgactcaaaatatggcagtaaataacagtcctgctgccagtctctcactagcatgaatacctgtatttcttcagggaacaagtgaacaaacttaagaggctaaccacagcaacaagataaaatatcaacactggagaaaataaaatcagaaaatacccagaagcctcctagcagttaggtttcagcttccactggtttctatgtatcccccatttctttcccttattcaggtccgatatttcttttttatttttttttttattttttttttttgagacagagtctcactctgtcgcccaggctggagtgtagtggcacgatctcagctcactgcaacctctgcctcctaggttcaagaggttctcctgcctcagcttctcgagtagctgagattacgcgcctgccaccacacccagctaatttttctgtttttagtagagacgggggttcaccactttggccaggctggtctcaaactcctgactttgtgatccacccgcctcggcctcccaaagtgctgggattacaggtgtgagccgctgcgcccggcccaggtcccatatttctcctccttctattccaccttttccaaacataagcctttttaggcataagcactttaacaatgactactaagttaaatgaaaaaaccttaacgttcacgaataaaatagtcatgcactgcaaaatgatgtttggtcgacgatggaacccatatatgacagtggtcccataagattacaatgctgcatttttattgtaccttttctatatctagatatgtttagatacacagacaccactgtgttacaactgcctacagtattcagtacagtagcatgctgtataggtttgcagcctacgaacaacaggctgtaccatatagcctaagtgtgtggtaggctataccatccaggtttgcgtagatgaaccctatgatgctctcacaatgatgaaatcacctaacaatgcatgtttcagaacgtatccctgttgttaaatcatgtgttaagtaacacatgatggtgataacatcaagtgctgaagagaatgtgaagaaactgatcactcaaacatagctggtgggaaagtaaatggtacagccactgtggaaaacagcatggcagtttcttagcaaactaaacatacacttaccatatgacccagcaaccgtccacgcaaaatgagtgcgtgtaaaatggtgaaatctgcgtcagctcactgtcaatgtcctggctctttatcatatcctagtgttgtaaaatgttgccgctaggggaggtggcatgaaggacgcacgggatatccctgtacactttttgcaacttcctgtgaatctatcactattttaagtaaaaagtaaaagaaaacaagtttgcagactagtgttttgcagtcgtcatccattttacctgtgtgtacatcctcatcccaggaaagaactgcagtttctggaatgtgcacgctatacttcccagtccttttgcctttgcgacttaacacgtttccattttctgcctggcaaaatatttactcttttaagcctacagtgtgtgtcctttggtaagacttcctggttggcatttggcttggctcttcctaggtctgctcctataaagaagcacattctcaagacagcctcatcaacactggaatattgttcaccatcgtgctgctttggtgtctcccaggactacgattctgaatagaccatgactcttgttcatcttgtatcattggtacttaggcggcacccctggtacacaaaagagctcactcagtgaaagttctctgaatggaaatgaacctagacctatcttatttttccagattctctttctgggatggttttctttaaatgcagatgcctcatttcatcactaatattcctcgtggtaaaactcatcaatactgcccaactgcccttttttctcccatttagtcatgtacctattcttttggtatacaacagccatatacatatgttctgtacacatagaaaggacagaactccctgtgaatatgaatcaagcacctccagacttaggtacaagttcgattctcctactctagagcatttcagaacacattccaaaactagtgaggactcagagcaggcatcagcataatacagtcctcaggctagatgtctgttgtcgtcgataaagttttactggtacacaaccatggtcattcggtcttgaacaacactggcagagctgagtagttgtaacagagactgtctggctcataagaccaaaatatttatcatatggtcctttacagaaagtttgccaagccctgttctgagagtctaacagtgccaaaatcacaaataagcaccctctacaaccattccatactggaagaccttccatccacatccttctttttcttcttcccattaggatcaccctgcaatggctgaccaagtcagaggcattgaagtgagtcaggattaaatcctcaaccctcttatacttgcctaaaaagtggtccccaacctttttggcaccagggatgggcttcctggaagacaatttttccacgggtggtggagaggggaagggtagatggtttagggatgattcaagtgcattacatttattgtgcactttgtttctattattatattataatatgtcatgaaataattatacaactcaccacaatgaagaatcagtggaagacctgagcttgttttcctgaaactagacagtcccatctgggtgtgatgggagacaatgacagatcatcaggcattagattctcgtaagtagagcgcaaggtagatccctcatatgcacagttcacagtagggtttctgatcctaggagaatctaggattctgccactgatctgacaggaggcggagctcaggtggtaatgcaagctatggggaacagctgtaaatacagatgaagtttcgctcgcttgcctgcccgctgctcacttcctgctgtgcagcctgttccttacaggtcatggactggtgctggtccatggcctggcggttggggacccatgctatataggacttagctctggttaaggcaccctaagtgcagctactccatgccttctcacagtatactctgttctatcagtatagacagtgtctcctgctatcttgccagtaagttttttcttatcaatgaccaaagctgctaaaccaaatagagaatgtgggtgatctttttccttctcctttgcttccaacgtccagttgagtctccccatttggtgggggtggacatttaagttaatttctttcttcttagttgcaactcggatatttagtttgagcctgagtcacccagtacatcatctggcttattccaagagctaaaacaactgctaaaatctttccaatatctgcttggccaattcactccacttctctgaagttaatgttattaccaaccataaaatcaaactctgttcagtaaagattcaaattttgctaatatgcatgaaagtgcttgacaaactctaagttatgctgcaatttgtcctccaccctcattcacccattcatccctaactccatcctagctcaactccattcaaatcttgcccatataatgtttactctctctcttttttttttttttttgagacagggtctccctgtgtcaccaaggctggagtgcagtggcgccatctcagctcactgcagccttgatctcccaagctcaagtgatcctcccacctcagcctcccaagtagctgggactaaaggtgcgtgccactaggcctggctaatattttgtattttttgtagagatggggtttcaccatgttgcccaggatggtctcaaacacctgggcttaagcgatttgtctacctcagcctctcaaagtgctgggactacaggcatgagccactgcgaatggcctatctttcaaaacattatgaatgcttccttccctcttttggaaattccacctctttaaacatgacatgtaacagtttgctactctctagaagtagtgcttagtgacaggcatcacagagtacagagtagtaataaagagccagggttctggagccagactgcctgaattcccgtcctgtctacactacttattagctgtgtaactttgggtaaattacttatttctgtttcagttgccttagctgtaagaagagagttactgcctgtagtcacctcaaagtgtcattatgtgaattgcataggttaatatacgcaaaccacttcaatcattgtctagtactataaatatttgccattttcttgatactgttccccgtttcaatagctttccattgctcacaaaataaaggaaaatatctttaatctggcctcaaattccctgcacgttgtgaccattgcctactctgcaaccccatttcttagtacttgccttccagacatactgaattgtctctaattcttggaaatttccatggttttctttttctttcttgcctctcagacttctgaactcagtttctcctagtttaggacgctgtgccttccaccctcccagtaacctagagactaccctgcgagactcaccctcttctccctggaagaagagggagttctgccagcagactgtctttggacttggactgagtacttctctgggtctccagcctactggcccaccctgcagattttagacttgcatctccacagtcgtgtgatccagttttaaaaataccccctctctccatacacatatatacacatatacatcttgttgattctgtttctctgaagaactctactaaaagaagtattatcaaaattaaaaaggagcttgaactcatgtagcctaatgctcttctttttaaagatgaggaaaagagatattcagagaaagaagtgaatttacctaaattacccagctaaggagttacacttcccatatatcatatttattgcatatataagtaagcaacaacttctcgagaagctcggtgagtccccaaggtccccagcgcttctaccctcactgcactgggtaagctgtaccctgactgcttctgtgtactcaagctcccatccgcccgcgggcctcctgagagagtcggcctaattcgtaagctggttcccagtaaacagtgcagagcaggcgctaagtgaatgaatgagcacgagagctggaagccctctgaggcctctctggtgtcccttgtccgcccgccgcctcggccccggccaggttggaaggaccgggtgcccctaccgcccggagtggcgctctcagcgtccccgcaccttcatgcgcagtagattcttggacaaccttgtctttcgctcggccgccatggtagcttccgcccagcgccgcactccggccgcgagcctcaccgcacat

SEQ ID NO: 2211 - DNA, 64 bp, Homo sapiens
ggctgcttctgtagtgtagtccgtgcatccgcccttcgatgcttgggttggatcatagagcagt

SEQ ID NO: 2212 - DNA, 17943 bp, Homo sapiens
ttttaaatgggtatatttgtgtctacaacttttttttaattatagcattagacaatgtgtatatagatacgtatataaagcaatggaagtggcattgttttcatactagtctagaatattaaaaaatatgtaatatgtgatcagcaaaataatggccccccaaagatgtccacagattcctagaaccttacatgaaaacggtacatcatgcatgtgattcaggtaaagaccttgacatgaggagactaccctggtgctatggaatgaacgttgtgttccgtcactgttcatgtgttaaaatcctaaccctcaaggtgatggcattaggaggttaagccttacgggagactctgccctcatgactgggattagcaccttattaaaggcacaagggagcttgtttgttcctctcaccatgcgaagacacagcaagaaggaagcctctatgagaaagcaggccttcaccagacaccaagactgccggcaccttgatcttgcacttctcagcctccaggactgtgagaaacaaagttctgttatttataagctacctggtctaatgcatttccttgtagcagcctgtatggattaggacagtgggctcatgtggatgatgacggtgtctccattcaggactaagtaagcacatgagtccttaacagtggaagagaagggggaaggaaagagccacagagacatgtggccatagaagaagggcccatgggatgcaaggttgctaatggtgagagtggagaagagcccaaagccaaaaaatgcaggcagactccagaatgtggaaaaggcgagaaaaaagatcccctagagcctctagagatgaaggtagcctttccaccacctagattttagcccagtgagatccacatcacactctgacatacgggagtgtaataaatttgttttatgccctgacatactggtagtttgttgtagcagcaatggactagtaatatataaatatatatatacacacacacacataaacactacccccaccaccacacacacaacataactatctatatataccccgcccttcaaaactgaatcagataaactacacattagcattaacttagctgggtgtggtggcacatgcctgtagtcccagctacacaggacgctgagagggaggatcacttgagcccaggagtttaagatcagcctgggcaaacacactgaggccacatttcaaaaacaaacaaaaaacacaacaaatatttgattaagctcatttcccaaatttgaagaggaaacaattattagataaagaggagaaaagagaaaggtagagctgctgacttctgtggtggaagcacaggcacaggcccaaacatactcctgtcctcctggctttcctgtcccttctcataagggacacaggaacctctcaaactgaaccatggatcacagaaccatactcagaacgcaatacagttttgtctacaattttttatatatctgtgtccctgtctctgcctcccattcccaactcccttactcttgttagaaaaaaatggctattatcaaatatgagtacatccttatatactaatgccaactgatcaccagctggttttcttcttttacaaagtcataaatatttaggctttaacacatcttccaagcaatagaatgttattttccagttcattaacacaaattctatatctaaaatgaagacttcacaagttgatttaaataacatattaacgaaaatcgactggccatggttcaaactgacattttaattaaatgtgatgataggttgagtaacctagcagtactctaaaatgacttttggttatggctttttccatattatgcttaggctgaggcatccctaaatgattcaattgtaattccccttcttaaacatgagatttatctttacaaaataatttattttcttaaaattacaagttaattctatagttcatgcatacataatctcagtagatatcagctgtatgtgtacacacatacatataggtatttgtatatacacatattacataatttaaaaaaaacttattagcagggtacaaccacgaagacaaagaggctttgtgtaatgtgatggaaacacaactgcaggacaaacaacaggctgctgtgagggctgtatttaccctttctgatgtaagacttggaaaaacatggatactggatatctaatccccataacagaaaatttagggtgcagaaaacttcccacaatttttacagacaatgtcaatagaaaggcattcaatgcagggaatacacagtgtgacagtatacaaaaataagcaggttgatggtttagatttatgagacaagagaaagaaatagtagatgatgtcataattctccttttatggagttatgaaaattcttcattttatataaggtcaggtgctttcaaatgtcaatgagaaaaatatttaaaggaagaatcaaatctaagacgtagagagatctttataaatgtgaacttcaggccaggcacggtggctcatacctgtaatcccagcattttgggaggcctaggtgggccaatcacgaggtcaggggatcaagaccatcctggcccacatggcgaaaccccgtatctactaaaatacaaaaaatcagccaggagtggtgacgtgtgcctgtagtcccagctactcaggaggctgaggcaggagaatcacttgaacccgggaggcagaggttgcagtgagccgagatagcactactgcactccagtctggtgacagagcaagactccatctcaaaaaaaaacaacaacaactttttttcatgctgagaagatataatcatcaacacattcttgagcacaactatgcacacaggcacttccgcattcacaagccatgctgtgtgcacacactgatgcccctagattccttttttgaagaggtggtctcttggtgtgtcacccaggctggagagcagtgttaggatcatagctcactgcagcctcaaactcctgggttcaagtgatcctcctacctcaggctcctgagtagcctgaactataggaatgagccaccatgcccagccaatattttcatttttttgtagagatgaaatcttgctatgttgcccaggcgggtcttgaactcttggcctcaaggaatcctcctgccttgccctcccaacatgctgagattacaggtgtgaaccattgtgcccagccaccggattctttattaagaagaaaacttgtttgctgacatgtaggcaatgaattgatgaatagtagttcataaattactaatttacaagtcaatataaatgagttgagtaaacacaaaataacagcataaattaataaacagtttacgacctcaagtttctttttttcctttaaaacattgctctgacagagactactacttgtccattccatggaaaagtcagaggtggttaaaatgtcagaggtacacttattaacaccttgctgccttttgtgtagcttcctctcagtacttcaccagttgggattgacacacctctccagctgggttcaggagccagacaggagcacacagaacagggaatccaaagccatctctgacaccaaaagcaatgaaaacaaaaataaccaaacatattatcaagaaatgaacaagagatcgatatcaagtacagcaaaaagagaagaaatcacttaatctgccaggctttcattctgacaaaataatttacaacacgcatgtctctatctgacatgtgtgaatagaaaaataagaggtgacaatagagtagaggattcgtcttccaattgtctctgatctatccaacctttgttacacatcagagagctctccaatttataaataaacaacagagatatgcggcaaccaggacacagagacatactgagagtactgctcagctctctgcctaggcctgattctgatgatccctgacaatgagcactgtgaaatttacagcaaatcagtacacatacacacaaacacacaaaagagatacttcatgggcaaaaagcatcaaagatataaaataaaatgcctgaaagaccataaaacaacttctgatgaaatgctgttttcattttgcagtagtaaaatattcaccaccaaatctacaattagcttaaaaattacaataagtacagtacttttggatcccatctccaattcacaccttatcaacatgtaataatcacactgcatctacaacaaagctggatggactttatgtgctgaatacaacttgtacactaagaaggaaattttttgaaataatgagaatacaaaatttgtatgccatgctctacttcacaagttaaaagaaaatacaatcatttctatttttaaaatgcatcgaaataaaatacagaaaagagtattctaataccagttaacattaagagaatatatctctaaaccaaagatcttggatcttctagaaagacaaaatcagctggtatatatttggataagaaaaaaaaattaagagatcaagaaaggagagaagacgttcgcacagaatcatctccaaaaatggctttctgacgcattcgaccagttttcaagtctatttgtttttcctcctttggcatcaacagcctatatcaccaaggatatgcaaaataattcaatttgtacattaatcagctaatctagaactggaaatatagtcaatgaaaatacaaaagaaacagaaaatgtcaatgaattgcttaagatgtttaagatgacatagcgtagggaaaaaatgatctgataaacaccggaagagttaataaggaaactgaggcatggttccctaacaccacacttcaaaagaacttatagagagaataaaggaataacccttaaaaaaaaaatctaattttagaaaaaaattgctcaaaagggaagttagggttttatagatcttctggaaagctgattaatttctaagctaaaaacgcatgatccttaagagaaatggctgagtccaggcccaaggcaggaagaggacaaaatgagcctggatcctctggttctgtcagaaagtaagaaatgctcaaagactaacagagacagttgaagggacacaggagacaggccgaaggctcccgcagccgaatctgggacagcataggcatcagaaagtacaatgacagtgatggaaaataacccatggaataaaacgcaagtgcattagtcagccgtgatgctgaaacaaaggggagaagagaaagctctttgttaaaaatgccaggtaacaaacttagaaggaatgacagaggaataacatccattttgagtcaccagtgccataactgatagagaagattatcagggggctaaaatcactggatgaaagaaaactatatgaagctttttaacgtagcacaatagataaaagtatgaaaacataaattagaaaaaactaaaaatcataccataagggatggataagttagaatacaggaataacaggccaggcatagtggctcacatatgtaatcccaggattttgggaggccaagtcgggaggattgcttgagcccaggagttcgagaccagcctaggcaacatagtgagaactcgtccctagaacagaacaaaaaaaattagccgggagtggtggtgcactcctgtagtcctagctacttgcggggctgaagcaggaggatcacttgagcctgggagttcaaggctgcagtgagccaagatcacaccactgcactccagcctgggagacaaagtgagaccttatctcaaaacaaaaacaaaaacaaaaacaaaaacaaagaaaccacaataacaaaaaaacactggtaacaataaaatcatgattacataaagactgtatagaaaaaaaatcctcagaatatagaaataaaattatgtattttacctgtagctatattagaagagagtattcttgtagacaaggatgactagaaggatatgcaaaaatgaaaacagctaataacactcattacgtcaggcactgtggtaggtagtttatgcacattgtaacaaattatatactacattatctcaagattttcagataaattttactgggagtcataaatcaatacaacaaaatcaatgttttgcaaacatccactaagcataaaggtatacaaattcccaacccagactgaaaaataattcacataagccacacattagtggaaacctacccatgggagataatacaacataatctaaataaaactttcagagacaaggcatgtggcttctggacagccacaaactccctgactctgctctagtgtttcggccatcaaaagaaagccaagtggcctcaggtctctgaaaaaccaaaaaagcaacctatggaagatggcgtggtatttgaggaatatttgaagtctgttgaaaaatgcatcctgtattttttttcaagataagactcccttgtaatgtcaggtaagtgaagagccctcagagacacatgcacacacaaagaaaaacaaaacgacatagaatgaatcccaccaaaatgtgttatgatggcagaattatgggtgatacaatcttctgtaatatatctttttattaaaaatagaaaaaaagcagacttacccttgattatctatagcctctgacccaagtggtttggaattggaaagcagcgtcactcgacttgaagccatcttggcatcaatggtggagtaggtggagatgagactctggaccagctcatgggtgagccccaccttgtcctatcaaggccaccaagaaagggcacgtgaggaaagcacaaagatcctggagagacactggtttcactcagtttctcaaaattatcttagacacatttcctgagatcttttcttaatgccacaaacaccagagaagaaaatccttataacaaagcttgaaatggatccccatctccattaaacttgtccaaagctcagtgagtatataacctgataacctaaacacctagctagaaaaacctcagttccagtgctacaacagtgctagcttttctaacatttttaaataaccctgcttttaacccaataaaattcaactacagaactaagaaataaatattggaaatccactttaaaataatgaggagaccactgtgattgagaaaaagaaaaagacaaacgagagctggaaagcacactgattttgtagaaacagaaataagccgtgcaggtgccacactggcagcagtgcccgcgctggggccacggatcaaggaggcatggaggacaggactcttctgcttggtacaatgaaaaaatggtattctttttattctacatattgacaatatgcatttgggcctttattataagtacaagagaaaaatcttcaataaataaaagctgagtacattactttttttgattaaaaaatagattaggaaagaataatgagagttcagagcaaagactcctgcctcactgatgcctgaaaaccgtggctgccaccaaggtcaacacagacagcgtctttgtcatacagcacaccctcaactccagaaacaggcacataaaccagctgctccttcttatttaaacagcacttcttttgttattcaggaagaacacaagggtctgggaggaaaccgatgtcactcatggcaaaatgttctacccctggaagacgggacccaaaaagccagcttcaactgacaagaagtcagtaagtatctactgttgactggggggttaaaaacgatccacagtccaagggcttaacccatgaccctaaagaagggcattgtgccacactggaacagtggccctctagctacaagaggtcagagaagagggattcggtaacacctttgcaggcctacacatagctggcttacttttaaaacctccagcaaggccatcttcccttgtttggtcatttttcatttttcctgagaaatgaagccatcccaagaatcctatgtgcaattctagtatgttctacaacaagagaatacctggcatgtgaatttggcttttatctttgaagtgtgctcctcttaaataaccataaagtgacacctgccggtcacatttgatgtttgtttggatatcctccgggtttgtcaaatcttccatcctagaaaaataaactcaatcatacagcagaaacgaatgccaaagttcctatacctcctttcatgtgtcaatgactcatcacactcttgtccactaagcacatcacttaggaactagaaaatgcagaaataaggaagcaccgttcaccatccagcagaggaaaaggggcaggcacacaactgtgtctctaggctgaaagtgacattcattccataagacaccagatgggagacgacgtctacctggggtcagggaagagtgaagaacatatgcagaaaatccgtttctggaagagggtgagcctgtgctctgggatttgtactgtggcttggattctggcaggtggaaaaggggtattccaggctgagaaaatcacagcacaaagaagagcacaaaggaaggaaactgaaggcacgcacgaaggactccagcacccgggcacgaaggcagcatcactgaaaaccgaggctgaacgtaggatggggccacatcctgtagccttaaatgcttccaagtcctcccattttcctaaacatctcataattaatttactcccaaaggcacagcatctttgagcaatgatataagtagacattttccatcaactgcacttctacccccactattcaaataggcacaaaataaatcctatcactgttctttttctagcctttttagctttgaaatacatggcccaggaagaaaaagtttacaatcactttttacctgtctgccaggatataagggtgaaaagtttgccatgagaggcctaaacttcataactgtaataaaatggcccagattgtggatttcttggttttgatattctccatgcaccattccagaaaggtagaacagtttggcaacctaaacattaaaggaaaattaaaaattaaatttcaattaaattctcgtcaatactgcaacaaaataaaagctctaaacaagaagcaatcctaagaagggagacttccagcaaagccactgtcctgaggcttccagagccttgctggattctttcaggacttattagaaccacacagaggcagactgctctgcaaccaagccggtgcatctgtctaagtatggtgaggagagggaggtgaggcctctgagcacagaaacggttctgtggccgatggaccacagcagtatggaaaggaaggggcagtgcctggtcctgtaactgggagaaacttctgatgtactctattaagtcccgactccaaaacacccagacattgcctggtgcagcaggtacggagacaaatgagatacaccaagaggcccagaataaccactctcttgagggacaccttccagagactgggaacacatacacaaagggaattcaggaggcaattcctagagagatgtttagtaatgtctcttcagtctttttgtttgtttgtttgtttgtttgtttgtttgagatggagtctcactctgtcacccaggctggagtgcagtggtgcactctcagctcactccaccctctgcctcccagctttgagcaattctcacgtctcagcctccctagtagctgggattacaggtgcatgccaccacacccgactaatttttgccttttgagtagagacagggtttggccatattgccctgagctcgaaactcctggcctcaagtgatccacctgactctgcctcccaaagtgctgggattacaggcatgagccactgtgcctggcctctttagtctggttttaaaggattatactgttagtgtctaacaattatttctcttcctacctggtaaacttctgtccagaacctgtgttttaatcgcttctttgtcttcttcagttgcttgttatgcttgaaggagtcgaggtgggtgagaactcccagaattttaggaaagccatgtgcttgacagatgtttagaaactcaaacatttccatttcaaacccaaagctggcatctataagcatcagtacctacaagcacaacacattatttctcgaagaaactaccaaaacagaccacctacactaggggttggcaactggcccacgggccaaatccagcccatcacctgtgtttgtaactaaagttttattggaacatagccacattaattcctttacatattgtctatggccgcctgtgcactacaactgcagagctaagtagctgcagaagatatgatccacaaagctgaaaatattcactatctggccctcgacagaaaagtcccactccagactaaatcaaatgactacacaggcatcacccagacagagaaaccaccaccctctgacttgctctaaaaggcaaccataagacaaggccactaggatataaacatccattttaagaattctaatgcatgagaagtaactcagaaaaggctgggtctaacctggcccttacctaagaaatcctaatttaaagaaatgaagttttctgtaatgtatttttaagccaaataacaggtctctgacatccaaagaatgggaagaaagtgataatcaatgaaatatattaaatacgtacagaaaaccaacctcttctttcaatctcctcacagaaaaaaaaaaaaaatctttttttgctgggaagtatacaatggaaacctctaacttgtatgttaatttgtataactcaattgctcagaaatatttgaaatagctaccagtttagaattaagtaaaaaaacagaaagattatgatgaatggtagtctataagaaaatataagcagataagaccaatttttttttttttttttttttttgagacagagtctcgctctgttgcccaggctggagtgcagtggcttgatctcggctcagcgcaagctccgccccccggattcatgccattcttctgcctcagcctcctgagtagctgggactacaggcacccaccaccacacccggctagttttttttgtatttttttagtagagacggggtttcacagtgttcaccaggatggtctcgatctcctgaccccgtgatctgcctgccttggcctccgaagtgctgggattacaggcgtgagccaccgcacctggccaagaccaatttttaaaatttaagacacttcaaagatgcaaaataatttcagaactgattcctggaaacttgtaattttaatactaaagatagttctgtttctatctttccatggataactaaaaataacacaaaatggaaacagaaatgcccatccttgattaaactaggaaacattcaaaacccaaaaccacagaatatatgaagttgggcttgtaggaaagcacagctgccactgcagaccaaggcagcaagcagagctctccagcaacactggaccagctcaaagaacaggtggaatatcctcacaccacatctgatgccagagtgccaagggacaagcagctggttgtagggtcaggaataaaagggagcaaacagtccctcagctgccaatctttgccatctaagccagtgtcactcccctaatccacacacgcacgtacacacccaaatccacgtactgtgtgtgcctctgctgtactcaggaggctttgacaacccagagcagagcaatcaacataagctagactaaataaattatggtgcatccacagaatggaatgttatattaaaaagaaggaggcagagctacagtacttactgattatacaccttcaagatatattacatgaaaaaagcaaagcatagaacagtgtataaaataagctaccgtttgtgtttttaaagggtggcatgtgtgtttatatgtatctggaaggatatacatatacatatacatatatataaaggtctgcagggacctgagagaccagaggttacagcaaggaaagagaaaatgcgcattgtgtgtaccgtgcattacagttagagtgctttaccaaatgtgtgtgctccttttgaaaatcttaagatttacataggcatctctctcaatgatggttaagaggctgggaaggggagcagggagggagggacaaagagggaaaggttaacaggtacaaaaacacagttagatagaataaattctagtgtccaacagcacaatagggtgactataatttattatataattcagaataactaaaagaatgaaattaaaatgttcctaacacaaataaatgataaatgtttgaagtgacggatctctgaattaccctgatttgatcatcacacattgtatgcttctatcaaaatactacatgtaccccataaatatgtacaactattatgtatccataataactaaaactaaaaaaatgtaaatgcatctcttaatatgtatgtgtttaaaattagaaacttgctacattttaaataaaagagaaacaaatgacttctatgaactattcaatcatttcaagtatacaagtttagtaatctttacacaactttacattaattacacttatttttactaatagtagcattacatgttcaaaatttgaatgttatttagttttctgacattacaatggcacaactttaaaatctgtattactttttcctttatattttaggagtcttcctaggccaaagtataaaatctgtagctctagcaaaaactaaataaaaatgaaaaaaacaaggtatctgtcaccctacacctcctaatcaatatggcttatttttttgctaatttttttttttttttgagacagaatttcactcttgttgcccaggctagagtgcaatggcacgatctcgcctcaccgcaacctccatctcctgggttgaagcgattctcctgcctcagcctcctaagtaactgggattacaggcatgcaccacctcacccgtctaattttgtatttttagtagagacggggtttctgcatgttggtcaggctggtctcgaactcccgacctcaggtgattcacccacttcggtctcccaaagtgctgggattacaggcatgagccactgtgtctggcctttttttctttttttcttttttttgctaatgtaaaagatcatagaatatcagagatagtgaacattatcatttccataaatgtacattttccacacgctgagtactatctaaattttctattgataaactctgaccacttcttcaggcaattcatgtacttactttagcattatcattaaggatgaaggttctagaaccatcaggaacaagggtcccatcttcacacaagttacttaactgctgggaggctctatttcatcttatgtaaactatagataatacctactcacctcaagggtgtatcaagggtttatgtaagctaaatttgtagaaagcagttagcacagtgccaggaaggatccaagaagaaatggtacttactatgatatatttgtacatatatatgtatgaatgttaatgagctcttattagctgtgttcattaaaggttttctccatcctgtgatttgcttttagattttggaacacatttcattgtgcacattccatttgtattattaatatgacaacatttattactaatattattatcatcatcaattcaatcacatctactatatccctgataatgaccatgatccttttaataatcacaaaactctcttcccttcatcacggggtaaataacctaccacaatgctgtaagtctccatcagcaccccaggctgcccctgctcacttaccagatctgctactttagccagatcaatcatcatgttaatgtcacacccacattcaataatggtgagtctgcgctttttacctataagtgaaaagatgaaaattttactttaaaaagaccctgaaaaaactctaaccatcaactcttaattttcattttttaattgcatccagtaaaacaccacatacgtttacaggagtgtaccagaagttcatttttataggcaaaaactggtaaaataaattccatcctgtttttcttcctgtgttctaaatttagataatatcaaaagcctacccagatgaataaaagtgctcaaaacagggaaaattctgactagacaggctccacgataaccatgatcttgctgttcagctgcaggccaatgtcttcacctctatcaaaatttcctgtattcccactatcgctaaaaacatcctcaaacataatgcaacagaatatttacaatgataattatttctaaattaaggtaataagaaaatgatcaagaaaatattggctgggcacagtggctcatgcctgtagtcctggcaccttgggagaccagggcaggtggatcccttgagcccaggagttttgagatcagcctgggccacatggggaaatcccatctctacaaaaacataaaaattaaaaaaaaggaaaaaaaagaaaaattagccaggcatggtggcatacactactcaggaggctaaggtaggaggattgcttgagcctgggaggttgaggctgcagtgagctgtaatcacaccactgcattccagcctgtgccacagagcaagactctgtctcaaaaaaaggaaaataaaatatggatgcgccaaagataaagaaaagcctcaatccaactatattactgcaataataagagatttcagagtgtacattgccattctaccactggacgtttgtttcatcttccctcaaacttggaaaggtcaccatctcccaaagcagacaaattctcataggaaaaagagaaaacgcgcacttccaccagcatgtggcttcataagggcaagcatgtgcacctggcacataggaggtacgtgctgtctgttaaatggtgtgttcgcagtgaccaggcctgtcaggcccttccaaggaacatgcttggcaaagccatagagcagtcaggataaggtatgtatcacatccttatctctgggaacttatccttttatgaagttatagctaacttagtaaaagtaagagagaggtaacatgatatgacaatatttaacatgttccactcaagaaaacaacaaacacacgcatgtccctcagatgacaacagccacgccaagtctgtgtctgtggcaccatctcctacctgacacgatcgtcacagggcctctgatctcggtgaacttctgccaggtgaagttccgaatgaggcattatatcaaagtgctctttccaactttggaggccccgtcaccactaccggtattggtggcggctctagtggagttccatcaaccactggaatatgatgcttttgtgtcttcaaatccagagtcctatttatttaaaaaagaaaaaaaaagtaaactcacttttaaaatagagtaaaaggtatcaaccttataagtagacttttttttagtataattacagatatgagtactttagtatattttatagagagtacaacagacaatataaaaatataagtaacttgtcaattattaacttctgacccctatccaaatcaattgctgttcaataaagatgtaacaagatgacttcaatagtatagagttgaaaattaaacacaccttaaatctgactgctttatgagtgatttttatagttttttaaaaaccaaaaggtaaatactgaggcagtgcatcataacagataagagcagaggctctggagttaaatttggctctccgacttactggttgtatgattggaggtaacttgttttcttgacctcagttttcttgtccataaaatgagggcaagaatgattcctactctggtaaggctgctggaaggatttagttgaataacgtttaaagtacactgctaagaatatcataaggactcactaaataaagctatgttagtattacatattgtaatttttgtattttatattacaactttgtaaaacatatccagagggaaaaagcacacttatcaccatagaaacagtttaaagtttaggaagaatcaaattctataaattcttgtatcttgggcaagaaacgccaaccagtgtgcagatgctggaggcaaggcagcttctatggcaagtcttctcacgttttagtaaaagccacacagcatgcatctccatgtcctttggagctggactagacttgtgaatccaaatgtcacctgtgagaggctcctaactatttaaaaagattcaatggaagaaccatcagactgtagctaaacacacctgtgaaaggatcgagacatccacacagcagactgaactgcaaaagcattggcatttctcttctgggcattttcttagtctcctagctggagatcctgcagatgccacttctttttctttgcagctttgggtccaccgtttttctttctgtgtttcttctggtccttagtctccatagtggctatttaccaataacaagtaactctaacctacaaggaagaaggttggggtaaggaggtgggagaagcattttacaatccaggcaatacccagggaaaaacattaaatttcatttatttctttatgaagacatgatgtatttgttcactgaacaagggtagaaactgcttaaccatccccaatttcatttctctctgttatgctataaattagatgagttacctctgctaaggttacattctatggttaagttactttttattcatctcaagtgtcaacatcaccagtacctatttctgcaaggatggaaatattctatatctgtacttttcagccatttagccattagccacatgtggttacttaaaatgtacttcagagaaactgaaaaaatgaattcttaattaatttcattctaactctaaatagtcacatgtggctaccatactggacagctcagacctagacatcgactggactaacgaagtggtttcctaacttaaaccagaacttaaatttcaataaaaaatttaaaacgtttttatgaacttccaataggatcgcagtattacttttagtacctgttgactctaaaacttctaaattacagctcatctacatacatttgaaaaatagcaatatctgtatgtgtgagatatgactggttttagatgatgcctggagaccccatggacttacagagacccttccagtgatttctgaggtacctgggaatctgtggccaataaattggtagtcactgaatctgtgagtttttttggaatatcgggctgcataaaatctgacagcttgattgagaaaaagcggggcagggtaccatttcattcagttaaggtcctgtattcattccgtttaataaatgtttgtgtctgtctatgatgtgctagccactgtgccagaaaatggatatagctatggtctgattggcagaggaaatccaaactagtatcttccgtgccatgcaataagggctacattgcaaggctgcagagggtgctactggagcacagaagtgagtcagaggcttctcacagacacacacacgagcggaaacagaaagtctttatatatcaccatatgtcaaggaacactggccgggagttaggagagctgggcactaggaacgctttgaaactgaatagctgtgtgatttcagaggttatattgcttctctactatattttactgccgaacttgtactgtttctctcccttttcttcttggtgggaaaagcacaatttggggtcaacagattcggctcaggtctaagtcgcctgccgggaccacgtcgccaggaaacgacgtctccccgacaccttccctcccagtccgggctctctgcagggattcatcccgtcactctcccaacgacccccgggcacacctcaggcagatgcgaaatatgccgctcctcgggagcaaagatgacccggaggaccgggggaggaccttcccatgcgcacgactcgcgatcttcccagtgccccagagccacggacccaaccgccgcctaccccagcccgcggcaccaaacctgttcacaactgcgactccttaggtccgcttggacaccgccgga

SEQ ID NO: 2213 - DNA, 17943 bp, Homo sapiens; identical to SEQ ID NO: 2212

SEQ ID NO: 2214 - DNA, 4469 bp, Homo sapiens
ttttattgagactggggaagggccgtggtagcaggtgcactcactgtccaagtttgtccagactttctgctgcatgggtgatggcatttgtgactgtgttggtcactgtctcggtgatttccttcatctttttgtcccctgactcctgggctttctttatggcttcagcaatggctgttggaaagaggaagaatgtcctagtgatccacctgctgaacttgtgtccccttgagtggcctgtgggatgtggccatcttaatggattagtctctggagtggcccgatgggaccaagggcagcaggattactgcagaatgaatttgaatttggttttaatttccccaacaacttgcatttcttcaactgtgagtgagactgagcatctactcatgggtacattgcctgcttatccttttttctggaaaatgcctgcttatgtcttttgaccatttttatattgggttgttatattggattatcatttttatgacaaatatttttcatcagtgtataatttttcttttggcttggtttatagtgtttttttttttggctatagaaaatttcagttttggattgtcaaatttacttaatatttcctttatggcgctgatttttttgtcatagttctaaagattctcccctctccaagattaggccaaagtctctgatgttattactatgtctaaatgtttacgatgtcttccccctcaaaactcatatgctgaaatcctcagtcttaatgtaatgatattaaggggtggggcctttgggaggttgaaattagcacccacataaaagagaccacggagagctagctccttccaccatgtgaggacagagctgggcccatccatgaaccagaaagactccctcaccagatgccaaatgtgccagtgccttccttgatcttggacttcccatcctccaggagtgtgagaaataaatttctgttgtttctaagtcacccagtttatggtttgtttttgtttttgagacagagtcttgctctgtcacccaggctggagtgcagtggtgcaatctcagctcactgcaacctccgcctcccaggttcaagggagtctcctgcctcagactcctgagtagctgggattacaggcatgtgccaccatgcccagctggtctttgtatttttagtagcaatggggttttaccatattggtcaggctggtctcgaactcctgacctcaggtggcccacccgccttggcttcccgaagggctaggattacaggcgtgagccactgcacctggcctatggtattttataagagcagcctgagctaagatgtttatctcctagtaagttaataaattcatttatgtaaatgtaagtccttcatctacctggaatctattttgttgaaaaggaatgagatatacacatgctttgtacatagtactactcatagctcacacacatcaatttaacatttaacatagaattttacatgttaaatttttttttttttttttttttttttttttttttttgagacagagtatcacactgtcgcccaggctggagtgcagtgtcgcgatctcggctcactgcaagctccaccttccaggttcacgccattctcctgcctcagcctcccgagtagctaggactacaggtgcccgccaccgtgcccagctaattttttgtatttttagtagagatgcggtttcaccgtggtctggatctcctgacctcatgatccgcccacctcagcctcccaaagtgctgggattacaggcgtgagccaccgcccccagcaattatttttttctttttttttgagaccgagtcttgctctgtagcccaggctggagtgcagtggcatgatctaggctcactgcaagctctgcctcccaggtacacaccattctcctgcctcagcctcccaagtagctgggactataggcacccaccaccatgcccggctaatttttatgtatttttagtagagacggggtttcaccgtgttagccaggatggtctcgatctcctgacctcatgatccgccctcctcagcctcccaaagtgctgggattacaggcatgagccaccgcaccctgccatgttaaatgttttgtcccagtgtgctgtcacatagtcttgtgtgactttgtcttcttattccacagagagaaccatctagacagtgtcctaacgcagtacagtctgtggcctctgatgagcatagataactgccccagccaagaggctctgaaaggctgcaacattaggggcagagtttgacctggttagtcaaagaacaggttggcccagcacctagcttcccttcctccctccctccttccctgcccgacctcagccggctgtacctttctctccagtctccttggcatgtcccaccacctccttcaccacttcctccacggcatgaactgaacagaggagacaagtccagggtgagggctcagagcaggccggctgcccccgagtccagggtgagggttcagagcagagccgctgccctcccagtccagggtgagggctcagagcaggcccactgccctcccagtccagggtgagggctcagggctggcttatcctcacaacagacctatacatccctgggcatcctagatggggctctggggtgccacccccagccaggacagactgactcatgagaaggaccttcccccacagctggcttcatttggagacgccagggccttggctgctgggagacgagctcaatgagccccatgagggcatgggtccctgaagccccttggccctgcccggcctggaatggcaatgagcaggcagtcttgccagctgagacatgaagcccaggctgggcctgtgtgccaggtcacacccctctcaggatgtgctagcgcctgcctcaggttggtttccaaagcctcatccactaagaccaggtctctcaaagcaattcctccaacaaaacggaattctctgcctacttcagagttttttaaagtgtgggtggtagcgtgctagaactgaaggatttcagagtcagaagaaatggttcttattctaactctaccttccacctcttggttccctcatctttagaatgggaatctgttgggatgatgagacccaacaccaggtcacgggggcggcaagtccagcggagtcaaaggaatgacaaagagacagttcgagagagaaaatgggagcagggcgctatcgcgagtgtggaggctgcgaaggccccgagttctgggagcccacgctatttattggtgatctaacaaagaaacaggtggtgaggatgtggaggttgaaaggaaacagtgtatcaagtgaatgagaaacatatggctacttgagagaatggcagtgctagaagcaaggagccagcaagtctagcaagccctgcctcagcttttctcccaacgctgagcttttctcccaacaggaatcataaaaaactcagaggctagtgaaaggttaaagcaggtggtccacaccagctgcagagtcaaaaacaaaatacgcatctgctgccatttagaaagaggacacaaactcaggcaagactttttcacacgatgacccatgagtggggcctggctgggcctccccacacatacctgctgacctctgaatacaacatacacttcgggaccaggtgcagtggttcacgcctgtaatcccagcactttgggaggccaagaggaatggatcacttgaggtcaggagtttgagaccagcctggccaaaatggcgaaaccccgtctctgctaaaaatacaaaaattagtcgggcgtggtggtgggtgcctgtaatcccagctactcaggaggctgaggcatgagaatcactttgaacccaggaggcaaaggttacagtgagccgagatcgcaccactacactccagcctgggtgccagagcaagactccatttcaaatacaaatacaaataaaaataaacatgctttaggggacttggatgaaattgaaaatgcccttttagactttgaacagacttggtgacttgttaagaaatctttgaagctttaaagttatggtaaaaataaaaatccatcttccttttcctgcataggttattcagaataggctgttttgacaagaaaggctccccagatttccagagggaagggtccaagctgccagtgttcacccagcaccaggactcatgccctgcccccaggagacctccccaggtctgcacccctcaactccgtgctgacttggtagagcaggagaccagggttcctgaggggccaaggcctccccgcaggtcctcgcctgcctacgtagatccgcctcccacagacccagtctgccccagatccccccagcccaggtagaaaggagccctgggtcctcactggctccctcggtggccttctcggtgcggtgggccaggccctcggcagccagcttccccaggcctcccagcatcgtgtggcagcagacagtggcgaact

SEQ ID NO: 2215 - DNA, 21784 bp, Homo sapiens
ggccaggagggcctgagactaacacatccaccttggcaaaaggacataaaatatgtcttatggtcagaaaaatcaacattttgtgtatttacttagtttacgaaaagtactgaaaatgctattactagctgaatttgtgatttccttttgaaattctgagttatccttatttttcccattttgtttttgcaccaaggagactgcagtcaaataaaacagatactacacgcactcgtcggggcagccgtactgcagaagcacgttgatgcactcctggctggaggcctgccgggcgtaggtcagcgctgtgttcccgtgggcatctcgggccatgacgtccaccccgtcaggagctgctccaggaccacattccccttgcggcaggccagatggagtgccgtgcagccgtctccctccccacaggtctcgttcacctcctcacgggagccatgtgccagcagcaggatggctgtctgcaggtcctcatcagtggtggcccgcagcagctgctggcccagggacagctcagtgcagggtagtggggccagaaagagcttctcctcatatttggaacggatccaccattccttctcttccctcgtggactttattgagggttttgtctgcccctggctgctcccttcccagatgctgttggctagctcattgccaatagatgacataaccttcctgagctcaactggccagtcatccagctccagagatcgcacacgggaaaggcgggtgccaaaactgcggtggatacctgagcattcaatacacatgaggactcccaagttcaaactggcccacttaggattctgggtctcacagtccacacagtgggcgttcccacgcatgttttggatcgactgcagggccatggcctcactctggctggtcagctgggacttgcttttactgctcttgcatgactgcaggctggccaggatctggctctggatggcttggacccaggcatcccgctcctcatacgtcgtggcttcaaagtgccacgtttggccagtggcagacacaatcataaagttgttggtgcttttcttctttaggtgtttctttttattggcatgaggagaggggggcgggttgagcttggggctggtggtgctggagataccggggctgaagcatatggagtcacccagcccggtgtccatgtccttggataggccattgcttttagagctggagatgggtgcacaggctgatgtggctagggatggccactttcctgggactttgatggtagatgtccgaaggtcaatctcttttttatgaatattcttcatataatcacctaagcttgaataataggtgagcacgccattggaacacagggtgacgtatttctttttccatgtcttcagccattttccacttcgctttaagagcatgccctgtttaatggggatggctctgccgctcccgatggtgtcagcatgattctccggggctttcctctctttgtctgggtcactccctttctcagatgtaaacaggttggaccagcgcatggacagcttgcaaacgggggtgggtgtgttggcagtgggaggaacactgaactgagggtcctcctggctggtgctgggagtcggtggaatggaggaggaatagttatttaaactcccacctccatttcttttcttcataatgtgcacggtggaaacctgtgtggaacaggaggaggaatggcttcaaaaattgggtagtggcttgcaggatcctatagacagctcacaattaccttttaaaaagatacattttctgggccaggcatggtggctcacacctgtaatcacagcactttgggaggccaaggtgggtggatcacgaggtcaggagttcaagaccatcctggccaacatggtgaaaccctgtctttacaaaaaaaaaaaaaagaaaaaaaaattagctgggcatggtggcacatgcctgtaattccagttactcgggaggctgaggcaggagaattgcttgaacagggacctgggaggcagagcctgcagtgagccaagatcgcgcgattgcactccagcctgggctacagaaagagagtccatcaaaaaaaaaaaaaaaaaaaaaaaaaaaaagatacattttctgttgtttggatagtatatttactcacactagctcactaactaaacagagctgcagatcagttcttactccagcacattctttttacaacacttaagatgactaaatgcaacatgaaatggggaagatttaaaaaaagatggctttgacttcagcatgaaacagatacaagtgtacgatgaaaatacaacctcaataaaagtgccacttaccgcaaatgagtgtaactgttcatcaggtatgctcaaagatctatctgcatctctataaaataagaaagtgcattacttcaaaaactgttaatatcttagtataatatttgttgagtaaaatacttcctcctgtgtgctttggtgtttactttaccaaagcagtttttacaaattcttctcctggatcctgacttgcagagggtttcctgacttcttctttctcagcacatcatggtctgtaccgtgaagccttttatatgataaccagtcagaaatgcccatgagtattgactctccctaacaggccatggcaataaaccaaacatattttcactcttctaaccacacattgaaacacaagaatgttctacaaagcagtagtagtaaactttaataaatgtaaatgtgattcagatttcctagcttcctttctctttagttctctgtagtatactctcatgatgtttttatgtattttctgttgtctgaatgacaaactcatctacctttttaagaggccagtctttgaggaactttaaactttgtaaaactaatgcattgtgcctgtgtataaaccagtggttctccaaatgtgctctgtggacctctcgggatcccgaagaccccttccagaaggcctaagaggtcataactgttctttttttttttttttttttttttttttgagaccaagttttactcttgttgcccaggctggagtgcaatggtgcgatctcggctcatggcaaccttcgcctcccaggttcaagtgattctcctaccccagcctcccaagtagcagggattacaggcacctgccaccactcctggctaagttttgtatttttagtagagatgtggtttcaccatgttggccaggctggtcttgaactcctaacctcaggcgatccacttgcctcggcctcccaaagtgctgggattacaggcctgagccactgtgcctggccaacactgttctgaatcatactaattaaacctgagaaagctgatgaaaaattttaaaaatttgtgaaagtaatacaaagtcattgcctgctttttcgttgacacttgccatgattgtataaaagcaaaagtaggtacaatggctggtttctcagcataaatcaaggcagtggtaccaattacattagtagtcattctattcttcactgtcccctacaggtaaaaaacatagcctgaatttcttaagaacgtctttgatgaagcaataaaaattaatgttgttaaatcttgacatgtctctaatattctgaataagtggaaagttaatgagaagtgctttttttttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcctgagctccttcaggagttcgggaccagcctaggcaacataacgaaaccgtgtctctatcaaacatataagaaaattagcctggcgtggtgccacacatctgtggtcccagctacacaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgaaaaacttgttccttctactgtaggcttggcagcttttcaatacttaaaggcctgttaaagtaagattggtggttaaactaaaagtgatttttgacacaataaaacataaaccaatatattccaagtaactaatgcatgatattataaatgcaagtatggagcaaaagatccatttactgtgcaagaaagatcaatgagtactgatggaataaatttattaatatgtaaaatgccaccgtaactaatttaagaaaccaccacttgtgaagttttgatttagtgttttaacaaatacccacaactgtctgaaaactttaaaaatacaccttctaccaactacatatttgcatgaggttaggtcatcttattgcttctttttctctttttttgagacagagtctctctctgtcacccaggctggggtgcaatggcaagatctcggctcactgcaacctccacctcccaggctcaagtgattctcctgcctcagcctcccaagtaactgggactacaggcatgcaccaccacgcccagccattttttgtactttcagtagaggcgggttttaccatgttggtcgggctggtctcaaactcctgacctcaagtgatccacccaccttggcctcccaaaatgctgggattacaggtgtgaaccactgcgccccaccagcttattgctttttttgtttgtttgtttagacagagtcttgctctgtcacccaggctgcagtgcaatggcacgatctcagctctctgcaacctccgcctcccaagttcaagcggttctcctgcctcagcctccagaatacgtgggactacaggtgcgtgccaccatgcccagctaagtttttgtatttttagtagagacggggtttcgccgtgttagccaggatggtctcgatctcctgaccttgtgatccgcccgcctcagcctcccaaagtgctgggattacaggcgtgagccactgtgcccagcctcatattgcttctttgaagcaaattgcaaagaaagctctagagaatccatttgtctcctattaagctcaacatgagagactttaaataatataaacaaatgacacactttttactcaactttttgttgtagaaaagttttttttcaatgaaaaacttctgttaacaatactgttctcaaggaatattttctgtttttataaactgggtcatgggttactactgacatctagttggtagaggccatgaatactgctaaactctctgcaatgcacaagacagtcctcacaacaaagcattatctagcccataatatcaacagtggtaaggctgtgaaatctaaactaaaaatagattttgaaaaaatttcaattgtataattctaccacactaaatatcaatataatcaatataaacatatactctttgagattctcaatcatttaagaattatgagagtcttaaggaacaaagaaaatacaaataatttgcttcgatattttagtaggcacaatacagcttatgatgtctagagctgtgacctaacactgagcttgatatcttgcaaagtaattagctagaataacaagacaggtttctaaaaagctcacctttgtgtgatatgatgaggtatctccaaggtcacactgtggaaggaaaacaaattcataacaatagatgttatcatttgttaggcctgcagacattttttaaaaggggggcagaggaaactctcctagcggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttcccttttatatgcttttctaccgatgaaacctttcgtcccatgcgatttattttatgtatttatttattttttgacccagagtctgtctctcttgctcagactggactgcagtggtgccatcttgactcctcacaacctccaccacccaggttcaagcgattctcacgcctcagcctcccaagaagctgggactacaagtttgcgccactatgcccagataattttttttttgggggggtggtgggtggagtttcgctcttgttgcccaggctggagtgcaatggtgtgatctcggctcaccacaacctctgcctcccgggttcaagagattctcctgcctcagcctcccaagtggctgggattacaggcatgtaccaccacacccagctaattttgtagagtgaggctcaaaacaactgagggaaggtaaatctcaattctactaataggtctacacaatattagcactttttaaaaagcctgtaacattagcatgtgagatggatatgtctatagtgcttcaagtagttttcatctctgaaataattttaaaatcacagaatttaaagttacatgctggaaaggaccaatgaccttatgtgacatttaattcaacacttgttttacagatcagggaaacaaaccttaaaactgacttgcccaaggtcccaccaaataggagcagtttctcgtcctaaactcaaattaagcagtggctctcaaactttgctgcacattaaaatcgcctgagaagctttaatatctgcctcatcttccacatgagacattttaatttaattagtattgggtatggctttgggcatcaaggttcttggtaaacgtttcccaggtgatttcaatcagcagcaaagtttggaatgattgagctggggtgaaaatcagaatcttctgggatgcttttcttcacagaaagatgcctcacatccatcccgattttcctaaaaggcttctcagtgcctagagatagagggaaagtggagatgggaagatacatgtatttgcagacttgcattttgaaaaaaaccttgcataagtgatctcagcgagttccacctatcccactgacaacagtgcactactgattcatgataaaacatttttcaatatatcttcttgaagccaatttgccctattaatttgttcaataactttatttcaccaatagtgaatacaccaaatgattatttctcaaacttgctggtggcaaattaaaacttactatactctcaaaagtagacttctaaaaagtagaataatgaggaaaaaagcacaaaattagtttcagcaaaattaatcttcaaagctgcttttgaattatatgctaacttatcaaaatctttggaactcagaagaagccagggactctagtcaaagtaatttttgtgtatgtgtgctcaaagatttaagagacttggctgactacagacatttagtgattactcaataggtcccaaagctcaggacttgagacagagtttgagttcagtttttgtttgaaacacaatttcctctcaactattgttaaaagggagggaggaaagtgacattattatgagtgtaaacttgccacttttaattgaagtaaaagttattgacaattgaattagctaaaaaggctagtgcatttgaaacaaaattgtttataagctagttatgtttacagaatgaaaagttaaattaaagataaagacattaatattctaaattagcactttccaaactgtgttctaaaaatcaagactaataacccaaggagatgagaataatgtacactggacggcccctgtggagctggtggtggtgttggttgttgttccttttaaaataaacttcatctcagggtgctctcaaagcgcatctttgtggcccacgaggtgctcatgcacaatgggagaaattcaaatgcagatacactgtggtgccagaagaagaaaagctgttccttcttccaaggataatgtccaaagtagtgcacactgatttgggcctatgatgcattgaaaaactaagtttccacaaaaaacattcaataaagggaacctatccttctcactgtgttcaacattgtctaaaggcataaagacatcaaaaagacacactgtttctgggtttgcttctttgctaactgatttttccttccaccacgacgtctaagattaaaagagaaactgatacttaatattcagaatctgaatatcaatatatggttgactccaatttcttaagctgattgctgaagaggacaaccaaatggctgaaataatttccgaataaaggaatctgtccctcggcagcatagttgtactcacgatattattgtcattgtaagataatgctggatggctgtgctgtcatcaaggaatattgtcgaacacgagctgtattgttgactgaaacgctcagtagatacctgaaggggaagggaagtgtaagtcaaacttatcaaagtgtatttttttctcagttaaaatgtcaaatgacaaagcactaagatatgtcttacactccatgaactgcctgagtgtggtatcatgtgcaatctatagaaaacccattggaggctctcaacttccagagatgatgtttaagatatgggttataaaatgctgcccttaatatggtacctgtcatcaaacctaacaaggattttatgaattaccgttaaaaataatgggaaaagtcggcttcgccgggcgcggtggctcacacctgtaatcctagcactttgggaggtggaggcgggcagatcacgaggtcaagagatcgagaccatcctggctaacatggtgaaaccccgtctctactaaaaatacaaaaaattagccgggcgtggtagcaggcccctgtagtcccagctactcgagaggctgaaacaggagaatggggcgaacccaggaggcagagcttgcagtgagccgagttcgcgccactgcactccaggccgggagacaaagtgagactccgtctcaaaaaaaaaaaaaaaaaaagaaagaaaagtttaaaatgagatttcatatttttttctacagcaataaaaagcagccaagaatttctattaattaattaattaattaatttatttatttatttatttatttttgagacggagtctcgctctgtagcccaggctggagtgcagtggcgcgatctcggctcactgcaagctccgcctcccgggttcacgccattctcctgactcagcctcctgagtagctgggactacaggcgcccgccaccatgcccggctaactttttgtatttttagtagagacggggtttcaccgtgttagccaggatggtctcgatctcctcacctcgtgatctgcctgcctcagcctcccaaagtactgggattacaggcgtgagccacggcgcccagtccttctattatttatttactacgataaaatgtagtgtattaaataatcctgctacaagagcactttattgcagtgaatacaagactaatgcatttactaaattactaatcctaaacgtattatttcaggtgatattgttacaaaagaagtgtttcagattcaggggctctgtgtgccagggctgctaggccaccaacaagtgaggaagccataggtttctctagtcctattttcttatgtggaggataaaaagagtatcacttaaatattctctcacaccctaaaaacaaatgacaacttaaaaaatctaactttcacttcatgtttaaataagactgccaagacatgactcaaatgagactcttggagaatactttgcattcacttcaaaacttgatcaattgcattctataaatcatctgacctgcacctagccattttcctgctctacccctgctctctgcctagaatactgcttttctctttccttgcttcagcaagctcgactccatctaccctcttggatctctttgtcggcagccacaccaaaaaatgtatttttatacactaattagttgaattcaccactgcttacaagatgctaattcctgcagagtattcccctcatgagaaagtatgcctctccataagagtaagggagggcccttactcttcctacctccagctgctgagcatagaattttgagtaaatccaaaacttcgacaagtgtttgacaattcagtcatcatttggaaggtaagtcttactacatttaattacagcaaaaacactactaacagtttactctttataggtattatttaaggtagtcacaaaatagaaacaaataatctaacgtcagtcagcataaatgagagtatgaaattttacaatatttaacaagaaatggaaggggttacttagtagttttaaggtttaatgacaaaaactagaaaataatcgtacctagtaatttagtaagtcaaaaccaaagccttaccatcaaaggtgcagtacccattggatgcggatgcccacgcactgacttctgctgtacctgctgcctctcattttaacccattaaaaatactaaagttgttttccttgtagacatctttcacctccttggttaggtctattccgaagtactttattttattttagtttatttttgcagctatcagaaaaggggttgagttcttggtttgattctaagcttggtcgcttctggggtataacagagctactgatttgtgtacattaattttgtctcctgaaactttgctgaattcatttatcggttctaggagctttttggaggagtctttagggtttcctaggtatatgatcatatcatcatcaaacagcaacagtttgacttcctctttactgatctgcatgccttttattgttttctcttgtgtgattgctctggctaggccttccagtagtatgttgaatacaagtggtgagagtgggcatccttgtcttgttccagttctcggggggaatgctttcaacttttccccctttcagtattatgttgttgtgggtttgtcatagatggcttttattacattgagctatgacccttgtatgctgattttgctgagggttttaatcataaaaggatgctgcattttgtcaaatgctttttctgcatctgttaagatgatcatgtgattttttgtttttaattctgtttatgtggtgtatcacatttattgacttgtgtatgttaatccatccccgcatccctggtatgaaacccatttgatcatggtggattatcttttttttattttttgagatggagtcttgctctgttgcccaggctggagtatgcaatgcggtgatcttggctcactgcaacctctgcctccgaggttcaagcgattctcctgcctcagccacccgagtagatgggataacaggtgagcgccaccacgcccggctaacttttgtatttttagtagagatggggtttcaccatgttggccaggctggtctcgaactcctgacctcatgatccgtccgcctcagcctcccaaagtgctgggattacaggtgtgagccaccgtgcctggcccgattatctttttgatatgccgttgggaactacaaaacattgctgaatgaagtcatggacacagacaaatggaaagacacccatgctcatgaatgggtagaatgaatattgtgaaaatgaccatactgccaaaagcaatctacaaattcaatgcaactcccatcaaaataccaccatccttcttcacagaactagaaaaaacagtcttgaaatttatatggaccaaacaagaaccggcacagccaaaacaaaactaagcaaaaacaacaaatctggaggcatgacattacctgatttcaaactatactataaggccatagtcgccaaaatagcacggtactgatataaaaataggcacatacaccaatggaatagaatagagaacccagaaataaactcaaatacctatagccaactgattttcaacaaagccacctaaaacataaagtgaagaaagtaaaccctattcaacaaatggtgctgggataattggcaagccacatgcgggagaatgaaactggatcctcaactctcaccttacacaaaaatcaactcaagatggatcaaggacataaatctatgacctgaaaccataaaagttctagaagataacattggaaaaacccgtctagacactggcttgggcaaagacttcatgaccaagaacacaaaagcaaatgcaacagaaacaaataggtgagacttaactaaagagcttctgcacaggaaaaggaacaatcaacagagtatacagacaaccacagagtgggaggaaatcttcgcagtctatacatctgacaaagggctattatccagaatctatgaggaactcaaacaaattacaattacaaaaatatggaaccagcccaaatgcccatcagtcaatgagcggataaagaaactgtgatatacatacatattatatatatatatatgaggaataccacctcagccataataaggaataaattcatggcattcccagcaacctggatggaagtaagactattattctaagtgaaataactcagcatggaaaaccaaatatcatgttctctttcctacgtgggagctaagctatgaggatgcaaagccataagaatgatacaatggactttggggacttgggggaaaggctgggaggagggtgagggataaaagactacaaattgggttcagcggatactgctcaggtgatgggtgcacctaaatctcacaaatcatcactaaagaacttagtcatgtcaccaaatgccacctgttcccccagaaacctatggaaataataaataaataaataaagtacagcatttttctcagcaaacataaaataaaacaaagactaaagttcatatttttcactctccttttgggcaggacaaattttagataggtttttaaagaattagtaacttttttcctttttccgagacagggtctccctttgttgcccaggctggagtgcagtggtgcaattatagttaactgcagcctcaaactcctgagctcaggtgatcctctgcctcagcctcctgagtaggtaatatgaaaggcgcatgccacgaggcctggctaatttgttatttaacctttttgtagacatgaggtcttgctatgttgaccaggctaaaaatgaacaaatcttaattaacttaaatatttctaacaccttgggcattcaggaaaacagctccatttatgttgtgaagtaatgggaagcatatggcagtggataaactttgaatgaaaatattaaacaaggccttaggagaaaagtgtaatatgcttattatagatacattaatttaaaaaattctctggcttaatatcattatactcaaattagactttgatttaaacataggtcctaaatttggattaaatataatagattgaccacaaatttatttcgtctccctctggaagcctcattagtcataaaataaaggttacacccatgaccagcacagaaggttgacagagataatttttagtaaatgctgagacataaaaagtagacaaaggagtggtaaataacacagaaacacaactttgctgactacagaaagtgactggaacagaagcgagccagtttgtcttgcagaactaaaggcaggttgtgaacttacaggcaaatggcactttggaaagtagggtaaaatgtaaaaaaaaaaagccagcaaggtcagttgcaaatctctaactagagcccaaagtctacctgtccttccatctgacaagaaacttagatgtgtgttctctggatatatcaaacctgagaatttctggctcagagatactatggcttaaacctgagatataaagaaaactgtacaccaaaaatggaactccaactttctttgctaactctgcttttcctttccaggcctgcttttactttccaggcagaaaattgggagatccttctcagaagaaactgaaatgtcttcagtaaagatccccagataatacactgaggtctcccaaatgaaaagctagtcaggcttctaaggcctcacactgagtgctatcagttaacagaaatcctgcttccaaataaagcaggccagggaccaccacacattggagggaagcctccaagaaaagagatcaaaacaatagaaaaaaggaattgataggaccagtcaaaatcaggagcaaaactttaaaaaaaaaatcttaaaacactctcaaaaaatataaaattcaatagaaatagtagaggataaagtcacagaatatcccagaactagaataaaaagacaaactgaaaaaaatagaaggggaaaaattaaaaatcaatgcaggtgtactggtctaagcagcctagcatctgaagaacaagactatcagtaaaaaagtaacagagaaaataaaaaaaaaattctcaagaagagatagtctgcaggtttagtagcctcaataaaatgaaaagatccccaacaagctgttataaaatttcagaaccttagagagagagattctaaaaagcttccgcagataactaaaacctggttgtaaataacatatcacacactggcaatagattcaagaacaacactgtaataagagcacaactgcaaaatgtcttcagaaccatacaatttagattcaacctagaggtgtactctctatcaaagaggagggattttaacatctccacccaggaaaatgtgttcaagtacaactagagacgataacaggacagaaggaaacacagaatctaggactcaggagatcccacacaagacagcagttacgtgagatcccaaaagactttaaggagttagcccagaaaagcagacattgagcatatctagggaaacccacgctatattgaactaggatgacaaaaggccaaagaaagttgccccccacacacacataaaaaggaacagatgtgtttttgcagatggaaaatatctttgaaaggcatgtgataaatgctacaatacttgggggaaaaacagctattagaaaataggcaaatgaatatagtcagaaaattagcttcatgctaaaaaataatggatgtgaaagcaaacagagcacccagaggctacttaatgatatttggatagataaactaacataggctaggaaaaaagaagatccaggagaattgcagaagtgctcagatttcagaactgtttcagagacaggatgaaggacatggaatgcagaggcacagtgaaaacaccatatgacttagcagtgaataatatttgcagagtcataatcatgtaaatattactgatttaattaaaaagtgtgctacaattggaagaaacacagggagaaacataagatcatggtgtagcgaggaagatacgcttttacccgctgtgatagaaagtcaatagacagtgctggcaattaacttaactattctatttttgttctttcattaaaaataagattaaatatttaaggcacttttttttttttttttttttttgagacagagtttcgctctgtcgcccaggctggagtgcaatggcacgatcttggctcactgcaacctccgcctcctgggttcaagtgattcttctgcctcagcctcctgactagctgagattacaggcatgcaccagcacgcccggctacttttgtatttttagtagatacagaatttcaccatgttggtcagggttgtctcaaactcctgacctcagatgatcagcctgccttggcctcctaaagtgctgtgattacagacgttagccaccatgcccagccttaaggcagatcttttgaaccagactattgaaatttaacttaaatgtcagaaatctttaaaaggtggacacgctaagctaaacacttttctggataaatttaatactcaggaaaatagaagagatttagaaaatccacaaaaagaggtccatgctaccaccaccaggtccacattgtaatttaaagaaatcaagagagacatccttttatgtcaaactatcaatttcttaactatttgagtgtttacttacatggtttgtacagttgcttcttcttatttctacaactaagaataaaaaaaaaaaaaactggtcacttctgatacaaataccataaaataaaagtagttgttaacatcttactgattactcctatgtaaaatgagacaaaattccatttaaaaaaataattttcaataatttataatttaaattatctggcatgattaatttcataagtcaaatctaaaaacttagtttttcatttagtttactttttgtttctattacatacaaatgaaagaatcctcatgtacaaaagaaaagggtaaaaaaattaggccagatgaaaaatttagctaataaaaagtttaactgttgcatatatgagccatgatccattagtattctctcattctgcatttacacatagcttactttaattatcagactctaagagctaacagctctaagaactacgtcctgaccagacacctatctctagatgcaacagaatccctgtaagcatcttgaaccacacttagtggttatctactaatatgtcactaaaaacaaatcaaaattaaaaaacggtctttacacaactggaaagtaacgtatcttaatttttttttttttgagatggagtctcactctgtcacctaggctcgagtgcagtggtgggatctcagctcactgcaacctctacctcccaggttcaaccaattcttcagccttagcctcctgactagctgggactacaggcacgtgccaccatgcctagctaatttttttttgtatttttagtagagacagagttacactgtgttagccaggatggtcttgatctcctaacctcgtgatccacccacctcagcctcccaaagagctgggattacaggtgtaagccacagagcctggcctaaattttgatgttaaaatgagtatacaaacctaattggacatggtgtctgaagctcaaaaaatcattttttttcctctaaaaagaggccagaataataaaagccccaagagggacttgggccatgctttgtttcctacactgcctctgcctttgatgctggaagggccttgtaggcaaaagttcctaccaccgaagagtgagggacatggaatagcttttcttttactgcttccatgctctctaggtgtgagaagcccatggctctggaaggaactgggaaatacaattctgatatgttttggatatgttgcccctccaagtctcatgttaacatgtgacccttaatgttggagacagggcctagtgggaggcatttgggtaatggcagtggattccttatgaatggcttggtcccatccccatggtaataagcaaattctcattatggtaatttaaaaggctgtggtactggccaggtgcggtggctgaagcctgtaatcccagcactttgggaggctgaagcgggtagatcacttgaggtcaggagtttcagaccagcctggctaacatggtgaaaccctgtctctaccaaaaatacagaaattagccaggtgttatggtgcccacctatagtcccaactactcgggaggctgaggcaggagaattgcttgaacctgggagatggaggttgtagtgagccaagattgtgccattgcactccagtctgggcaacagagtgagactccatttcaaaaaaaaaaaaaaaaaagagtgtggtaccttcccccttcccctctctctttcaccgtgtggaaccacctgcttcccctttgccttttatcatgattgtaagtttgctgaggccctcaccagaagcagatgttaaagccatgtttgtacagcctgaaaatctttgagccaattaaacctcttttttgttataaattacccagccttaggtatctctttatagtaatgtaaaaaatgaagacaaattctaaccagaaataactgactcaagatgggcaaagtctactcaaactataaaaacaaaggttacaaactcccgtgttttactgtgctgcattacttcgcacactattatagaaccctcacttgtattcttgctgtttaagtcaactggaaaacttggctgtgtatggcttgttggcaaataaatgaggatttaacataacattagggaaataagcaggagtagggcatgtttaaatttacatgacatcaaatgaaaaagttaataacctaaaacttttgagtagcatgaacttggatgtggtaaatgaatgtggtcagaggactgtgtaagaggaggcccaaatcacagattcaatccctgatgataaacaactatgttttttaatttgtttaaatgaaaaccaagctgaagcctaagttctatcattcatctttaaagtgtactttttggagcaagggaaaagggattataaataaagataaatccattaattataaataaagataaatccaagaattataaagagaaatccatgactcctccaacacatgacaaattaattgtgttgataaaaagatggcaaaatgtataaacaaaaaggttacacgttttcactaacatcataacaactaaaggaaagtatatcacatattaaaataagacaagtgaacatgtgaaaaggtgaaaaatttaaaccaatatgagtttttctaaatactttctataacctgatcaaacaagagcttttattctttctcttggcggaaaaaacaatgttgtctcaccatctgtttgagagttcctctggaatattgtgcttgcctctggattggcagaagagttaaactccaaagctatatgcatagaggaagaaaagaaaaagagatgcaatcattgataaaaatttatcaactcgtttattcggctgctgcatttaggctatttcactatctctactttgattcttatccattgaaatgaatgtatagacataagatagagccaggcaagatggcacatgcttgtagtcccagctactcaggaggctgagatgggaaaatcacttgaacccaggtcaggaagttgaggccagcatgagtaacacaatgacaccctcctttatttaaaaaaaaaaaaaaaaaaaaaaagaagaagaggtaaattttggctttgagttgtgtaaaatcaactttgcataaaataaatcaagatggcagtaagttttaaaagacagtctattttataggcaaaatataagatgtattctagagtttttaaaatttttaaaaagtaaattcatcatatctgtcacttccatttcattctgaggacacagaaccttagttctcttgagtagctgtcttccatagtcatgtgatatctctaagttttcatttcttcattagcaatacatagggagaacatacacaggccttatttgtattggaaagggccaagtgagacatacataaactgtgttgtaatcctaaagaatgacaataaagagccatttttgggctctcatccaacactacccatctactaactggtgtgtaacatccatcaggctttccaaacatcaccaagcagagtataagtttatacaagtacttacatgctttgtgtataaaggtacaatcaattaattcacacaatgcatttgtttattctaaagcaatccttaaatatcttgaaatgtgaagatagtacttccaagttacaaagtcacactcataatgagtcttaattatcctacctctttaaaaattaagagcccaaccaaagtttaaatagaagagctataagacatttcctctagagtaatgaaatctctggcatttaaatgaaaccaataagccaactggatttaatatgtttatgatgcaatgttttctattttgaaaatttcagtttttattcaagaaccatattattacccagaattacttttacttagattcatctctttgcaaaattttagaggcaaaccaactaattgttttctgttttctaccggctcccatcccctgcctctgccaacagtgtagagactaaaaaactccaactctttccttttttttttgtgagacggagtctcgctctgtcacccagcctggagtgcattggcgtgatctctgctcactgcaacctccacctcccaggtccaagcaattctcccgcctcagccttgtgagtagctggaactacagtcatgcgccactacgcccagctaatttttgtattttcttttttagtagagacagcgtttcaccatgttggccaggctggtctcgaactcctgacctcaggtgatccgcctgccacagcctcccaaagtgctgggattacaggcgtgagccaccaagcccagccaaaactgtaactttcttatctttgaacaagatgctattgtcaggaggggaagggacaaagggggagccacggcaacaaacactcttacagggaagtctgacattttaacctgcaatctttatattacacattaaaagtctacgttgacgtttcatgtcttttgaaagttttgaccgtgaaccaatccccacctctcttttagaacaaggaggtaaataaagtctgttaagtcaccagaataaatctggagacacattttctgttaaagtaagaattttaaagtaatcagagcctcataggtaaactcctttgagaaaccccaaacacacacacacaaccatttttctgcagccccggctgtgacattttatacctttcacaattattttaagcactctccttttttctttttccttctgtgttcaaattacagttagaagaaactaagcagcttctatcaaggtgacttaaagcagcccattaagaataccatatagcctctcccgtggcaacctccattctgattttaaataagaaatccccaaatatttgaataggaactgtcctgagatttggctactttaacaaaggaaacaattaggcacttacctggttccttcacttaggtaccatctggataggttcaaagaaaaattaagatgggtactgaaaagttgggatatttgagtttttattgagaaaaggaagagaatagctcaaagaagcctaaacaaagtcccacaggataataaacagagctacagacactgttgtctcaccatctgtttgagagttcctctggaatattgtgcttgcctctggattggcagaaaggttaaactccaaagctatatgtatagagggagaaaagaaaaaggacgtaatcatttataaaaatttatcaactcatttattcaactgctgcttattcgacaagagccataaataaatggtcccatgccagcctgggagaatgagatgagagagcaagaactgggcgattgggaggggaggtgaaaagaaactgactggactcggtggggaaagactaaggggtgggaattcaaggcagagccagcttttgttcctggccagcccccgggaaagctggctacaagcagaaaggagctcgaagtgtgggatgcctcaaagggaaccttggggacagcagcagccagaggcaaaccgagggtagatggcacctatcacctccttaccttcaggcatctcccggtcacgaacctggtgcatgtggaggtcctcaccaacttcaacagtcacctcagcaggctgtacagcagcagccatgggcgctcctgccatcctgtcctcagctcctgcctcatagatctcagattcagagggacacaccgacccctgctgctggtcaaactcgaggctgacgctagggtgcacacgacaggtcagtatgttccccatggggcgcctctactgtctgccaccacctgtgcctctgctcacagctttggccacgcactcccgctgtcctaggccgaggctatgctgcacttgcagagatggtcttcccgct

SEQ ID NO: 2216 - DNA, 4469 bp, Homo sapiens; identical to SEQ ID NO: 2214

SEQ ID NO: 2217 - DNA, 4469 bp, Homo sapiens; identical to SEQ ID NO: 2214

SEQ ID NO: 2218 - DNA, 16140 bp, Homo sapiens
tttgagttgaatacaaatctttattattttgaaaaccacagcaaaggcacttcagaatctccaggtacccagtctcagttgccgttcagtggggacaagagtggtgctgagggcatggtcacacccttctgtgctgcatgcagaggggtgcaaggccagggcagctgacctggtcagccaccaggggagcccacgcctcttataacacagtgtccttgggtcaggaatttgtagtttattttgttattaagatggcgagagaatttttcgtccatttagagcctaacatttttagatgaatgttaatggcatctcggttgggatggattcgtgttcgtttctcagctgctgaaggatgtgtgttctaaaacaaaagggctcccagccagctctccggctgcatgatagagaagtgttttgtaagacgcttgttaaaaacccatattccctggcccctcttgtggagaccctgtttcagtagatgggaatggggctggggtctgtataacctgtgcccaggagactctgtgaccagcttgggaagctcctgcagggaggaaggaatgatccacaagtccccaagcccttcatgctgaggcatctgtctggctggagaaacactaaggttggcattgtgctcacactgggaaatgacctggaggaagttgggaagaggagtccaggccggttccaccctctgggtcagaaacccggctggaaagcactggaaatagggaaatagaagactgaaaggctgggacccccctcacacccaacctgcgtccatggccgaggttgagtgaggagtcctggagactctggcttcatggtctttgctcttgttcttctgtgcctcaggggtcgctgcccaccaggctcagcagggcgttcttgtagtcgccgctggtgtcttcctgtgggcaggaggcgcataagcgtgagaaggggtttgcttgtgcctggctcggcagtggcggctgtgttattatgactaagaggtgtgcccctggcctgcacctggcccggccctccagggttcctagccgcaggggttgtgccatcacccctctttcctggtttttaatttcaggctattcctttacatttccttttgattctcttaccaactacatgcaggattgatgtggaaaatgaatcagagacagttccactcctaaacaaggaaggggtcagctgtcccagggttcttctattcgggagccagggtgcccagccattcatttacacaacacgatgcatcattattcaacacctgctgtggcagcttgggaatcaaggctgagagtgaggcatcagcacacacctgggggcagggccgggggtggagggagcctggatcatcgcaccctgacggtgtggccgaggcaagccccttcacctctgtgggactcatctatgaaatgagatcgatgctgtgctgctgtgcatcttgctgagacgtggtgagggtacagcaggaggaaggcgagctggtctgccctgcatctggctcacatcgggtccacagtgtttgtctcctgatgagactgaccttgtggtccgatgactgaggagccctgtttcttagatactggtaggtcctgatgggactggctagtccggggtctgcatacagagctgggaaatgggccaggtcagatcacccagattcttcttcatgcagttgaggacagcggggccaagagaggggagtgaattcattcacaacggcatggtgagtaaggggtagactggggctagacccactttccacactctggaccagtttaggtctcatggttattgtctacttttcaccatttagtaaaatttgcctgctttgagcctgaaatctcattacgggtttcaaactacaatgaaatttttttaactttttcctttctagacacggtctcactctgtcacccaggctggagtgcagtgatgcagtcctagctcacggcagccttggactcctgggctcaagcgatcctcctgcgttggcctcccaaagcactgggattacaggtgtgggccactacgcctggtgatttttattattttgaagacaatttttctaatagtttttagaaagaaaagcattaattttgtttactttttcaaatacatgagttatacttggagtgtttatacatttgcctcttaatttcaatgcaggagtttttaactcatattagtgttgaaaaccatttttgctttaatgacatctgtggtctacactaaaaagaaacgtttggtcaatgtattcatgattctaactcaattttcttaagtaacaacattagataaaatttgaagagggtggcttcatgtatctgtagaaatctctctgatgccgtaagttaccatgtgtggttaaaagggttaatgacaatcagctcagactgtctgcaggtgacagcacagtccaggctggtgtgtgccttgccctcctgtctcccgacaagattggctggggagcctcaagtgaaaccaagaataattccaatcctctcttgcccctgcccacctgtttcaagatgttgccatcttgaaacatctggaaacagaaatgtcttttccacctattgtcagctatgtgtttcttgaaaagtgcacttaacaacgacatttgcagaagagctagagacttgacttagtagccaaagaaaacttggggatacatttgtcctaatgtgacttctgctaatgaaatcatcaagacctcaatttgcagacacccccagaagagctgtttctcccaattatcgcagcgtgataatcagtctgtgttttgaaggctccagaacttttgctaattggaatctggttagatagtctattggcgctcatctgacttatctccttagaagttggccgccaggactacttaaatctggatttgagcggtgggcccgattcctaccggactagttcatctcattgactattcagaggtggcttcttctgcaaggatttggtgtcttttccaaggagcaaccataacttaaatgtgaaaccaactttctgagtgggacacaggggagcctctgtgccctggtctctgcatctcccctctgccccccattccccttgggatccagccacactgacctctgctgttccctgcacacaccacatggtcatgaatgcaagcacatggtgcccactgggaagggaggggctcacgtagtgttggccacagcctccaggtttccctgaatgtctgggtttcaggctggcctcagcattgggaatgcctgcttaccatgatcatgctgctgagggtcttgccgtacatcttcttgaagtgacatttgataagatttaagtcaatctcgctccttgaaacgatgtttcttatcagggtcccatcacgcgtccctgctccctgggcaagacagcagccatcaacaatcctgcctcacctttcctgtccatctctgagtgatggacggatctgtgtggttgggttctggggcttttagagggagggagatgtgggaaggagcctgtgcttcagccagggaagcattaggagggaagctttggtggcttagggtgtccactcccttaattccttctcacccactgcccagaactcttcctttatgatgccaagtgctccaaactgcagtatgtttggtttgccacatcagattctagacacaaaatactcactgctccaggaacaagacttcctactagagcaatggcagcaatcagctcagccaggaatttcacaggcagggccttcctgctcaccttcatccctgaccagtctcatgtcagctggggccacatggccaagggaatcgcatgccctctctcatttcctgggcagaagtggccagagggcttgggtttcgggtgtggaactaacttcaggggatatcagcaaccatcaatcagagaaaacgggcaatggttttagtttcagggaattattcacctctggagatgcagcgtccctttcccagactcaatttcacctccgagaactaaaacctttctgatccacgacaggtttgggtaagataactcccccgtgtggaggatcgtggtggctttgagctccttggctttgcacttggtgctatgtagggtgagcgtcaggaagaagaagacaggacagttaccttcatggcatagtagagtctctctgcaaagtagctgtggaggttttgggtgcatttcactggcaaacaagaaagctgtgttaatgtctggagctggtaggtggcactgcctacaactttatgtcttgccttaggtcttaagagtcagtgttgtgcaaggcttggcatatttctttgttccgtgcctttcccaatgtgagaggctttgtgtcaggtggcgtgggacagggaaggtagcccggggcactgggcacagctccaaaggcccaagcaggcaggcaaaagggtaagatgtgaaatgcaccagactgtggggctcgtctgaagacaccagctcaagcccatccaagggcagctcagactcaggacaggccctgggctctcaacccagagacacctccaccaaaaatccagcctctcagctccacagaagcaccatgggatggtggctgctggcctcagagtgccctctctctcacacttatcagcaggaaccctgcattttgaattcccatgtgacaagtggagtttggccccacaggactaaggcacctgggggcgtctggtccagagactgggcccatgcttgctcccatgggtactgctcagagacttggcatctgggtggggaaggttggcattttcacttagggctgcagaaggagcatgggctttgagtgaggtaggcatgtgttcacttcctgccttgatggtgcagtatggcttcattactcaacctccctgactcatctgggaagtgagactgatgcgaggcttcaaggtgaagtgaataggaaggcccagcatgacggagcactgcatggcttcactattccctgctggcagacttcattcttggtgggttcaggccagatccaggggtggaagctgagattggagcaggggtgtgattagatgtcctgacatagaccggattgtatcacagcatccaaggccagctggggtgtctcagatggccctgtccacccagagaggctaggaaacagcagggagcctgctggctgctggctttgcacggaggcagcctggtgtggaggtgagagctgcaggccaggagtccggacctgggctctgtgtgtaagtgggagaagagacgtccctctgccctgggcctcagctctttactctgcagtgactcttcccattgtgatctcagccctggaacccatgagagctctggagtgggtcctcctgagtggccctgacttcctgctgtggggaagatccccagtgtttctcagcatcagaccatccgtcactcagtttggactcaagccacacatcactgtttcttcaactggcaatgaaggcaggggccaggcccctggttcatgtccagaaagatgactttgtgctggccagggcttcacaaccacagccagagtgctccctgcatggctgccatgagtacacacagggttggggctggcataatcactggcgtatgcatttgtgtgcgcacacacacacactgtctgtctcacacacacacactcacattccacccacagtcatgcacacacaccctcaggcacacacactctcacgcacacacacactcatgcagacacacccacacagcactgggcaccacgtgggcagcacagagaacaatctttggcagcacacactgggactctagaggtggagcagtccctgggtgagggagacaggcagagtgtgagtcggggggacatcccgtgaaggtgacacagggattctttctcttgtggtcgcatccctaggccctttgttctttggtgctgccccacggtgagccctgtggcctgaaaaacgtgcaagtctgagctcttacccacagtgagcatggcctcctccagtgagccatgggtctcactcttgatgctgtcctcaatgctcttgttggcaattttctcatactcttcaaacactgtggagagggctctgctcaggggatggtcagacctcctcgtgatgcccctcagtgtctcggatcagagatcgcacatcaatttgccgccctgacctcccactggtggctggggaaacagtcctgggctccctggctctctccctaactctagacttgacaaggcagaagcacgagggagaggctcatggccaggacaccccctgtggccccggccccagcccctccctccctggtacctctcagcaggtgagtggcactgcgcgtgcacaggatggtgatgaatttcatctcatcagtcccacgaatcttctcgcctgccgcatacagatcctagcattgggacacccacaataagccagtgagggagaccagggaggtgagggactgagccccagagtcccagagctgtggccatggcctggccctgtccactctgccaggccagcatgctcccctgcttggtcgtctctgacagggagctcccctttctctagcagctctggcttagaatattttctctatcctgggccacaagctgctctaggaactgcctggtccccagacttccctctgccagcaggcagacctacagagacccggacacctgtgtccagcactggggcctagcgcccccgggttcatgggctgttcctgccaggacagagctttagtgctcccccacccccaagtcacactccttcctcccgagtctcccaacaccctcactctcctccccagacaccacaggacaaaggcctatagggagctgagctgggtgggtcccagcccagtgtcagagaaagcccccgtgggcagaggagccggagtccagatggcagggggtggggccacatggccggctgggcgcagcctcacctgtgcgtcttggagggccagtcctgggtccacaaagctgctcacatcatccctgctgccctaggaacagaggaggtggctctgtaaggcaggccagctgaccagagcattaagggcacaggggggatcctgggcttggagggcaggcatggctctgctgctctttggctgtggaaacttcgacaagccagttattctcttcagcccttggtttcctcatttgtacaatgggggtggtaaggactgcctcataaggcttggcggattcagtgagctaaggtaagcaaagtgcctggcatgaggcctgcacgaaggacctgctctcctcccgcttccaggatgctctcacatggctgagtaaggacaggtgtgggggctctgcagttgggaccctctaaccatgctgagacacacccaatgagccctggctgctgggctatcccatgcccctaccctgactcttgtggcgctattcaagggctgctccctggggtggagctgttgggactcccaaaccaaggcactcccaagagcctaggctgtgacacctgcaggaggcacaccaggatcctctccaggtagccacttgtgtctgcttggatgtcctcctccaggctggacccatagtctgcagggaaacaggaccatgaggcacaagcagaggcccacagcctacccggggcctgctttcctccttccagccctgttccccatacttctccttattaaagccttctaggaaagaaagtccttggcacagggcatggatgcaatgcccgggtgtccaagtggctgtcgcctgggtggtgcttcacaactagaagcgacatgcgtacccaaccaagctcaaagcacaagatggaccaggtcagagagccaggctaggggctgccaaccaagctccatttcatctcaaggcttggcaaagccaaagcctccaggaaaactccccactaggtacatgatgtggaggactgactggcctctgctagcctggggtccacaccccctactaccacagtcctcaagggcagagattttagttggtcacaggcctctctcccctgtaagaggagctggtgagcttacagatcaagtctgaatcatgttcagtgtcaccatcaggcacagatcttggcatacggtaggtgctcagcacctgtgggtaaaaaagtccccaaagggtcctttctagtgtggcccaggttaattcttgatccttgttccctgccaggctgccaaagcttgtggccactcctgagcccctccatctgtgccaccccttaccttcctcatacgccttcattatctcccgcagctggttcttggtccgagaggccaggatctcaatgatgacaccctccttggttcctaagccctgtggacagaaacctctgcctgctggagtgctctgccatgaccttctgctctgtccacaccttcttttctcaagatgcctgagcctcaggaaggacctcactgccctgccccacttgaagtgggaggatgtgatgagaaaatcacatgcttcagtgatgaacattgagggcaagtgctgtgacggggaagccctgtctcagctctccctccttagctgggtggtctcagacaggctgctccatgtcctggagcctaagcatcccgatccataaacaggaataagaagcctcccctgcgccaaagatagattagggagcgtgggtgtaaaatgcctggcagtgcccatgcagcaagtgtctttccaaacaaaatgactatagttactgggtccccatccttattaatctgcaaaagcaaagagtagtgagaggtaaagggaaacccaaggggctgtgcctgggactgtagaggtgggtttccaataccactgtacacctgagctcgtgaggttctgagaagtactgattttggcttcatcacggccactcaacgtgtcaatcaggcaccagtgactccaggtgttgggtgcagtctgagcagcaggctgcctgctcactgggcccagttatggcccatatggccattccaaacagtggctcaaggggagctctgggctgtaggttcccggtccccgcattgcccctacccagtcatgtgagcacccctgccactcccctgccctgtctgcctggttaccttcatggcgtcatgcagctccttggcttcgtatctgtatggcgggtacataagggccacaatgagcctctcaaacttgccactgagctcagacttcaaggtctcagtgaggtcctaatgcgggaacagggaaaggtgatatttgtcataagccaggcccacctgagtgcaggcagcggagtggtggctgggtccaggggcttgggctggattctgcgtgggccttgccacgtgctggctgggtttcttgggccagctccttagcttctcttagcatcagtatctttaccggttacacggagagaaacgtgctcctgcttcatcccgttgcttagggggttgtgtgtgactcaattcagcattcagtgcagtgctgggcacatcataagctctcagtaaaatgaaattggtattgctagctagactgcaagctctgagtatggcatcaccataaaatacctgtcacttggcactcaatgaatgaatgcatgcctgaattaaagacttcgtctcacatgtgcctccttctaaggtcacatgttgctacgaggagccaccaggctacatcagctgatctacagagcagcagagagatcaagggctttgtcagacctggattttaatccccaccttgttgattacaggctctgggaccttgggcaacttaaaacctctctgagtgccagtttccccaaatgtttgaatacaaagaatgtatcactgtgaggactaagagagggaaactgtaaaaatgcatactgggttctccaagagaatatttgagctgatcttccttcgttacatctccaaactaatgatatgagtcactagaggcttgaggcaaccatggctgtgcacatatttaatcctgtgtttactgtgtacccccaaatgtcaggctttgtcctaggggtggagtgcaggtgggaggagaaacaaagggcctggcatgcttactccaggctcttagaattcccaggtggcagaagggacgaggtgtgggtgcaagcagctcgactgaggaaagcatgcccacgccccagaacagagcaaagccaggcctgcatgcctggggcatggaaaagagaaggtggtctgggctcagagggcagggcgagatagcctgggggcagggagacagacctccagtggggcctgttgggtgcatgagaaggaatgctgtgagagaggaggcaggaaaggaagcaaggaaggccagcccccggcccgggctctgacacctaaaagtagatctgccagataaaacacagggcagccagttacatttgaatttcaataaagaacaattgttttcatgcaaacaggttccatgtgcccatgctgccagtgggctggctctaggggaaagtcgtccagaatggagctgcctcccaggctgtacccccaaccccaaggctcacctatccccacccccaccagccttccccttgccttgccgaactgagccttgaaggacttggcgatctgctgccgctgcgtgttgcttctcttggtgagcacatcgatgatagcctgctcgttggtccctgcagggttacagcacaagtgaccctgctgcccccagggtgacacactggtgagggcggaggaggggaaggcgaaggcagctgcttggtggctgagcagttgggacccgacacctggatagttccaaacccccagaccattttcgtggtgtaaacaagacccttaggaaatctgcctccccatttcccaccccacacccccacaatgttggggcgtgcccaaggccagcctcacaagatggaatctgaggtctgggtggctctggacatcagcccgggcctttggagcttggccgagtgagatctctggccctgccctcctttgtgttggtcgcagtaggggaaggtcaagactaagagtccaacccctgaatccgaggcctggcccagcaactgcgtggcattgggcagccagcctcatttccctgggcctccgttttctcatttgggaagtggagataactttctgcttcacagaaagcagagggcatgagaacgttttctgggcttgtcaggagcggcagttctcattaaggcccctgatcctcaggcagagccggctaaggggtcagtcccacctggggtgaggtcagggtacatgctctgctctcaggtcaggagggctttctgggcaagctgtttaaatctggcctcaggccagccctcgcccactcacggtagtgctgagggcagcactgggcaagtgcaggagatgggaagggagccggctccatggccatcgacatggggcaagggggccttgaatcagccccacaaactcccaacacctcacacccctggcagctctgtgcctggcatcataaagcaccacccccttcacacttcatgtgacacacaaggccaagaattcttggggccactttacaagtgagaaagctgagactgatgggaagtcactcacagagacacacagctcacctccccacccccattacccagggaagagcagcaccctcctgtccagtcttgcagggtgggtgctgacctcactgcagaaacagagggctgtgtgattctctgggtagtggaatcagtttcagagtatcatgggacaccccagctccccagatgtcccctggcacccgctttccagggctgtgagcggaggggtcttgagcagaggtggcaaggctgccaacacccactcaccgatccccttcatggcttggtagagggtctctgcatcagggtctgggttgaagtgggagctgctcttcactgtgacaccctcctgttcaatctgcaagagaaccaggcctgctcaaagcaggcagggacagggagggcagagcaggctcccagcccatctggtagcccgccctgacagggtgagccccttccctgggcacggagatctgctcagcccttgcaggccagtgctctgcccttcagccccttggccaacagggtggagtagccagagccagagcttgtggggagaagccacaaaacctttcctgtccctgtctgtgccatctgactgcagacagcagccccagccacacccagctccttccagcatcacccaccagcagcaggaagggacaaactcacccaaagttaggaggggaaagaacactgaagcaaaggcttcctggagctgcatgcaccaccttcagagtgtgcagatgaggttggaaggctgagcatggttctgcctttctgaggaatggtttgagctcagtctgccctcttcctggggagttgggacttacagcaacttagagggcaggggcccagctgagcatattgatagttcagggtgtttgcaagtccacaggcccatggggctcagagcgtcaggtttagaaaaacccgcacgatgctctgcagattgtgaaataaaccagataaccaagtgcctgagcccttgatttccaagcctccagttcagggcttgcctgaaggctctttaaacttgtgccctgcagaatttctcagatgattaacatggacataagtgtgttttgggtggaggaatggtagagaatggagggatattggagataggtattgaattagagggagactcagagatcctccaggatgaaaaagagtttagtcccatccagtcttgtcttccatttacctgttcacttattccttccatcacctccatcatctgcccatctactttcccacctacgcacttacccatttgactaccacatccatccatccatccacccacccatccatctatgcacccgcccatccatccatccatccatccatccatccatccatccatccatcgaagccctgggttagattgtgaaaatacagagattccaatggatggtatatctgtaagtatctttcctttgagtaagaggtaaggcatctttctgaactctttgctttaatttcaaatgtctggtgacagatcttcctgagtcatttcttagcaccatgtttcacagcagaaattgttagaaataattcctatggaaattccatccagagagagccagtgtggtcccagatattgctcatcggtgtccacacacacgatatcccttgcttgtggagtcacgctctgctattactcctgttagcacttcaagccccttgtgtgtgccagacctgggccaggtgctttagaagcaatgcttatgtcatggcttcctcaacagttgtgctaggtaagtactgatgcctcactttacagaaagggagctggactcccttacacagctagtaagtgatgctgttgggactccccagcctgactcagaagctgagctctatctacctcccctgccctactgatgactccacctttcccagacaatgagtgttcctggaacgttccactgaaggaagcttcacccacaggaacgcaggtcatctgggaatgtgggaggcatctcagctctcagtgcctgccggcttccctctgccccagcactcgggggctgtggtgcaccagcgagtggccaggctgtgtaaccgcatccctgaggagcatgcagtcccgcaggggtgcggtaggtctcaggtgcagcatttgtaagcagctccctggctggttctgattttgctgcattgagaagcctctgtctcacttcccactctaaggttttagaaaataagtgttctgggaatcggagccctggctatcagtgtggagtcctggagctccagacctcctgctgagaaggaagggtcagcctcaggctcctgcagggtcttgcccagggccgtgctagtccagacaggcacattttcactgaaaaggtgactcagaccagcctgtgactacatctattaatataacttgttctgtgacaggcacaggggagctgccacgccttggccttcccctgctacgtggctgcccagaggcctgggagatgggtttgtctctatgagagacacagaggaaaaggcaacaccaaaaagagaggtgcagatggaccctgcctgcagacagatctctctccagtggctccctcatctcctcccatcgcgttcctggcccagctttgtgcctagaggacactgggtcttcgctagcagctcagctgttgcaggtggggtctacctgtgaacttgctacccctagccagctctcacatggggtatggacgaccagggtatggttttggccctggagtcaggctgttcagattctcacctagactctcacacttactagtgagttcgggcacctgcctagcctacttgtgcctcagtttcctcatctgtggataaggatactggtgtctacttcatagactccttgtgaggttcaagggagatattgaatgtgaggtgcttagagaagggtccggccacagagtagggactcagtgagtgtcacagtgatcctgtcaatttggcaggtccctacatggacagccctttgtcctgctgcactgggtgcaaggcccagtgccagactgccttggccagcaactgactttggaaaccacccagcactgggctctccctgccatgtccacctcctcaaaggcaggttcccagcagtctggttgaagctgcaggcctccatggccccttgtcctggaagaaggctgcttccctgggggccaggacagctgccccacctcagcctggcttcctctttgtcccacctgtccagaacctagcatgtctgaccctgaggacacttgcttgggttgcgacatctatgatccagagactccctgaagctggacaagcctgggtatcccacaaaagctcacagagaacctggggctgggcagagagacccaactgctctctgactggagcctgctggccattggaccctagcaagtcactcagtgtctctgagccttcatttcatcatctgcaaaacagaaagtgcagccctgacatcctgaggctgcctgggaggaaaggaaaagggtgtgcagagccggcagccgggagatgtcacctctgtccccttctggatattcaactccttagcacagcgatggcctcaggctcaaccatagatggaaagctcccgagaacccatcagttctgctggggatgggctgccctgagccccgggttcctccaggctctagcaggccaggtcctcctgcttcccctcttccctctccagtcttgacaaatgaacatcattgatccctgaggtgaaggcattgatgggtccccaacagcaggttcaggttactctcatgctcaaagcccttcagtgccttcccacttctcttaaggtaaagcctaactcctcagcctgccaggcaaggcctttcaggacctggccctgcctgcttccccaggtccatctcctccggtaccaggacccttgagctgtgctgagcagcttccctcgaagccaagctccctgccctctgaccctctgcacacagttccctctgccaggagcagtatgcctgattctccccaaatgcacacgtgtgtgcaccccatacacatttacacacaaggctcaaccatgataccccctcctttgagtggccccacccctgcaagggtccctcccctggactcttctcaaacctcagcttcccccttgcatttctagatttcttcatcagcctgtctcccggcccaggtcccatccctgccgtgggcactctaggcctgggactgtttcttctcggccccttcccaccctccatgcttggcccaggaggcagccaaatgtagactgagccactcccagccaagggcgactttacatttctcaggactccctggtgaccagcacccaacaccatgcaggaacccaaatctcctgccagctcccacttacccaggatttccaccaggccatctctttcacctcgggggcacctttcccagggagatgaagagacacaggttggcctctgctgggactccacacgtctggctcctgcagctgaggagtgagcaggccgctcacttgggtgtgggggtgcaagcccgcccagggcagcgccacacctgcctgccgtcccctcgcccccgggctctgcctggctttgggcatctcctg

SEQ ID NO: 2219 - DNA, 16053 bp, Homo sapiens
gttgaatacaaatctttattattttgaaaaccacagcaaaggcacttcagaatctccaggtacccagtctcagttgccgttcagtggggacaagagtggtgctgagggcatggtcacacccttctgtgctgcatgcagaggggtgcaaggccagggcagctgacctggtcagccaccaggggagcccacgcctcttataacacagtgtccttgggtcaggaatttgtagtttattttgttattaagatggcgagagaatttttcgtccatttagagcctaacatttttagatgaatgttaatggcatctcggttgggatggattcgtgttcgtttctcagctgctgaaggatgtgtgttctaaaacaaaagggctcccagccagctctccggctgcatgatagagaagtgttttgtaagacgcttgttaaaaacccatattccctggcccctcttgtggagaccctgtttcagtagatgggaatggggctggggtctgtataacctgtgcccaggagactctgtgaccagcttgggaagctcctgcagggaggaaggaatgatccacaagtccccaagcccttcatgctgaggcatctgtctggctggagaaacactaaggttggcattgtgctcacactgggaaatgacctggaggaagttgggaagaggagtccaggccggttccaccctctgggtcagaaacccggctggaaagcactggaaatagggaaatagaagactgaaaggctgggacccccctcacacccaacctgcgtccatggccgaggttgagtgaggagtcctggagactctggcttcatggtctttgctcttgttcttctgtgcctcaggggtcgctgcccaccaggctcagcagggcgttcttgtagtcgccgctggtgtcttcctgtgggcaggaggcgcataagcgtgagaaggggtttgcttgtgcctggctcggcagtggcggctgtgttattatgactaagaggtgtgcccctggcctgcacctggcccggccctccagggttcctagccgcaggggttgtgccatcacccctctttcctggtttttaatttcaggctattcctttacatttccttttgattctcttaccaactacatgcaggattgatgtggaaaatgaatcagagacagttccactcctaaacaaggaaggggtcagctgtcccagggttcttctattcgggagccagggtgcccagccattcatttacacaacacgatgcatcattattcaacacctgctgtggcagcttgggaatcaaggctgagagtgaggcatcagcacacacctgggggcagggccgggggtggagggagcctggatcatcgcaccctgacggtgtggccgaggcaagccccttcacctctgtgggactcatctatgaaatgagatcgatgctgtgctgctgtgcatcttgctgagacgtggtgagggtacagcaggaggaaggcgagctggtctgccctgcatctggctcacatcgggtccacagtgtttgtctcctgatgagactgaccttgtggtccgatgactgaggagccctgtttcttagatactggtaggtcctgatgggactggctagtccggggtctgcatacagagctgggaaatgggccaggtcagatcacccagattcttcttcatgcagttgaggacagcggggccaagagaggggagtgaattcattcacaacggcatggtgagtaaggggtagactggggctagacccactttccacactctggaccagtttaggtctcatggttattgtctacttttcaccatttagtaaaatttgcctgctttgagcctgaaatctcattacgggtttcaaactacaatgaaatttttttaactttttcctttctagacacggtctcactctgtcacccaggctggagtgcagtgatgcagtcctagctcacggcagccttggactcctgggctcaagcgatcctcctgcgttggcctcccaaagcactgggattacaggtgtgggccactacgcctggtgatttttattattttgaagacaatttttctaatagtttttagaaagaaaagcattaattttgtttactttttcaaatacatgagttatacttggagtgtttatacatttgcctcttaatttcaatgcaggagtttttaactcatattagtgttgaaaaccatttttgctttaatgacatctgtggtctacactaaaaagaaacgtttggtcaatgtattcatgattctaactcaattttcttaagtaacaacattagataaaatttgaagagggtggcttcatgtatctgtagaaatctctctgatgccgtaagttaccatgtgtggttaaaagggttaatgacaatcagctcagactgtctgcaggtgacagcacagtccaggctggtgtgtgccttgccctcctgtctcccgacaagattggctggggagcctcaagtgaaaccaagaataattccaatcctctcttgcccctgcccacctgtttcaagatgttgccatcttgaaacatctggaaacagaaatgtcttttccacctattgtcagctatgtgtttcttgaaaagtgcacttaacaacgacatttgcagaagagctagagacttgacttagtagccaaagaaaacttggggatacatttgtcctaatgtgacttctgctaatgaaatcatcaagacctcaatttgcagacacccccagaagagctgtttctcccaattatcgcagcgtgataatcagtctgtgttttgaaggctccagaacttttgctaattggaatctggttagatagtctattggcgctcatctgacttatctccttagaagttggccgccaggactacttaaatctggatttgagcggtgggcccgattcctaccggactagttcatctcattgactattcagaggtggcttcttctgcaaggatttggtgtcttttccaaggagcaaccataacttaaatgtgaaaccaactttctgagtgggacacaggggagcctctgtgccctggtctctgcatctcccctctgccccccattccccttgggatccagccacactgacctctgctgttccctgcacacaccacatggtcatgaatgcaagcacatggtgcccactgggaagggaggggctcacgtagtgttggccacagcctccaggtttccctgaatgtctgggtttcaggctggcctcagcattgggaatgcctgcttaccatgatcatgctgctgagggtcttgccgtacatcttcttgaagtgacatttgataagatttaagtcaatctcgctccttgaaacgatgtttcttatcagggtcccatcacgcgtccctgctccctgggcaagacagcagccatcaacaatcctgcctcacctttcctgtccatctctgagtgatggacggatctgtgtggttgggttctggggcttttagagggagggagatgtgggaaggagcctgtgcttcagccagggaagcattaggagggaagctttggtggcttagggtgtccactcccttaattccttctcacccactgcccagaactcttcctttatgatgccaagtgctccaaactgcagtatgtttggtttgccacatcagattctagacacaaaatactcactgctccaggaacaagacttcctactagagcaatggcagcaatcagctcagccaggaatttcacaggcagggccttcctgctcaccttcatccctgaccagtctcatgtcagctggggccacatggccaagggaatcgcatgccctctctcatttcctgggcagaagtggccagagggcttgggtttcgggtgtggaactaacttcaggggatatcagcaaccatcaatcagagaaaacgggcaatggttttagtttcagggaattattcacctctggagatgcagcgtccctttcccagactcaatttcacctccgagaactaaaacctttctgatccacgacaggtttgggtaagataactcccccgtgtggaggatcgtggtggctttgagctccttggctttgcacttggtgctatgtagggtgagcgtcaggaagaagaagacaggacagttaccttcatggcatagtagagtctctctgcaaagtagctgtggaggttttgggtgcatttcactggcaaacaagaaagctgtgttaatgtctggagctggtaggtggcactgcctacaactttatgtcttgccttaggtcttaagagtcagtgttgtgcaaggcttggcatatttctttgttccgtgcctttcccaatgtgagaggctttgtgtcaggtggcgtgggacagggaaggtagcccggggcactgggcacagctccaaaggcccaagcaggcaggcaaaagggtaagatgtgaaatgcaccagactgtggggctcgtctgaagacaccagctcaagcccatccaagggcagctcagactcaggacaggccctgggctctcaacccagagacacctccaccaaaaatccagcctctcagctccacagaagcaccatgggatggtggctgctggcctcagagtgccctctctctcacacttatcagcaggaaccctgcattttgaattcccatgtgacaagtggagtttggccccacaggactaaggcacctgggggcgtctggtccagagactgggcccatgcttgctcccatgggtactgctcagagacttggcatctgggtggggaaggttggcattttcacttagggctgcagaaggagcatgggctttgagtgaggtaggcatgtgttcacttcctgccttgatggtgcagtatggcttcattactcaacctccctgactcatctgggaagtgagactgatgcgaggcttcaaggtgaagtgaataggaaggcccagcatgacggagcactgcatggcttcactattccctgctggcagacttcattcttggtgggttcaggccagatccaggggtggaagctgagattggagcaggggtgtgattagatgtcctgacatagaccggattgtatcacagcatccaaggccagctggggtgtctcagatggccctgtccacccagagaggctaggaaacagcagggagcctgctggctgctggctttgcacggaggcagcctggtgtggaggtgagagctgcaggccaggagtccggacctgggctctgtgtgtaagtgggagaagagacgtccctctgccctgggcctcagctctttactctgcagtgactcttcccattgtgatctcagccctggaacccatgagagctctggagtgggtcctcctgagtggccctgacttcctgctgtggggaagatccccagtgtttctcagcatcagaccatccgtcactcagtttggactcaagccacacatcactgtttcttcaactggcaatgaaggcaggggccaggcccctggttcatgtccagaaagatgactttgtgctggccagggcttcacaaccacagccagagtgctccctgcatggctgccatgagtacacacagggttggggctggcataatcactggcgtatgcatttgtgtgcgcacacacacacactgtctgtctcacacacacacactcacattccacccacagtcatgcacacacaccctcaggcacacacactctcacgcacacacacactcatgcagacacacccacacagcactgggcaccacgtgggcagcacagagaacaatctttggcagcacacactgggactctagaggtggagcagtccctgggtgagggagacaggcagagtgtgagtcggggggacatcccgtgaaggtgacacagggattctttctcttgtggtcgcatccctaggccctttgttctttggtgctgccccacggtgagccctgtggcctgaaaaacgtgcaagtctgagctcttacccacagtgagcatggcctcctccagtgagccatgggtctcactcttgatgctgtcctcaatgctcttgttggcaattttctcatactcttcaaacactgtggagagggctctgctcaggggatggtcagacctcctcgtgatgcccctcagtgtctcggatcagagatcgcacatcaatttgccgccctgacctcccactggtggctggggaaacagtcctgggctccctggctctctccctaactctagacttgacaaggcagaagcacgagggagaggctcatggccaggacaccccctgtggccccggccccagcccctccctccctggtacctctcagcaggtgagtggcactgcgcgtgcacaggatggtgatgaatttcatctcatcagtcccacgaatcttctcgcctgccgcatacagatcctagcattgggacacccacaataagccagtgagggagaccagggaggtgagggactgagccccagagtcccagagctgtggccatggcctggccctgtccactctgccaggccagcatgctcccctgcttggtcgtctctgacagggagctcccctttctctagcagctctggcttagaatattttctctatcctgggccacaagctgctctaggaactgcctggtccccagacttccctctgccagcaggcagacctacagagacccggacacctgtgtccagcactggggcctagcgcccccgggttcatgggctgttcctgccaggacagagctttagtgctcccccacccccaagtcacactccttcctcccgagtctcccaacaccctcactctcctccccagacaccacaggacaaaggcctatagggagctgagctgggtgggtcccagcccagtgtcagagaaagcccccgtgggcagaggagccggagtccagatggcagggggtggggccacatggccggctgggcgcagcctcacctgtgcgtcttggagggccagtcctgggtccacaaagctgctcacatcatccctgctgccctaggaacagaggaggtggctctgtaaggcaggccagctgaccagagcattaagggcacaggggggatcctgggcttggagggcaggcatggctctgctgctctttggctgtggaaacttcgacaagccagttattctcttcagcccttggtttcctcatttgtacaatgggggtggtaaggactgcctcataaggcttggcggattcagtgagctaaggtaagcaaagtgcctggcatgaggcctgcacgaaggacctgctctcctcccgcttccaggatgctctcacatggctgagtaaggacaggtgtgggggctctgcagttgggaccctctaaccatgctgagacacacccaatgagccctggctgctgggctatcccatgcccctaccctgactcttgtggcgctattcaagggctgctccctggggtggagctgttgggactcccaaaccaaggcactcccaagagcctaggctgtgacacctgcaggaggcacaccaggatcctctccaggtagccacttgtgtctgcttggatgtcctcctccaggctggacccatagtctgcagggaaacaggaccatgaggcacaagcagaggcccacagcctacccggggcctgctttcctccttccagccctgttccccatacttctccttattaaagccttctaggaaagaaagtccttggcacagggcatggatgcaatgcccgggtgtccaagtggctgtcgcctgggtggtgcttcacaactagaagcgacatgcgtacccaaccaagctcaaagcacaagatggaccaggtcagagagccaggctaggggctgccaaccaagctccatttcatctcaaggcttggcaaagccaaagcctccaggaaaactccccactaggtacatgatgtggaggactgactggcctctgctagcctggggtccacaccccctactaccacagtcctcaagggcagagattttagttggtcacaggcctctctcccctgtaagaggagctggtgagcttacagatcaagtctgaatcatgttcagtgtcaccatcaggcacagatcttggcatacggtaggtgctcagcacctgtgggtaaaaaagtccccaaagggtcctttctagtgtggcccaggttaattcttgatccttgttccctgccaggctgccaaagcttgtggccactcctgagcccctccatctgtgccaccccttaccttcctcatacgccttcattatctcccgcagctggttcttggtccgagaggccaggatctcaatgatgacaccctccttggttcctaagccctgtggacagaaacctctgcctgctggagtgctctgccatgaccttctgctctgtccacaccttcttttctcaagatgcctgagcctcaggaaggacctcactgccctgccccacttgaagtgggaggatgtgatgagaaaatcacatgcttcagtgatgaacattgagggcaagtgctgtgacggggaagccctgtctcagctctccctccttagctgggtggtctcagacaggctgctccatgtcctggagcctaagcatcccgatccataaacaggaataagaagcctcccctgcgccaaagatagattagggagcgtgggtgtaaaatgcctggcagtgcccatgcagcaagtgtctttccaaacaaaatgactatagttactgggtccccatccttattaatctgcaaaagcaaagagtagtgagaggtaaagggaaacccaaggggctgtgcctgggactgtagaggtgggtttccaataccactgtacacctgagctcgtgaggttctgagaagtactgattttggcttcatcacggccactcaacgtgtcaatcaggcaccagtgactccaggtgttgggtgcagtctgagcagcaggctgcctgctcactgggcccagttatggcccatatggccattccaaacagtggctcaaggggagctctgggctgtaggttcccggtccccgcattgcccctacccagtcatgtgagcacccctgccactcccctgccctgtctgcctggttaccttcatggcgtcatgcagctccttggcttcgtatctgtatggcgggtacataagggccacaatgagcctctcaaacttgccactgagctcagacttcaaggtctcagtgaggtcctaatgcgggaacagggaaaggtgatatttgtcataagccaggcccacctgagtgcaggcagcggagtggtggctgggtccaggggcttgggctggattctgcgtgggccttgccacgtgctggctgggtttcttgggccagctccttagcttctcttagcatcagtatctttaccggttacacggagagaaacgtgctcctgcttcatcccgttgcttagggggttgtgtgtgactcaattcagcattcagtgcagtgctgggcacatcataagctctcagtaaaatgaaattggtattgctagctagactgcaagctctgagtatggcatcaccataaaatacctgtcacttggcactcaatgaatgaatgcatgcctgaattaaagacttcgtctcacatgtgcctccttctaaggtcacatgttgctacgaggagccaccaggctacatcagctgatctacagagcagcagagagatcaagggctttgtcagacctggattttaatccccaccttgttgattacaggctctgggaccttgggcaacttaaaacctctctgagtgccagtttccccaaatgtttgaatacaaagaatgtatcactgtgaggactaagagagggaaactgtaaaaatgcatactgggttctccaagagaatatttgagctgatcttccttcgttacatctccaaactaatgatatgagtcactagaggcttgaggcaaccatggctgtgcacatatttaatcctgtgtttactgtgtacccccaaatgtcaggctttgtcctaggggtggagtgcaggtgggaggagaaacaaagggcctggcatgcttactccaggctcttagaattcccaggtggcagaagggacgaggtgtgggtgcaagcagctcgactgaggaaagcatgcccacgccccagaacagagcaaagccaggcctgcatgcctggggcatggaaaagagaaggtggtctgggctcagagggcagggcgagatagcctgggggcagggagacagacctccagtggggcctgttgggtgcatgagaaggaatgctgtgagagaggaggcaggaaaggaagcaaggaaggccagcccccggcccgggctctgacacctaaaagtagatctgccagataaaacacagggcagccagttacatttgaatttcaataaagaacaattgttttcatgcaaacaggttccatgtgcccatgctgccagtgggctggctctaggggaaagtcgtccagaatggagctgcctcccaggctgtacccccaaccccaaggctcacctatccccacccccaccagccttccccttgccttgccgaactgagccttgaaggacttggcgatctgctgccgctgcgtgttgcttctcttggtgagcacatcgatgatagcctgctcgttggtccctgcagggttacagcacaagtgaccctgctgcccccagggtgacacactggtgagggcggaggaggggaaggcgaaggcagctgcttggtggctgagcagttgggacccgacacctggatagttccaaacccccagaccattttcgtggtgtaaacaagacccttaggaaatctgcctccccatttcccaccccacacccccacaatgttggggcgtgcccaaggccagcctcacaagatggaatctgaggtctgggtggctctggacatcagcccgggcctttggagcttggccgagtgagatctctggccctgccctcctttgtgttggtcgcagtaggggaaggtcaagactaagagtccaacccctgaatccgaggcctggcccagcaactgcgtggcattgggcagccagcctcatttccctgggcctccgttttctcatttgggaagtggagataactttctgcttcacagaaagcagagggcatgagaacgttttctgggcttgtcaggagcggcagttctcattaaggcccctgatcctcaggcagagccggctaaggggtcagtcccacctggggtgaggtcagggtacatgctctgctctcaggtcaggagggctttctgggcaagctgtttaaatctggcctcaggccagccctcgcccactcacggtagtgctgagggcagcactgggcaagtgcaggagatgggaagggagccggctccatggccatcgacatggggcaagggggccttgaatcagccccacaaactcccaacacctcacacccctggcagctctgtgcctggcatcataaagcaccacccccttcacacttcatgtgacacacaaggccaagaattcttggggccactttacaagtgagaaagctgagactgatgggaagtcactcacagagacacacagctcacctccccacccccattacccagggaagagcagcaccctcctgtccagtcttgcagggtgggtgctgacctcactgcagaaacagagggctgtgtgattctctgggtagtggaatcagtttcagagtatcatgggacaccccagctccccagatgtcccctggcacccgctttccagggctgtgagcggaggggtcttgagcagaggtggcaaggctgccaacacccactcaccgatccccttcatggcttggtagagggtctctgcatcagggtctgggttgaagtgggagctgctcttcactgtgacaccctcctgttcaatctgcaagagaaccaggcctgctcaaagcaggcagggacagggagggcagagcaggctcccagcccatctggtagcccgccctgacagggtgagccccttccctgggcacggagatctgctcagcccttgcaggccagtgctctgcccttcagccccttggccaacagggtggagtagccagagccagagcttgtggggagaagccacaaaacctttcctgtccctgtctgtgccatctgactgcagacagcagccccagccacacccagctccttccagcatcacccaccagcagcaggaagggacaaactcacccaaagttaggaggggaaagaacactgaagcaaaggcttcctggagctgcatgcaccaccttcagagtgtgcagatgaggttggaaggctgagcatggttctgcctttctgaggaatggtttgagctcagtctgccctcttcctggggagttgggacttacagcaacttagagggcaggggcccagctgagcatattgatagttcagggtgtttgcaagtccacaggcccatggggctcagagcgtcaggtttagaaaaacccgcacgatgctctgcagattgtgaaataaaccagataaccaagtgcctgagcccttgatttccaagcctccagttcagggcttgcctgaaggctctttaaacttgtgccctgcagaatttctcagatgattaacatggacataagtgtgttttgggtggaggaatggtagagaatggagggatattggagataggtattgaattagagggagactcagagatcctccaggatgaaaaagagtttagtcccatccagtcttgtcttccatttacctgttcacttattccttccatcacctccatcatctgcccatctactttcccacctacgcacttacccatttgactaccacatccatccatccatccacccacccatccatctatgcacccgcccatccatccatccatccatccatccatccatccatccatccatcgaagccctgggttagattgtgaaaatacagagattccaatggatggtatatctgtaagtatctttcctttgagtaagaggtaaggcatctttctgaactctttgctttaatttcaaatgtctggtgacagatcttcctgagtcatttcttagcaccatgtttcacagcagaaattgttagaaataattcctatggaaattccatccagagagagccagtgtggtcccagatattgctcatcggtgtccacacacacgatatcccttgcttgtggagtcacgctctgctattactcctgttagcacttcaagccccttgtgtgtgccagacctgggccaggtgctttagaagcaatgcttatgtcatggcttcctcaacagttgtgctaggtaagtactgatgcctcactttacagaaagggagctggactcccttacacagctagtaagtgatgctgttgggactccccagcctgactcagaagctgagctctatctacctcccctgccctactgatgactccacctttcccagacaatgagtgttcctggaacgttccactgaaggaagcttcacccacaggaacgcaggtcatctgggaatgtgggaggcatctcagctctcagtgcctgccggcttccctctgccccagcactcgggggctgtggtgcaccagcgagtggccaggctgtgtaaccgcatccctgaggagcatgcagtcccgcaggggtgcggtaggtctcaggtgcagcatttgtaagcagctccctggctggttctgattttgctgcattgagaagcctctgtctcacttcccactctaaggttttagaaaataagtgttctgggaatcggagccctggctatcagtgtggagtcctggagctccagacctcctgctgagaaggaagggtcagcctcaggctcctgcagggtcttgcccagggccgtgctagtccagacaggcacattttcactgaaaaggtgactcagaccagcctgtgactacatctattaatataacttgttctgtgacaggcacaggggagctgccacgccttggccttcccctgctacgtggctgcccagaggcctgggagatgggtttgtctctatgagagacacagaggaaaaggcaacaccaaaaagagaggtgcagatggaccctgcctgcagacagatctctctccagtggctccctcatctcctcccatcgcgttcctggcccagctttgtgcctagaggacactgggtcttcgctagcagctcagctgttgcaggtggggtctacctgtgaacttgctacccctagccagctctcacatggggtatggacgaccagggtatggttttggccctggagtcaggctgttcagattctcacctagactctcacacttactagtgagttcgggcacctgcctagcctacttgtgcctcagtttcctcatctgtggataaggatactggtgtctacttcatagactccttgtgaggttcaagggagatattgaatgtgaggtgcttagagaagggtccggccacagagtagggactcagtgagtgtcacagtgatcctgtcaatttggcaggtccctacatggacagccctttgtcctgctgcactgggtgcaaggcccagtgccagactgccttggccagcaactgactttggaaaccacccagcactgggctctccctgccatgtccacctcctcaaaggcaggttcccagcagtctggttgaagctgcaggcctccatggccccttgtcctggaagaaggctgcttccctgggggccaggacagctgccccacctcagcctggcttcctctttgtcccacctgtccagaacctagcatgtctgaccctgaggacacttgcttgggttgcgacatctatgatccagagactccctgaagctggacaagcctgggtatcccacaaaagctcacagagaacctggggctgggcagagagacccaactgctctctgactggagcctgctggccattggaccctagcaagtcactcagtgtctctgagccttcatttcatcatctgcaaaacagaaagtgcagccctgacatcctgaggctgcctgggaggaaaggaaaagggtgtgcagagccggcagccgggagatgtcacctctgtccccttctggatattcaactccttagcacagcgatggcctcaggctcaaccatagatggaaagctcccgagaacccatcagttctgctggggatgggctgccctgagccccgggttcctccaggctctagcaggccaggtcctcctgcttcccctcttccctctccagtcttgacaaatgaacatcattgatccctgaggtgaaggcattgatgggtccccaacagcaggttcaggttactctcatgctcaaagcccttcagtgccttcccacttctcttaaggtaaagcctaactcctcagcctgccaggcaaggcctttcaggacctggccctgcctgcttccccaggtccatctcctccggtaccaggacccttgagctgtgctgagcagcttccctcgaagccaagctccctgccctctgaccctctgcacacagttccctctgccaggagcagtatgcctgattctccccaaatgcacacgtgtgtgcaccccatacacatttacacacaaggctcaaccatgataccccctcctttgagtggccccacccctgcaagggtccctcccctggactcttctcaaacctcagcttcccccttgcatttctagatttcttcatcagcctgtctcccggcccaggtcccatccctgccgtgggcactctaggcctgggactgtttcttctcggccccttcccaccctccatgcttggcccaggaggcagccaaatgtagactgagccactcccagccaagggcgactttacatttctcaggactccctggtgaccagcacccaacaccatgcaggaacccaaatctcctgccagctcccacttacccaggatttccaccaggccatctctttcacctcgggggcacctttcccagggagatgaagagacacaggttggcctctgctgggactccacacgtctggctcctgcagctgaggagtgagcaggccgctcacttgggtgtggg

SEQ ID NO: 2220 - DNA, 41520 bp, Homo sapiens
cagaaatcatgagtggaggatctcaagtccacattttttggggtgctccagttgctccactgaaaatgacagtatcagaagacacagcttctttaatgtctgttgctgacccctggaaaaaaattcagcttttatacagtcaacattctttatatctgaaggatgaaaaacagcacaaaaatcttgaaaactatgaagtcccagattctattggttctccagatctttgtggtcatttcttagcaaactgtatgaatagacatgttcatgtgaaagatgactttgtacgttctgtttctgaaacacagaatatagaatcccagaagattcactcctctagactgagtggcataactagctctaatatgcaaatatgtggatttaaaagcacagttccgcatttaaccgaagaagaaaagtatcaaagcttctcagtgaaaataaaattagagatgaacagcctaaacatcagccagatatatgtggtcagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagcgtttgggattattttcctcgaactcagtagataagtcaaggtctgaagcagcagttaagaaggtctcagaccttaaaatatcaactgataaagaatttctcagtataattacctccagccaggttgctttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtggcccagtctgaagctctatctagagtccttcaagtagctaagaaaatgaagttgatttctaatggaggagattctgctgtagaaatggatcggagaaatgtgtctgaatttaagagtattaaaaaaatcattaataaaaaactgtgattctaaaagccagaagtataattgtttagtcatggtgctatctccatgccatgtgaaggaaataaacataaaattcggaccaaattctggctctaaagtgcctttagcaacagttacagtaagtgatcaatcagaaactaagaagaaggtttttctgtggaggactgcagcattttgggcatttacagtgtttcttggagatataattttactcacgggtgaggtcattatggtatagtggtagcttattttataaagctaagttttgtttgtttttgttttctcccacttagtctttgaagactctttctttagtcatttgcctcttctgagctcagcataattgatccctttattgcatctgcattgctctcctttccattgtccactctcctgcccattgccacttctgggcctctgttctatccttctcagctctgccccttctttccacttatcccctcctttaataagccttccctagtcaggtggagtgggtcacacttgtaatcccagcactttgggaggctgaggcaggaagattgcttgaggccaggaatttgagaccagccttggcaacacagaacccgtctctacaaaaaataaattaagttttgcgtgcctgtagtcccagctacccaggaggctgacatgagaggattgcttgagcccaggaggttgaggctgcagtgagctttgattgggccactgcactctagcccaagcaacagagttagacctttctgcttctttacctaatgtctaataatgctgtgcacattgtgtttttactgtgggaacagttattgatttctgttgccttattttattatcaaaattatattaattacacttggaaatatggaaaggaaaaaactggtattataccaacttcatataaccaccaatagagttcgagagtgttgccttccagttattttctctgttctccttaaaatgtgtgtgcatgtgtgtatatatcacacatagaagctcatatttattgggagcttagtttgtgagaccctgttttagattttacatgcatatttcattacaacaagtatatgaggaaggtactgatttttatccccacttttcagttgaggaagctgaagcccagagaagtaaagtaacttgtccaatgtcatacatctaggaagtggcaaagctatagtttctcctagactccagaatttatactcttactatatagttgtaaccataaagaacattttgtttttttaatttttaatttatttatttttaagagacagagtcttgctatgttgccaagtgcagtgggtactcacgggcacaatcccattactgatcagcatgagaatttttgaattgttatttttaattttttgtttgtttgtttaataaggacaggatctcactgcattacccagtctgatctccaactcctgggctcaattgatcctcctgccgcagcctcccaaagtgctaggattacaggcgtgagctaccgtgcccatggtatttttaacatgcccttgtttccaacctggaccagttcacccctccttagggaacctgtggtcctccactcccaggaggtcactatattgatggcaagcttagtgcaaacacctgatcggctacaactctgaactcctgggctcaagtgagcctcctgcctcagtctcccaagtagccaggactacaggcacgcatgccgctgcacccagagagaatatttaatttttttttttttttgagacagtcttgctctgtcacccaggctggagcgcagtggcacaatcttgactcactgcaacctccgcctcctgggtgcaggtgattctcctgcctcagcctcttgagtagctgagattacaggtgcaagccaccatgcctggctaatttttgtatttttagtagagacggggtttcaccatgttggccgggctggtttcgaactcctgtcctcaggtgatccgcccacctcgccctcccaaaatgctaggattacaagtgtgagccaccgtgcctggccagaatatgttttcaccgaagacatctaacattgtgttacgtgttctttgttgatttaaaattgacacatggtgtattagagcaggaggaagttgattaagcttaataaaatatctaaagaaagaatgtgatacagaggcggtatttagaaaaagaaaacttcgaagcaatattgatagtcctaccaaatagtttacaggaggaatgagaaccttagctaatgtaccttggtgttcctgtaggattgtcaagtacaatctttttttttttttttgagacggagtctggctctggcacccaggctagagtgcagtggcgcgatgtctgctcactgcaagctctgcctcccgggttcacgccattttcctgcctcagcctcccgaatagctgggactacaggcgcctgccaccgcgcgcggctaatttttttgtatttttagtagagacagggtttcactgtgttagccaggatggtctcgatatcctcacctcgtgatccgcccgcctcggcctcccaaagtgctgggattacaggcgtgagccaccgcgcccggccgagtacaatcttttataaagaggtaaacacaaaattgtaatgaacaggcttagcatagccacatcccactggcaatattagctaatattatttatatgtgattatattattggaggttcaattcacctaactccctctgttctgattcagtgcttgctgaatacctctttgcttgtgatttggctttctagttgtagagctgcccacagcatgagaacaggctgaaatactgtttttttttgggcaattattgtaaatgaaaaaaaaatgttttttttctttaatttgtttcattaattgatttagtatgagcttatgttgcagagctgaaatctagttttggagtgttaacaaaattaagtttcccagactgtaaaagagggctggatcctggaccatggtcattttaccgaggcaattaatgtcagcagggacctctcaggggccttttccgttttcctaggtaggtgtaaactcaactctgcaatctctgtattttttcctaacatctctatagttgttaacgactaggtaacattctctctggtggctgtaatgcaatttacttaaccattttcctattataagacatttagatgatttctatgaactttttttaaaaaatcagattttttttgtctttttaagaaaaagaggatctagttcaccgaattctgaataagtttcttttgtgtggaacagatggaaatgttgggaaaaaaaagaaatctacacttttctgttgtcctaatgagtcagtgaacttagttggatagcttgggtagttcatactacctattgatatatacccccaaacagaaatcttcctttttttttttttttttttttgagatggagtcttgctctgttgcccaggctggagtgcagtggcgtgatctctgctcactgcaacctctgcctcctgggttcaagtgattctcctgcctcggcctcccaagtagctgggactacaggagcccgccaccacgcctgactaatttttgtatttttagtagaggcagggtttcaccatattggccgggctggtctcgaactcctgaccttgtgatctgcccaccttggcctcccaaagttctgggattacaggcgcgagccaccgcgcccggcccatactgaaaaatttgaagtaacagatgtattccagaccttgttgaataccaacacagtagacagtttgctattataacttctagcaatagaatgaagagatgccaaaaataaggattacctaagggagactactgactagaattagaagaagatgggaggcttaacattgggaaaccacagtgtttaaaggacaaacagaataaggactaggagctggggcatgtcagtgagagggtaggaaggagccaggaggccagggcgggctacccatcccctccatgcaccactagtgattactatgtcactaatccaacataggcttcacagtcctagctttcagaatgctctccttgaaatttcttgtctgttccttttttctgaagaacatgcatcctgaatgttggatcatgaaaagtcttgaatgctgtactagctcttcctggctaggcagtggggaaccactgttttttagtaagtcacctgaactcattaatgctctgatatatcactcgcctgaactcattaatgctctgattaatgactcattagcattgtaagaaatgggttgcaggcgggacaagcacctgttgggagggaaaggaatgtgtaatgtaaaacagtagtagtggtggggcatgggcacatttaagcagcagaggggtaggtgggagctggtggcaaggagtgggaagggagaggcaagatgacttcagattttagtttacttgattagcagcatagcatcaacaaatgagttgggcgctatgaaaggaaaagcagatttggacattgctgagtttggggagccaatggaatatccaggtgggaatttccattaggcagttgtagataaaaggttcaaaagctgaggaaagggtctggaatctaaatctgtaagtaatcacttggaatttatacatccttggttttctttcctattatctctaaattatttcactattgttaatatacgtttatacctctgacactgtatgctgattagatcctgccttagagatagctcccttcccctctttctctttacagctcacacgttttgctctacctacaattgtttctacctgttggtatgtttagttctacctgattctactctatccgccttagatatacagctctctctttccagttggaaaatgttccctacctccaaagtctttcacttttaacttgtgtggaagataattatcgtgctatttagggaaaaataatcaagtatgttaagaatgccttatattcagatatatttatagtagaagggaccagtgcatactgaatattattactctcctaggcactacggctttggaaccactactttgccttctggtcctaaaaaaaattatttttgatgtatcagaaatatacatgataacattttccttatgtaaataaaagctattaaaccttttttatatagagcagtggacttccatactgctatcatttgaatataaagaagcaattttgttaatttacctagatttagattttagatttgctgttttgtcatttcgtgcccttaggcaggttatttaacctatttgatctctagttgcttggtatatgggaggcatgcataatattttgctgtgactagtaggttaaccacattgtgaaggaatttatggcatgatcagaatgtttttttctctctctagatgttgttattcatgaggaccaatggattggtgagacagtactacaatcaacatttagcagtcagttattaaatcttgggagttattcatctattcagcctgaagaatgtaaggcacattttaaatgaagtaatgtattagtgtttaaagtataaaaacatactaggaaagattagagttaaaatggttcttttacaaaatgttttctaaacagttggagagtattggtttcttttcattagtaagaatgaaaatagaattttaagaaatgaacttgtacattgtaaatcacatttattttaagaagtattgggtatcatgtttcgttttcttaggctgtcagtatagtggtggttcttcaccttttagggagtcagagacctctttgagaatctatagaccatttctccagaaaactggacttatgtagataggcacaaaattttgcttataattctaaagcattccgtggacctctgaagttcttctgtggaacttctgagcctctgattaagaatccttgaggtaataaaaatgtattggtctcgtattcagacagctgtggtttgaatccttattctcctgtctaccactgctaagaaaagctatctttcttctttaatgtccagttttctcttctttaaaagaagctgtttaatgaggaaactagcagctatctcctccactaggaaataaaatgacataaaaaaaagaaagaaaacaaagtaagggaaacagtataaacttgtggttttggtcactggactcagatagaccaggatttgaatcctggccctcttacttccagtctttgtctttaggcaagttatttcacttcactatacctttatctccttttctgtgaaatggagataaaaatacatatataccttatagggttgttatgaagattaagtgagaaaatgaatataagatgttgaacctgcacataatgtagtagtaacatagtaatattagagggagaaataataagctagcaaaatatatttgataaaatgctgaagtatcatacaagaaaatagctagagaaatatactgattatacaagaagataactggaataataggaaagttataggatgtatatggaagatagagcatggaattccaatctttgaattcttaaagaaaggcagagcaagtagaagggaagagcaacaattagaataacaagaactgtgtttgggatgggcaaggtttcattatatactagggtggcccatcagcagaaaaccaactctgacatatttcatagacaactcaaatagagttcttcatctatccaatatatatttattatgtgttgacattgtttcaggcactgtgtttactgtacactgggggtacaatggtgcctgtcctcctggagcttatgttctcatgtggaagacagaccaaaaaaaatgaatgaaacagacatataagtaaaatatttgcaggtgataatgagtgctatgaaggaaactaacaaagggttaagatacagaatgccatggttctagttgagaaggattgatcatggagtagaatcagggttaggaagttgttacaatagctgcagttgagagataatgggaggccagtggagctaaagagccgagatatatttgtaaatagagttaataggattttctgatgatgtgggtctggggatcagggaagagggacaatctactgctactggattactggtttaagtaactaggtagcctttattgtgaaagactgagagggaactggtttgtggggaaaagggctatgtttcaaggcatgttaagttttagatatctttgagatattcaagtggagatgtcatataagaactggaaacaaagttcaggactcagaagacaggtttaaaattaagaggcaaattttagagttattagcatacagataatatttcaaatttaaaagtttttaaaataaatattatctgtataattatagaatcacaggggattgcaaaaataatacataaagtcccatgaactcttcttctagcttctcccaatggtgatatcttatataactttagtacaatatcaacaacaggaaatcaacatttgtataatactgttaactagtaatatactaggatactttccctttcagtatcaataaatatagtatcagcctggcacagtggcttatgcctgtaatcccagcactctgggtggctgaggcaggaggattacttgggcccaggagctcgacaccagcctggatgatatggtgaaacctcatctctactaaaaatatggaaaaattagccaggtgtagtggtgcacacctgtagttacagctactggggaggcttaagtgggaaagaaagttgaggctgcagtgagccatgattgtaccacagcacttctgcctgggtgaccagagtcagaccttgtctcaaaaaaaatttttttcttaaataaataaatatagcatcaatacagcattataatatgattaatactatatcaataaaatagatacttagtcctaatgccaatgtcttatttaatagaaaagcactcgaggcattgtcattaaaaccaggaaaaagataaggatgtccactatctctgcaactattcatcttatactagaattatcagctaacgcacttagacaagaagaggcatctggtctggtgcggtggctcacgcctgtaatcccagcactttgagaggccaaggtgggcggatctcttgaggccaggagtttgggaccagcctggccaacatagcaaaaccctgtctgtactaaaaagatgaaaaattagccaggtgtggtggtgcatgcctgtggtcccagctactcaggaggctgaggcatgagaattgcctgaacctaggaggtggaggttgcagtgagcacctgtacactgcactgcagcctgagggacagagcgagattctgtctccaaaaaaaaaaaaaaaaaaaaaaagaaagaagaggcatttgaacatttgaatggataaagaagaatgaaaattatctctatttacaaatgctctgataacatacctgaaaactccagggaatcaaagttaaaacaaatttaaataataagataattcaatgatataacaggatgcaaaattaatgttaaaaaatatcattaggctgagtgcagtggtttgcgtctgtaattctagccctttgggagatgaaagtgggtggacagcttgagcccaggaattcaagaccagcctgggctacaaaaaagaaaaaggaaaagaaaaagaaaaagaaaaaaatgctgggtgtggtggcacacacctgtggtcccagctgtttgggaggctgaggtaaaaggattgcttgagcccaggctgggggatgaggttgcagtgagctgtgattgcaccactgtactccagcctgggcaacagagcaaggccctgtctcaaaaaaaaataataataatagtaattagacaatatacacaaataacaaacagagggcataatgatagtgaaaaactcatttactatagtaataaagaagatagttcaaaatacagttaacaagaaatatgcaaagcctatatgaggaaaaaatttaaacactccagaaagaaatgaagacatgaataaatggaaagacatttcctgttcttggataggatgactcaacattataatgatgtcagttcttcctaagttaatatgtaaattcaatgtagttccaatgaaaatatatgtgttgtggcatataaaagttgatactaaagctcatatgggaaaacagacatgcaagaatagctaggaaaagactgacaaaggaaaactacagaggaggggaactagctttaccagatgttaaaacatactataaagcctctgtaattaaaacagtgaagtactgatgcatgaatagacaagtagaccagtggaatagagtaagaagattagaattagacccacctacatatagcaatttaatatatgacaaagatagtatctggaatcagtgagataaaagctaacttcttaataaatggtgctgagacaactgggtagccatttggaaaaaagggaaaattggacacgtatctcacaacaaacagtaataaacaccatatggattaatagtctaaatgtaaaaaataaaatcatgcaacaacaagaaggaaacctgaatgaatcctctgtaatcttggtgtagggaaaggctttttcttaatattactcagaatccaggggcagtagaagataaactgatacattttactgtagaaaaataaattttgcataaccaaaacactataaacaaagtcaaaagacaactgacaaacttggagaaaatatttgtaacatacaacaaaaggctaatatccctaatatataaagaacttttaaaccttgagtgacaaagtctgggtgtggttgttcacactggtaatcatagcattttggaaagctgaggtgggagaatcacttgagctcaggagtttgagtccagcctgggcaacatagtgagaccctgtctctacaaaaagtcaaaaaattagccaggtgtggtggtgcatgcctatggtcccagctacataggaggctgaggcaggaggattgtttgagcccaggaggtcgaggctgcagtgagctgtattcatgccactgcactctagcctggcaaaagggaaaatgtgaaaaagagatgaacagtcaattttcaaaaaaagatataaaaatggctatcaaatataacttattagagaaattcaaattaaaactacatggagataccatttctcacctatcagattggcaaaattaaaaaaaaaaaaagcacattctgttggcgcaactgtgaggtaatgtgccctcttatacattggtggtaggaatgcaaattgctacaacccttttgaagggatatttggcaatatctaacaaaattacatatgtacttagctttcaacctagcaatcccacttctaggaatctaccctgaagctacatctccaacaatatgaaaatacatatcacaaggttattcattgcagtattgtttataattgcaaaatatataggagaatgattcactaagttatggtacattcacatagtggaacactatgtactatgcagctgtacaaaaagaatgaaaaagatctctacgaactgatatggagtgattcccaggacatactgttatgtgaaaacataaaccccccaaaactgtatgtagtatgctgtccttcctgtaagaaggattggaggaataagaaaatacctctgtttatttgtggaaagaaaatgcaggaaggataaaccagaaactaaagagattggtcacctacagggggcacgtaggagaggggtggaagaaagtggggaatgggaacaggatagcaggggtcaggaggaagtgacactaacaaatgaatgtattattgttacaaatgaacccaatattgttacaaatgaataaaataactacacagaagggggtggggaagaaaagaacaaacctaagtagctgtggaaaagagtatattgactggattctataaggctaatgacagaaaggactgtacataaatgctgcaatctagttagaaatatgtttctcaaaggggaatggcttagcaataaccttatgtacatactagaatgaacaaatgagtacatagattgtagataaggaaagctggatttctcactgttggagaaagaaattataaacaagggaaggttaaaacgaaccagaggtattgttataaactgaggatttttaatatagataaatggatacagaaatataggcatgtgtatatgggtgggatagtacacatacataaacatctcctagttctgtccattgagcgagcacagcacagatgcagttactccccagtaataatgagcatacctggtgcccagatcttcgtctgtaaacattttcttttcttttctttttttttttttttgagatggactcttgttctgtcacccagtctggagtgcagtggcgtgatcttggctcactgcaacctctgcctcctgggttctagcaattctcctgcttcagcctcccaagtagctgggactacaggtacgtgccaccacgcccagataatttttgtatttttagtagagatggggtttcaccatgttggccaggctggtcttgaactcctgacctcaaatgatctgcccactttggcctcccaaagtgctgagattgcacgtgtgagccaccgtgcccggcctctctttttttgagacagggtctggctctgttgcccaggctagagtacagtggtgcgatctcggcttactccaacttccgcctcctgggctcaagccagcctcccacttcagccttccaagtagccggcaccataggtgtgcactaccacgcctggctaatttttgtatttcttgtagagactggatttcaccatgttgctctggctggtctcggactcctgggcttcagcagtccacccatcttggcctcccaaaatgctgggattacaggtgtgagccattgtgcctggccaacatagttctctaatgaaaggaaccagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttactgatataaagacatatttatttcattaactaaccagaggggaagagagagctcttccttccaatggaattccaattaataaatctgagagaaaagaaaaaaaaatagagaattactggccatgctcagtggttcatgcctataatcccagcactttgggaggctgaggcaggtgggtggcttgagcccaggagttcgagaccagcctgggcaacatggcaaaaccctgtctctacaaaaaatagaaaaattaaccaggtttggaggtgtgcccctatggtcccagctattcgggaggctgaggtgggaggattgattgatcccaggaggttgaggctgcagtgagccgtgatcatgccactgcacttcagcctgggcaacagagtgagactctgtctcaagaaaaaaaaaaaaatacaaaacacaaaaatagagaattaccatcaggcagagatcacaataataaatactgcaccgacacaaatgcactgatagatgctaaaattagtaggtgaaagtctgaggagagagagcattgcatagtctcaaagtatctccccaggataccagcttactagagggaaaataataaatttataagaaaactcttcagacaccaagttaactgagtgattggggtaaatatcaccagtaataagatgtatggtatcataaattctttgatattatccattgagaaggatccaccatattttttgtggaattgccaaaaatgcataacttcattccaatcataaaacactggagaaacccaaagggaaggacgttctactaaataaatgatcaggattcttcataagtgtcaaggtaatgaaaaagaaaagactgagaaactcttatagactagaggagaccaaagagaaataacaactaaatgtgaggtgggatcttggatgaaatcctacatagaaaaagcatattaataggagaattggtaaaatttaaataacatatacattttaattaacaatatttaattaacgttagtttcctgtttaagataatttataatatgtgagatgcccacattagtcgacatagtgaggaatataagggaactctgtactatttttgcaacttttttgtaagtcttacattagttcaaaacagagtttttaaaagagctgtatacgatcatctcaataggtacaaagaaagcttttgataaaattcaacacctgttcattaggaatagaataaaattttccttaacttcataaagagtgtctttagaaaacccagaacaattatcatcctaattggaaaaatattagaagcattccttttaaaattcaggaatatgactaggatactactattactacttttcttcaacaccatattagagttattaaccagtgcaataaacatggaaaaatagatatgtaaagattggaaaggtagaaataaaactgccattattatagatggtttacataccttttccctctgaaaactacaaacaaattatcagaaataatgtgaaaatttagcaaagtagctggatataagattaacatacaaaagtcaatcacatttctagagtagagcgactaacaataacaaaggaagctgtcattgacaacaatattattttgtactaatagtaataaatgtaacaaagtatgtgcaagacctaaaaaaggaaaaatttttaaatgaagaaaaactaacaaagaatgaaataaacatactttattcattaattggaagatttaacattgtgaagatttcagttcttttcaagttgatttgtaaattcagtgcatgttccataaaaatcctcgtaagatttcaagggcgcagtggctcatgcctgtaatgccagcactttgggaggccaaggtaggaggatctcttgaggcaaagagttaaagaccaataagattttcatgtaatttgataagattatatgatatttatgtagaagagtaagtggttgaaaacagcagggcattttaagaagaaaagcagggaagaataatttaccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtatgaatgatagctaaatggcttctaagtaaaattcagcatatcttgtagatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaatgatgtgaaaaatcttgaactaattagataatctttagaagttacttcacaatctttgtttttacacatacacaggaatttatggtgctttattttttacaagttagtagctaaataaagtatattctaaagttttttattgatgtagggaaatggctaccagtggacattttgagaatattgcagttgttttccttctgaaagagtaaaccgggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtggggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccgccgccgccgcggttgatgtggttgggccggggctgaggaggccgccaagatgccgcagtcaaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatctttaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttggaaataagaaagacctgcatatggaaagggtgatcagttatgaagaagggaaagctttggcagaatcttggaatgcagcttttttggaatcttctgctaaagaaaatcagactgctgttgatgtttttcgaaggatgattttggaggcagaaaaaatggacgggggcagcttcacaaggcaagtcttcatgctcggtgatgtgattctgctgcaaagcccgaggacactgggaatatattctagctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtgtttcttaatattatgaccaagaattttatcggcattaatttttcagtgtagtttgttgtttaaaataatgtaatcatcaaaatgatgcatattgttacactactattaactaggcttcaatatatcagtgtttatttcattgtgttaaatgtatacttgtaaataaaatagctgcaaacctcaaaaaaacaaaaaaaaacaaaaaaaagagtaaaccaatttggttactcattttaccaatttggttttgattttgcaagtggttacaactcatgagaggattcttatttctgatcaatatattgtgtttttggaaaggacttctgggaaataattatgatgaagccctcgagcaattgcaacaaaaccaaaaattgaaaagtgggacctaataatacttttttaaaatttattttttagagacaggatctcactctgttacccaggctggagtgcagtggcctgatcatagctcactgcagcctcaatctcccaggctcaagagattcttctacctcagcctcctgaatagctgggactacaggtgcatgcccccatgcccagctaatttttgtattttttgtagagaccaggttttgtcatgttgcccaagctggccttgaattcctgagctcaagcgatcctcttgtcttagcctcccaaagtgctggaattacatgtgtgagccaccactcccagccccagaacaactattattaaaaagtcaaaaaacgacagatgttggtaggctgtgtagaaaaggaaatgctcgtacactgttggtgggaatgtaaattagttcagccgctgttgaaaacagtttggggttttctcaaagaagttaaaactgaactatgatttgacccagcaatcccattactaggtatatatccaaaagaaaacaaattgttctaccaaaaagacataagcacttgaatattcattgtagcactattcacagtagcaaagtcatgcaatcaacctaggtggccatcagtggaggattgaataaagaaaatgtggtacatatacaccatggaattctacacagccataaaaaggaatgaaatcaggatggtgcggtggctcatgcctgtaattcccacactttgacaggctgaggcaggcagattgcttgagtccaggagtttgagaccagcctgggcaaggtggcaaaaccctgtctctacaaaaaatacaaaaaaattagctaggtgtggtggtgcacacctgtggccccagctatttgggaggctgaagtgggaggatcacctgagcccaggaggtggagtttacagtgagctgagattgtgccactgcattccagcctgggcaacagagtgacaccttgtctcaaaaaaataaataaataaataaataaattgcagcaacacagatgcagttggaagcaattatcctaagtgaattgagggaggaacaggaaaccaaataacgtgtattctcacttataagtgggagctaaacactggctactcatggacatagaggtgacaacaatacacactggggactactagagggagagggttgaaaaactacctgttgggtactgtgctcagtacctgggtgacaggatcacttgtaccccaaagttcagtatcacgcagtattcccaggtaacagacctgcacatgtacacccgaatctaaagtaaaagttgaaaagaaaagacttctgttctttcatctttatagtgaggtgttacatgttttacaaacctagttctgataatgtgacaggaatataaatttatcttgaatattattaaatatataagtcaaagatcaacacagtgtttccatgaggtagactttttttggaatctaaataaccatgtgtttccatgtaaatttttatgaatcagggacaaatatataatttgatgtcagagatgtttttgttccccaaaagctctatcttgttcatgaaaaacgaagcccagagaagttatgtacaagttcacagagctcattattgacaaaaccagaatttgaatacaactcttctgattccagatttgctggaaatactgtgaaagaagaattcagtctggtagtattacgtgtggttttaattttttctttgtaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaatcacaaatcagtttatgaagtctgctttctaaaaagtacttaagtgtttattgccaatatcttattttggtcagcaatcaatcacgtactcaagcatacttctcttaccttcagagaaattaaaatttaatcagcaaaactcatcagcctgtacatttaaaatatatgcatgttattgtacagaaactataccttaataaaaagtgagaaaaaaaaatgagacaggaaagagaaaaacatttaaaagacatagtaactgaagaattaaataaccaatccaacacttgaaaaatattacaatgtagcacatgcttaaaagctctctgagctcagggaaaaaagcagcactgtgaatctatagtggtcatcattctatgtggtattgggtaggacaagaagacagccttgcagctggaaattggtgaggacggaggcctcgtgtggaaagagtaaggcacactcagggagagaaccagtgaggtggctctgagcctgtttcagaaggggcttgaggaagaacggcagaggctaggatagttgggaaagcaggatcaaatcagactccagggattggggaaccaattggctgttacagggtggtggagtcaaaaaagaacagaaattttgtgtttggttaattgatagaaaatgatattattaacaaagtaaagaagtatgggaacagcacaagttttttggggatagtaaataattccatttccattgattaaaaatatcaagtttatttttacatctaaactgattcaagacttagctattgtacatgttttagagaaaacaaaactatattttatatctaatcatactttacaacataaaatacagttctaaaaaatattatttgtcaagaaaaatgtaatgttgccatcttttgtctgtatgcatgttttttttccttagattccagtgtagttagtgacgttgtacttcaagacttactggcatatgtgtcctcaaaacattcctacctcagagatcttcctccgagacagcctcagagggtgaacagtatagactttgtagaattggagcaccttcaacctgatgtgttagtccacgcagtactaagagttgttgatttcctatactgacaggtaaacattttgactgcctccttaattttagattatgaaaaaattaagatacaagaccatcttagtgtaccatttggttatcactatatatgtatcatcagctattaaagtatggtatcacgtgtgatagagtaatgccaactaagatactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaataagtcttcattaattaatggtggtgaaataaaggcttaaatttattcccagatatactactttacctttttagtgaagatcttacctccttcaaataatgttctttaaacatttaattctggagaagcttctacaatttttttttcagccagagtactctgataaataaatgctatgattataaggcagatgtcaagggagttaccttaactctttcaagtcacaattaatgttcaataaattacagtttcatatttttattatagttgttttaaaagcatgcactgttagccatccctagaatgttcagtgttaaaatatgacccatgattacatttttctttaaagcataaattatttctggtatattgaattaaatggaattgatgtttcattaaaatagtatagtgtcttccctttgctcttgtgagatcctttagttgtaacaatcaaagacagtttcatttgtggcttatgagttatttttccctgctaaattaatttagagattgattcagtatattattattttttacctgaaagagttaatgtctctccaaacttctgccttccaaatagttatttgtagataggatctatcacattgtctctcttaatcattaatagctatgactaggatttgagataagtctaactttggacttttatgttaagatcaaacagggacagatgtttggttgagcaagctgacaaacatgtatcagtgatagactaactatgatcattgaccaccatagcctggctgagaacatgagtctagtgcatgctacacaagaatgtaggtcacaggtatagtggagctgtaacagagcagattgctccatgtttaatgtgaatattcttttaaaattaatagttttttggttaatagaagagaaattacagttgtctctaggtgactctatggtgtttaggttagtattgaaaacgtatgaatccaggaattaagatgttgttgttctttgtacattcattcatccagccccccttatttgtaaccatcattttaaagttttaacatctacttcaatacctcacatcagtctttttaagataaaaataccaattttgaaggattacttaagtaattctattttcctgattttacttttcttttcaagagaccaaccccatttccaaattcccagcaaagagaatctgattgcccagagtaaatttgattcaaaaaactgtgatcaggaagacagggtcacgcaatacaaatatgagagcttgagcttatttcagtggatgggaaaacagttaagggaatcatttgtgatctgggtgaatacataaagatattcactaccaaaaatgtgtatgttcattagcttagaaagatatatgtaatgtattatttagtttaaaaagtagattataggccaggtgtggtggctcactcctgttaacccagtaccttgggaggctgaggtgggtggattgcttgagcccaggagtccaagttctcatcttaaaaaaaaataaaaaataaaaaaaattggattgtaaaacttcatgtatagaaaatatattatgttatcatataataaatatttttatgtttatataagttaatacacaaaaattttcaagaaaaccctttatatatgatagtatctcattttaataaaaatgtatctataagtacatatgtgcatttgaaaacctggaaatatgcatgtatagcaaaatgctagccgtagttatttctgtatagtagtattatatgtgctttaatttttttctttatacctttagtttgaatttcatatgtgtgtgagcatctgcatttacttttaaaaacttttattataaaagccttcaagcatatacaaaagtagagagaatactaagcataaggcactttttttttttgtttgtttgagacagagtttcattcttgtcacccaggctggaatgtagtggcatgatctctgctcactgcaacctccacctcctgggttcaagttattctcctgcctcagcctcccaagtaactggaattacaggcatgtgccatcatgcccagcttatttttgtatttttagtagagacgaggtttcaccatgttggccaggctggtctcgaactcctgatctcaggtgattcacccgcctcagcctcccaaagtgctgggattataggcatgagccagccaccgcacccggccagcataatgaacttcggtacctattagccagcttattaaaacatggtcagtcttgtttcacctgttacctccctcatctttactgtttaaatatttcacaataaatgtattttattttataattaaaaataaaattaaaaccttatgctttttaaaataaaagaatagttaatgtttggaaaatctagctaacaatgtgagaaaaaatagaattaaatttatactttatatttgtgccaatataaatttcagatacattagagattcaaatacaaaaataatgaaacaatgaatagtagaagaaaatataggcaaaattatttgtaatgcaaaggttggtagggtaaataaaatccaggaacaaaaactattatacataaaaaccaccatgtacaaaattgaaaggcaacaaaaaaaaaacagaaaaaaaattacattgtcagacaataatgcagtaagcaaaagacacatatctatagagttaaatggggaaaggatatgagtaggcaagtccccaaagaagaaataaaaatggccaataaatatatggaaaaattgttcttacaagtaattgaaaacacacaaagtaatgatgatagattatttttcttttaagaaattgattgagaagatatgggaaaacagctactgtcatcagctattggaaatgcaaactggcagaacctttcttgaggataactgacaattaatatgaacaaattgggggtacttttagcccaataattttagctctaggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataatacatacatataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgctttagttctagctagtgatgttctgtctttacagatttactgagatgtttgatgattttccaccaaaaaaaaaaaaaaatctttagtgaaagaaactaaggagatgagcaggtgtagtaaattagatttatggcctgaagtgagaaactaaaaagacagctgatgttatcagaaaaatgagtgctaagaaaccctcttttgttttattatagttttgaagttgaatttactaatacagaatatgataatacagataagttgaatttactaatagagaatataacagtaacaaggtctgtgttactgtggctttaagtattagaattgtggccggcgcggtggctcccgcctgtaatcccagcactttgggaagccgaggcgggcggatcacgaggtcaggagatggagaccatcctggctaacacagtgaaaccccgtctctactaaaaatgcaaaaaaaattagccgggcgtggtggcaggcgcctgtagtcccagctactccggaggctgaggcaggagaatggcttgaacccgggacgtggagcttgcagtgagccgagattgcgccactgtgctccagcctgggcaacagagcgagactccgtctcaaaaaaaaaaaaaaattgttactgagagttaaaaataagtactattgtgtctaaatgctttttgttctagaaaagttaactaagataactaaagtattgaaatatgagtgaaatattagacttgggttcatttcagtgtcctttctttaacaaaacaaaacaaaactttgcctatagatagatacatgagaattttctttacagaaagcagttggttattataaatgatgaccgttcaggagggcaaggaatctttagaaaatattttattaaaattatctctggtggcccggcgcggaggcttatgcctgtaatcccagcactgtgggaggccgaggtgggcggatcatgaggtcaggagttcaagaccagcctgaccaacatggcgaaaccctgtctctactaaaaatacaaaaattagccgggagtggtggcacgcacctgtaatcccagctactcaggaggccgaggcaggagaatcacttgaacctgggaggtggaggtttcagtgagccgagatcacaccactgctctccagcctgggcaacagagcgagactctgtcttggaaaaaaaaaataataataataatctctagcatgcttctgttgtcttaatgcaccattcatattttgtctctgtttacccaaattctttagtgataaaagattagtattcaactgacttaatcagatcaatctatttaatctgatactaagcctagattttttttcctttttggtgacttttgtttttactgtttttgtttaaggttatatttgggaatttaaatatctttttgttcagcgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggtaagatttttatatacataaattctgctatttttatttcttttgaaacagagtcttgctctgttgctcaggctggaatacagtggtgtgaacacagctcactgcagtctccacctctcaggtttaagtgattctccccgctcagcctttcgcgtagctgaggagggaagggaaggctagtgcataccatcagtgcatgccaccacacccagctatttatttatttattattttggcagagacagagtctccctatgttgcccagtctggtctcaaactcctggactcaagtgatcctcttgccttggactcccaaagtgctggaattacaggcatgagccaccacacccagcccactgctagttttaatataagcaaaaaggctaccacttgtggtaaaaatgtataagtctatataaaagtgaaatataaatctttgcaaatatctgaactagattccagtagttttaggaactatgtgctaggaaccagggacaaagagcaaatacctattttttattatatgacaagtgggagcagaaattcagatccttactttatcttggccaaatgccagattaaaatgttactagttgggttaattcacatatatgtgtaaatatgttttccaatatatgattgaagggttagcattgttatatcataaaactatgctaaggagaatacaggcagaaaacaaagacaatacctctcaaaaaacccaacttttaattgaatacagagatttcattctcagagaagaactccttattcttagttctacactgaaacatttactaataccagcagatagtttaaattaataatatttctggaaggtaaacacagatgatagaaaatttataagcttttatactataaaaatttcatactattttcaaaaatggaagttgcctatggtcataaaagactctagatttatactaactggtaaaatcttggtaatgttatagcatcatgtaagttcctaagccagttttatatttatgtgcccctcccgtgctctgcttctccaacttcacagacatatagaggtggtcaccacaggaaggaatgccagacacagttgaggggctaccttactttgcagagacgtttagtttggtgccatggagaagtcaactctgttatttactgcttacacaaaacagttatctgctgggattgaagtctagaattaggtttaaaaataaaaataaataacatcatggacaacaacaaaataggaggccaccacgctgatgatgaaagattctcaggctatagccccacttgtttgaggacgcagccaggaattgtgcatgttcttggaagtcctggaggtgtgctcctcattagcaagccatgccaaaactgtgccattaaaatcagtccttcagaggctttgttcacagaggcctgtttagcctttttcattctctttatgttcagctatgagggctgaattcatagtttctgtcatagtgtatgtgtttttaagacaaaaatggagagagaatatgaaaacacaagcaacttttccctaacctattttatagttaaataaaaggagaaagagagatcagcatgggagcatttcctagaagggtctgcttgctcaacaaaagccagagggggatgaggctaggcctgagtccttgtaaagaaatgaagacgcttacccagtacctcatcttaccgccagcagaatttcagtgctcagcggagtgacccccttgaaagcaaagtccacattcagcgtgaccttttaattcttttcaagagttgtgtaaatttacaaaatgataggattatgtgaacattcttttaaaattattgaattattacgaattttttaggctgggcagggtggctcatgcctataattccagcactttgggaggccgaggtgggtggatcatttgaggtcaggagtttgagaccagcctggccaacgtggtgaaaccctgcctctactaaaaatacaaaaattagccaggcatgatgtcgggtgcctgtagtcccagctacttgggaggctgaggcaggaaaattgcttgaacgcaggaggcagaggttgcagtgagccgagattgcaccactgcagtgcagactgggtgacagagcaatactctgtctcaaaaaaaaaaaaaaaaaaaaaaagactttttgagtggagggaggagagcaagggttgaaaaactaactgttgggtactctgcctactacaggagactacttgggtgatgatatgcccatgtaacaaacctgcacatctaccctctgaatctaaaataaaaatcgaaatttttttttttacatatttttttaggccagacacattggctcaagcctgtaatcccagcattctgggaggccaagaagagtggatcacttgagcccaggagttggagaccagcctggtcaacatggcaaatccccatctccacaaaaaaatacaaaaattagccaggtgtggtggtgtgtgcctgtagtcccagctactcaggaagctgaggtgggaggatcacttgtgcccagggaggttgagactgcagtgagtcaagattgcaccactgcactctagcctggacgacagagtgagactgtctcaaaacaacaaaaaataataattttgtagtgatttaacatgtctttggaaagatgtggtattgaatcttctacagtttgttacatattcgatcgctacgcactcctgctaactcatgtagggatatgtgacacaattggaagagatgatgaaaccgtctttgggcattgaaagactaaagcaaatgaagttaagaacagaagactcatcattaactggactctgaaagagataaccagaaaacagtaggagactagagtgattagttcttgacctggagtgttcttacttctaagtggatgaagaagaacaaatttgaaggcttaaggcttaaagaagcctttaaattgactatggagaaagggagaataatgctcaagaaaactcatagacctcaccagtacacagtaagacaaaagtaaattaggaaaaaataatgtctgggagatagtagactttcagtatttgtttactggtgaatggatgagccattagcagtgaattatgaatatgcttgaggtttcttgtgagtcacctgagaaacgattaataaatgagaactttttataacccacagccagagtatatagatgataatggtgagcggaaagttggaaaaaagtttaaaagagaacaggctattgatatttttacgtagagagaagaagaaaagttcacctcctatttggctttttttttttttttttttgagacggagtctcgctctttcgcccaggccggtgtgcagtggtgtgatcttggctcactataagctctgcctcctgggttcaagccattctcctgcctcagcctcccgagtagctgggactacaggcgccagccaccgcgcccggctaattttttgtatttttagtagagacagggtttcaccatgttagccaggatggtctcgatctcctgacctcgtgatctgcccgcgtcggcctcccaaagtgctgggattacaggtgtgagccactgtgcccggcccctatctggcttttcaccatgatcagtttaaaagaagacagggcaaggagagagggcatgttagctagtttcaagtattcgaagggatttcttctaaaggaggtattgaacttattttgcctgattccagaggatggggaaggaaggaaacatcacatgttcagccaaattagccaagtaaacctgctctcagttgcagccagacctccctgcccttagattctaggaaaatagtaaagaagacgaagaacaagacctcagtgtatccttttactacaagtgactgtaaatcaactataaaattagccatgtttgtaaattaaagttataattttggcccaataatttataacatatctgtttgttgtttgtaggagtggttctaattaaagcccagatttcagagctggcatttcctcttacagcagctcagaagatatctctaaatgctcacagttctctgaagagtattttttcttctcttcccaacatcatatatactggctgtgcaaaatgtggattggaactagaaacagatgagaacaggatctacaaacaatgttttagctgcttgccatttactatgaagaaaatatattataggtaaggcaactaagcaagccaatttgatggaaaataattattatagatctggaaaaactagtctgtaaactcttactttctaaaaagaattaactagagctagtcgaagagaataaaattttccctgagtgatagatagctatttatggtagcaaaaattacccaggaatcgttataggaatttcttaaagataggaatttcttaaagcagtaattgggagattttattgtcttcaaacagctgtaccaaagaaacattttccttggtttactttttaaccaaaatctaaatgctcataaataactcattttcccaccttaacatataattagaatttaaaggctaaaagtatcatatgatgtcacctctgagttgttgtggaagctagtaagacatttaagctgttttcccacctttaccttagaaattaaagccagcaaataaatgttgtatggtaaaactgctaatcagctcagtgaaaaacacattgttttttgaataataggtagtcaaaagctcagacatttttctctttaccttataaattacatgtgtttacaaaatagcactcagtgttttatgctccttatgattatttctaaatattgcggtatctaaaaactaaattcagatatattccacatgttatcatggcatacttcaagaaaagttatagaagcttaatttgtaaaccttatttctctttacagatattatgtttgttataaataagtgaatgaattttgctattactgtgaaagttgcttttgtggaaaagaagattgaattaagatgtatggtaggctgggtgtggtggctcatgcctgtaatcccagcactttgggaggccgtggtggggggatcgcttgagcccaggggttcaagaccagcctgggaaacatagggaaaccccatctctaccaaaaaaaaaaaaaaaagctgggcatggtgacataggcctgtagtcccagctacttgggaggctgaggcaggaggattgtttgagcccaggagatcaattgttacagtgagctatgtttgcaccactgcactctagcttgtgcaacagagtgagaccctgtctcaaaatcaaaacaaaaaatgcatggtatgtaacaaacaacattgatttattaatagttaaggcccctcaaaagtatgtataggtgacttatttatatcattccaaatgtttctattcaatataagcatttattggacaaaaatactgctcaatactattccttatggggaggagggcctttgaatctttagtttacaaaatgactgttcaagagaaggacttcacagatcagtatcacctgattatggcataactagtatgaggtatttaagatctcttcctaaactataccacattaaagatgtagtgctagtttgttgtcttactagaatgttgaatggtcatgttaaggcaagaattattattttttatttatttaaaagccttttttttttattttttgagacagagtttcgctcttgttgcccaggctggagtgcactggtgcgatctcagctcatcgcaacctctgcctcccaggttcaagtgattcttctgtctcagcctcccaagtagctgggattacaggcatgtgccaccacgcctggctaattttgtatttttatagagacagggtttctccatgttggtcaggctggtctcgaactcctgacctcaggtgatccacccgtctcagcctcccaaagtgctggaattacaggtgtgagccaccaagcccagcctaaaagcctttaaattattagagtccagattatgtggtttccttggaaagaaaatattgaaattaacaaactcccttcaagttatcaagtatgtgactccaaaatcatctatataaatcaatcagcaaactgaataagagaaaactctcattgattatttttctaagactcagtcaaatatttattaggaatccacgtatgttcacatatcacatgtgtactgtggatgttatactagttgatctaagtagacttattgtgcccaagaagcttggtagtccatttaagaaacacttaatgaacatttgtgtggcacaacagtcccaaactatgagtgggttgatcatattttacattggttgtaacttggagctgattttccaatggaagcaacattagatattgcaatggagtctcatacgaggccacagacatttattaaattaacatgtagatagcatagttcctgctcttcaagctatcataaaactcaaataccatttttaacaatgtttctacagaatattcagatttacatttttggaatacaagaaatacatttatttttctgtactggaagcaaaaaaccccagcaggtcaaaccacaattaaggctcctatttaggcagcactaggaaatgtttgggtctctcaagaggttgtaatcaaggtgtaggctggggctgcagtcatctgaaggcttgactggggctggaggattcatttccaaagtggctcattcatatggctgacaagttgagttcctcttcacttgggtgtctccacgggctgcctgaatgttctcacaaagtggcagctcatttcctcagagcaggaaaggcaagaaagagagttccaggtggaagccagcctttttgtgacctagactcagaagtcatgtggcatcacttctatcaaattctgttcatcagaagtgagtttagctgtgcgttggagagtggattagaatgaagctagtgcagagaagcggtaagaggctgttgccttattttggaggggagatgatggtggcttgactagagaggaagcggtaggaataaaaagaagtggacagatttgagaatggtcggaaaatagtttgcaagatgtagtgattggtaggtaaagagagagcacaggtacattgcaaatcattgacagttgggtgaacaataagattatttattaaaacaagtaaccttgggagaaatcttgatcatattgagcttgagttcctgagaggtaacaagttggaaagtggttagatgtaaagaaatgcaatttgcaagagaagtctgggctaggcttataaggttatctgtggtgattgaacttttccttggtttctgcaccctgttttgtttttccttcttaatcttcagtgattacctctcataatggattattcttactagcctataaagacagtcccatatttctcttattaaaaaacaaacaaaatcatccattaacattacatctccctcttatcccttcgtttttctattctgttttatacccagccaaactttgttaaagagttgtaaatatactctctctcccctattatgtcttcagtttcacttcagttattccattctactcctaccatgctgcagaagctgcttttgtcaaagttacacttttgatgttgcctgaggcatggatacttctttcctcgctctaactgctctcagttatattcagcatgtcagtccacttcctccttcttgaaacagcctcctccttgctttctaacctgtctctcaggcccttctttctcagccttttctaccccctctttaaatgctggggttaatcttgagctctcgtctgtgtccttcctcttattctttctgtacattctgcctggatgatcacagctgttttcgtatttgtacttaacatcttcaccctgattttctcctccaggctccagtagtcaggtatcaaattctttgcttgatgtccatctcacatttaaacatacccacaatagactcttgtttttcctaaaaccacactcaaatctagttctcttcgtttttatactttctggaaaatggcacaccatctacccaattatttaggctggaaacctgggcacaatcgttgcatcattttctcttccctacctcccctatctaatctattagcaagtcctaggaattttcattcagaactatatcacaaattcatccacttttttccatctccactgctaacatcttagtccagtgtatctcagcaggggcattgttgacatttttctcaggacagtttctcattatgtaccatatcccacatgctgcggggcatgtggcatccctgtttaccttcccctagctgaacctcaattactgtgaaaccaaaatggaaagtcagtgcctgctggtctggaatcactcaggcctcatctgagtccctactacctattgcgcaaaccagcacaccagcagtctcttggtggggctcctcctggccttgcctcctcccctttattctccacccgttggcagtgtgattaccctttgcttcacccatcagtcatctccttgtgcttgtttcctctgcagtctcatctgctgccactcccctgtcgtccagcactctagccacgtggccttctttcagttcttcagacattttgatttttctccttaggatgttctcgaatgtcttccctctgtctgactccacaaggctggtttcttcatgtcttagattaaatgctgctctatcagagaggcctttcctaaccacccttctttattttctgttatagtagcctgggtgtgcttactgtaatttgtatttgcatactgtcttttctaaaaaacatttttactgaagttaaaattcatataccatcaaattaatcttctgaaatgtacaattcaatggctgtagtatattccaagggctgtgtagctatcaccacaaccagttaggacattttcattacccagccctttacaaagcctcatactcattagcagtcactctccattccccatgcccctcaacccatggcaactacgaatctgctttctgtctctatagatttgtctgttctagatattttatataaatattatataatatgtgatcttttgtgactggcttcacttagcatgatgttttcaaggtccatccatgttgtagcatgtatcactacttcattcctttttattgcaaaataatattttattgtatgcacataccacattttatttatccattcatcagttgatggacaattgggttgtttctactctttggctattatgaatgatgctgctgtgaacatttgtgtacaagtttttgtgtggatatgtgtgttcatttctcttgggtatatatctaggagtggtggaattgctgggtcatatggtaactgtctgtttaaccttttgaggaactaccaggctgttttccaaaattgctgcacaattttacattctcatcagcaatatgagggttgtaatttccccatattcttgccagtacttcttattccgtttttctttttgttgcatgtgctttcgggtcatatctaagaaaggtgtcatttctaagccaaggttatggagatttgctcccgtattttcttctaagagtttagtagttttacctcctacatttaggtttattatctactttgagttaagttttgtatatgggataaggaaggggtataattttattttttggcatgtggatatctagttgtcccagcatgaatttttgaaaagactgttccatccctgtttagtcatcttggcaccactgttgaaaagcttattttctttcttcttctttttgtagagatgaggtctcgttgtgttgcccaggctggtctcaaactcctggcctcaagcagtcctcctcaccttggcatcccaaagcgctgggattacaggcatgagccaccgcgcatgcccaatttcttcctatccctctacagttttacgttccttgagtgacggaaccagatttgtctttttcactagtgggtacccagcacttaccacagtccatgatagatactcagtttgtatttgttgaaataaataatggagggagagagaggctgaggaaagagtgtagagtgaaaagaggaaggaacatagagtcatcgtgtgaataaagggggaagtgggtttttagggggaaaatcagtagttatgttttagctctgttacattaaattcccccgctaatgagcctgtttctgaattctgttctcaatttattttttaaaaatcaatgtagttataaaataggtaccacatgccatggttaaaatgcacactacataggaggttataaaacaaagagtgaaagtctccttcaccatccaaccctctcccaccagtgctgcttccatgctggtgagaaggttttttgtatgtccttccagtgatttattatgttcatcccagcacatgtgtatccctttctttagaagcatgtggacagaagaatattgttcatattgttgttccctagagtctatcctggtgctccttccctaatagcacttgcaaatgttcttcattctttttatcagctacatagcattaagatgtaggatgcactgaaaattgttaatccagttttattgatatgcaaaacagtttatttctgataggaaagaattcagttgaaaaaagtaacttgaaattgtgattgtgaaatatgtgattattatttttattttcatttctaaaaataatttataaaacagtttaatatatttttatattagtatctgaaatttaaaaatggatatagaataaataaaatgtagtaatttatcatttgaagctcttggggaaaaaaaaacctttttttccttctaggatgtcacagaacatcctagagttgttttaagcattaaaattaatcctgcataaaaaccaagtgctttttggaattatttttcatttaagcatttcttttatttgaaaatctttttgaaggtcgtgtgttgtttactcttctgtaggccagcgttaatgactgccgttgatggaagacataatgtttacatccatgtagaatcaaagctgatagagaagattcttctcaacatttctgcagactgcctcaacagagtgataggtaatatatcagtgtgccatcaagaagttgttttattcaggagtataaatggtatatcagaacagaaagagcactgtactttaaattaagagcttttctgtccatatgaaaacagaaggataatttagcttaagtgaaatataagcctatgtaagttagaaggttgacttgctttacacctgttagtacatgaacagcgggaggcacctaatttcttcttaacctacatttcctgttggtaagcaaaaactattttacttaactctagttttataagaatgaagtcaatgagtgtatgacataatatatatgaagatagtccagtgtcagtggaatggatttgcaagatcttcaaccatgatgtcttagttgtcagtggctaagaataaagcaaagataatatatttgtcaggtattcaaactccattcctgttctcattagcctcagatcctctaagctgatgagctaatctggttctgtgattgctttatctttcaatagtagattgttttttgtgtttttttttagttgggggtgtctagtaattttgagttgaatgctgaacgttgcatatattaagtagaacagtacaaactgaggtaaatagtagttgtacctggaaacaggcatgcctcttctggtcctttactggaggtgaggggtgagcaggatggtcagccttgtcataagttgagttggattcaggttttgttgtttctctggttaccttcaggtcaccactggtttcaaattatcttgtgcttatggtgggaagtggttccccagtattcctgctccaccatcagcatagccctccactctgcacctgggcctcagagaaagtttctttccatattcttgcacctccccaagttgcacaagcttttgttggttgttatttggtgcatcctaacctggtgggtgggagcagggttgttcctctttgattctggtccagccccagtcttatacggatgttgcacatggcgctttcttggtagccctgtcccttatgtggcatggcagctgagctctgtcttgtgcctttagtgggtcttgtgtggtcctggccctgccccagcagtaggggaccactaatggtcttgacccagggtggtttttcagtcctcccccaggatggaggtttttttttttcttttttctttcccccatctgtactggttcctcacctgtaccctggggcaacaggatttggtgtccctcctccagcaattgaaggcttttgttccttaaaggggaggccagatggtgctttgtgttttgtagttggaagctttctctgatgtcttgccctgcccccagtcttatgagcacctggtggaggtgagacgtactatgtggaagagcctatgaggatgcagatgttccttatgttgctgacactggcagttcattggctttttgcaattaatttattaataaaaattaatcacattcttctttcctgcctgtatggaggacctgtcttcttcccaaggcctgccccaagggaacctgtgctcctgttccatctccctggaggcacctgtctccttatgtttcagtctttttggctgttttacaaccttggttctcatgtgtattcaagaaaatgatgattttatatttattcagttttttccagtaactgttagggtaggagccactttttccagctttctacatcttaattagaagcctctctccgttttttcccccattttctttatttcatttttattcttttggctattttcattccttttcttaatgttacttatatattttcagtgttatctcttctttttttttttgagatggagttttgctcttgttgcctagactggagtgctgtggcgcgatctcagttcaccataacctctgcctcctggattcaagcaagtctcctgcctcagtttcccaagtagctgggattacaggcatgtgccaccatgcccggctaattttgtatttttagtagatatggggtttctctatgttagtcaggctggtcttgaactcccaacctcaggtgatctgcctgcctcggtctcccaaagtgctgggattacaggcgtgagctgccgtgtccggcctatctcttcttttttgcataatgtaaattagtctttatctcttagagaagcataattctcatatcacatatacttcagtgttttgtccattcttgagacaattaaagttgtacttcttggcattaattagattgtgatcataagtcaaaatgtcattggtcataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacagtctgagcatggtcgatggtgctctgtcattctggtattgaacaacctcccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcactcgtctgatgtactgcagcataaccagaactgctgttggtctgaacggtgtgttatctgggcctgtttcttgtgtcagggggatcacatgctgtcactctggagtgcctcaatagcttgtaactagaaagagaaggtatagaaagagtagtttacttacctgtttatttatttagaggcagagtcttgctctgttgcccaggctggagtgcagtggcacaatctcagctcattgcaacctctacctcctgggttcaagcaaatctcctgcctcagcttcccgagtagctgggattacaggcatgtgccaccactcccggctaatttttgtatttttagtagagacagggttttactgtgttggccaggcatgtctcgaactcctgacctcaagtaatccagccacctccgtctcccagagtgctgggattacaggtgtgagccaccgctactggccgggaggagaaatttaaaatgggtttgagacttgaggaaccaaaagaaacaatgaaaccattcaatgtgtgtgctcctgtcaagctagcagcgatcttgagagctctgtgttttcgtcttctgcagttccttcctcagagatcacctatgggatggttgtggcagacctgttccactccttgttggcagtcagcgcagaaccttgtgtattgaagattcagagcctttttgtgttagatgaaaacagctatccattacaacaagatttctccctcctggatttttatcctgacatggtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttcttctggagaaatgatctaccagtcaaggcaatatgtagcagatccctgggaattaaaggtttgcccatttgttcactgtatttagtccctgctacattccaggcatcgtactaagtatggggaaccacagagaagacactccttcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaagtgaaggaaatgagatcatgtttcaatttattaaagcagggaagagcgttctgtggttagttcgtgtctaggatttgagtgccttactgaatgtatttaccagcaaacatgtagcaatctgttctctcattgtgattgtggaagaagctcatgtaaaatgatagtcattaatgaggaagtatggcgtggtacttattctgtaagttcagagtatgctgagtgttaatagattgtcatattgcctgaaaataaattcatgatgacatgaa

SEQ ID NO: 2221 - DNA, 18506 bp, Homo sapiens
gccaaactgaagttgctggcgtctatcttccacgagaaccaggaggctcagctgcggctcacgctccactgcaacatgaggtgaggcgcccggcggcggcctcgcggggcaggaagagggcggagagggggtgcccggagtcccgggacaaaggggaacctgccccggcgaggctccccgcccctttctcccgcaactggcccggcccgccccgggactgcgcgaggcttgggtgggaggaggcggcgggcgcgtctgtctctccggctcctcgcatggggctgtcttgggggccactggcccctctcagcccccgtcgccgccccccgaggtgggagcccgcggtggcgggagccctctcgggacccatggtcgccctcagtcagccggcctgctccggggaccgcgacagggcggggaatggcggcttttgagcccaggcggggaaaggcaaaggcctttaagattttcggtgttcgaaaccagcctggctaacatggtgaaaccctatctctactaaaaaatacaaaaattagcccggcgtggtggcaggctacttaatcccagctacttgggaggcagaggcaggagaatcgtttgaacccgggaggcggaggttgcagtgagccgagatcgagccattgcactcaaacctgggggataagagcgagacttctctcaaaaaacaaaaacaaaacaaaacaaaaaaaaacaactttttttttttttttttttagacaaagcctcactctgtcgcccaggctggaatgcagtggcgcaatctcggctcactgcagcctacgtctcttgacagtccacggattaaagctattctcctgcctcagcctccggagtagctgggattacaggcgcccgccaccacgcctggctaacttctgtgtctttagtaaagacggggtttcaccatgttggccaggctggtctcaaactcctgacctcaaatgacccacctctgcctcccgaagtgctgggattccttcaatccaatcaagttgactctgagtattaaccatcacaagtgtcttcagaattgtcattcttttctgctgtggcctccctctcctggtttgcagacccatgctccgcctgtgacactaggatggggaggtgctggcaggagagctttctagctcctgagttaaaaggcagagatggagtctgttttaagattttgctgctgtgttgagttatattaaaaaacattttgtcttttccctctggttttcacactcatagtaagaggccatcaagataggcttcttatatgggagggtgattcttaccaactgtagttgggacaagaacggtaaagaatgttagattcttctggaaaaaagtggtccctccattatttggattgggtttgtggccttctcaagcccagcagtctaattccatctgctttgtgtcttccggcatgtccctgtagttttggttcactaagggtattctccttgtatctgttatttttctgctgctgtgtcagacttattctgtttagtaaaatactgtcattttggtgggattttggaaagaggaccaggccacatcttgaaattcatcttaggattttacaaccctaactcactttttgttttgattaaattaccctttttgaggggtgggggctcagctttatcatttgcaaaatgaaggatagtaactgggctgatggttacagatgtggatgcgtgtcagaatcacctcagagagctttttaaaaacacattctccccagcactttgggaggccgaggtgggcggatcatgaggtcaagagatcgagaccatcctggtcaacatggtgaaaccccgtctctactaaaactacaaaaattagctgggcatcgtggcacgcgcctgtagtcccagctacttgggaggctgaggcaggagaatcgcttgcacccaggaggcggaggtggcagtgagccgagatggtgccactgcactccagcctggcaacagagcaagactccgtctcaaaaaaaaacaaaaccaaaaacagattctctgggtatgctttgaaatgagcatttcaaaaatgctctttcaatcactgatgcaaccaaagtctttgggacttttaggctaagaatatattctttagatacccagaatagtttaatgtggagtataacaatttagggaaatgaagaagggttgaattacattttggaagctgctgcttgcttcctttttccatttagtttttagaagacaaagaatgtctaaagagatacagatttaaagcaaatataagttaattcttcatgggtatgtttatctacatggctttctccagctgactgatccagaagagttctaataccctctgtgatcatgggtttgtttttcttaagaattactccatcagagtatctaagaacagatgcttagatactgctgagacctttgttggtcttacttgatctctgaatcctagttttttgatcttctacatattctgggttttaacctgtactggccttcatggttaaagaagcatttatatactgtgcccaggccaggaagcttatcttttgaactttgcccaaactgtgtatgaaggcccttcttaaaaccccattaaattcatttctaaacttgatcattgtaaattgtgtcagttggtaaattctgtcttgtagggaggtattttgtagtaaataacatgtttttaaaactaaaatttgccttttagtaaggtggtaatcatttcataattcttagttttgtcaagtgtctataaataacacatctgatcttttaaaatgtaaggcaattgaatttatgtaatgattcaggcttttcaaagttaaaaaggtagttattttaaggaatggatagtttgtgatatttattttaaacaaaataagccattgatcttatacacatagccatgtaagtaaaatgttttcttattttaaattagattacattttaacatttttttcggttttgctttgtatttgactgattgcttttctttattcctaattcttttattctttgttccgtttttaaaagctgataactgttgtttgtcaaatcaaagttggatttaaaaataaacatttaattttaataagctctctgctagtggcactgcagtgacagatggttgagagtttgtccctaaagctatggcaccggtcttctaattgactcaccctgtattcagcctgtgtagccctggcagattctttctctgtttcagaatgggacaacagaagaagtgacttcagaggaagaggaagaagaggagatggctgaagtaggtattttatataagaatgacatttcataaatgtcgtcatttttgatttgaggaattctctaaatctcctttgtaaactactattaatgtggaataattgaaagcacattgtatttggaatggaatataatttctcacctctggctttacctctaactgatgatacatctttgagaaaattgctttatctgaattctttggatttgattttctggaaaacaaaagctcttaacttttagcaccaaagttgtacttatatttaatactaatcagtccttaacctgtatttggttatttttaggaaaaggaactactaagtttaaaaaatgttatgtttgcataaaaggagaatttgagaacatgttagggactactcaccagaagtagtgacactgtctcttgttgaaaaatcatcaaggaattttctcttagtctgttttatgctgctataacagaataccagagactgggtaatttataaagaacagacatttattttctgacagttctggagactgggaagtccaagatgaaaataccaacatttggtgtctgagggccttcttgttgccacctcacatggtagaaggcagaaggcagaagggcaggagagcaagctagtccaatgtgtgaagcctcattcatcagggccttaatcccattaaggaggaaggagccctcttggcctaatcacctcctaaaggtcctacctcttaatatcatcacattggcaacacctgaattttggagggaacacattcaaatggtagcaaatttagtagagcacattccaaagacattgagcctaggccagttgtcagtcatgggtctaattttagacattttcaggctctgaagctttgcatttaaattcaaactccggaacaaagatctgtgtctctgcattgaccaaatagaaggtatgtgaattttatggtcttgatcgttttacaagattttttctgtttggggtcttataattaatataggctttcattttcttggtttggaaattattaatctaaaatatactttacagtgcttcagaactaaagaagtagtgttgtgggcttgtttttgtttgttttttttaagatagggtctcctgtcacccaggctggagtggagtagcatggtcacggctcactgcaaccttgaactcccaggttcaagcaatcctcctgagtagctggaactacaggcgggtgccccacgtccagctaattttttaaattttctgtagagtttgagtctcgctctgttgcccaggctggtcttgaactcctggcctcaagtgatccaccacctcggcctcccaaagtgctgggattacatgcgtgcaccactgtgcctggctgtaggcttgttttataagtctgggagtaaaatacttcttaaaattgtccaattagaatgagagtttaggctgggcatggtggctcatgcctgtaatcccagcactttgggaggccgaggcaggtggatcatgaggtcaggagatcgagaccatcctggctaacaaggtgaaaccctgtctctactgaaaatacaaaaaattagtcaggtgtggtggtgggcgcctgtagtcccagctacttgggaggctgaggcaggagaatggcctgaacccaggaggcagagcttgcagtgagctgagatcacgccactgcactacagcctggatgacagagcaagactctgtctcaaaaaaaaaaaaaaaaaaaaaaaaaaaagaatgagagtttaatgtttttatgcagtttagctcaggtagaataaagtgcaagaaaacattgaaccttttctgtgggtcaggaagccattgtagtaaagatcatgaaccctttcatcttcccctcacaaaataataaacaagggactgcaactttgagggaaatctagaaaggtaggagactggactttggagatgtcagattaggactggtgaaaagcagatattctaggctcctaaaataacgtgggaacaagcccagaacaaccttggacatggtgtgtttgtgcatgggatgcttttcttttgagacggaaggttgatgtgttgaagtcatggaaagtgttcaaaatattgtgagaattaccgaaatgtgacacagaaacatgaagtgagcacatgctgttggaaaaaaatggtgctgatctacttgcttaatgcagaggtgccaaaaaccttcagttgtaaaacaaaaaacaaaacaaaaaaaacaaaaaacaataataaaaaaaaggaaaactgcaatatctacagagtacaataaagtgaagcagaataaaatgcagtatgcccgtatgaaagattatgatgtcggtgaacaaacagttgtatgccttcctttccaatgtgtatgccttttattgatccttgttgcttaatcactttggctaggacttctagtactatgtgggaaaaaagggacgagtatgagcatccttgccttgttcttcatatgagggggaaagctttttaccattaaatatgttggtgtcgggttgtcataaatggccattgttaagttgaaatatgttcttatttgtttgtttattttaactagagatagggtttcactatgttgcccaggctggtcttgaactcctgggctcaagcgatcttcctgcttcagcctctcaaagtgctgggattacaggcgtgagcctttctgagcgttttttcatcatggaaaggatgtcaaattttgtcaaatgctttttgtgcatttattgagatgatgatatgttgtttatcttttatgctgttaatgtgacatatcacaattactgatttttgtatgttgaatcattcttgcatcccagggataaatctccttaatcatggtggtatgatatggatttggtttatttggccccactaaattttatgttgaaatttgattcccaatttggtagtattgggaagtagggcctcatggcaggtgtttggggtctcatgaatggcttggtgccatcttgcaatagtgagttctcatcttgcaagactggattggtttttggggtaataaattagttccccttggagtaggttgttacaaatccaggataccccttgggtttgttctcatttcacatatgcccgcctcaccttttaccttcttcaccatgttttgacacagcacaaaagccctcaggagaagcagatgctggcatcatgcttcttgtacagcctgtagaactgtggccattttaatgcggtattgaatttggttttctagtcttttatggaagatatttggatctgttttcatcagggttactggtctgtgattttctcttttttgtagtgttctggtttggctttgatatcagggtaatgctggcatagtaaaatgagtttggaagtggtccatcatcttcagtttttttgaagcaattgggatatactgacattaattcttctttaaatgcttgatagaattcagtagtgaagccatatgattcttgtgcctcagcctcctgagtagctgggattacaggtgtgcaccaccgcacctggctaatttttgtatttttagtagagtcggggtttcaccatgttggccaggctggtcttgaactcctgacctcaagtgatccactctcttcggcctcccaaagtgctgggattacaggcatgaaccactgttcctggcccatagacttctttttgatggagattttaaacaaccaaattgatatccttaatcattactggtatgtttagtttctccatttcttcatgctttggacttggtaagatatggtttctaggaatttacctacttttttaggttatcttttttatggcatataattgttcatcatagacccttatggtccttcttatttctgtggtattagttttcaagtctccactttgatttatgattttgtttatttgagtcctgtcacattttatcttagtccagcaaaaggtgaattttgtatgtcttttaagaaacaactcagtttacttttctgttgtttttctagtccctacttcatgtttttcagctctgatctttaagatttccttcttctttctaacattggagtttgttcttctttttctagtgtttgaggtataaggttatcttacttatttaatatctttcttttttcttcacgtaagattttatcactaaaagtttctctcttagaattgcttttgctgtagcccataatttattatttatttatttatttatttatttatttttgggatggtgtctcactctgttgctcaggctggagtgcagtggcatgatctctgctcactgcaaccttcgcctcctgggttcaagtgattctcctgtctcagcctcccaagtaaatgggattacaggcacatgccaccatgcccagctaatttttgtatttttagtagagacaagatttcaccatgttggccaggctggtctcgaactcttgacctcaggtgatttgcccaccttggcctcccacagtactgggattaaaggcatgagtcactacacccggcctagcccataagtttttgtatgctgtgtttccattttgatttgtatcaagatctttttaaatttccctcttggaaaatttaccacttaccctttggttgctcagaagaatgttgtttaatttgcatatatttgtgagttttccagtttttctttttattgatttctagtttcataccattgtaatcagaagatattcttcatgcagtttcaatcgtcttaaatttgttaaaacgtgttttgtggcctaatacttaaagtaatttggaaataattttatatgtacaagaaaaaaagtcttctgttgccttttgacagaatgcattgtatatgtctgttaggccctctttttgtctaaaatgcagttcaattacaatattttctcattgactttctatctgaacaatttgtccattgttgaaagtgaggtattaaagttttctactattattgtatccagtctgtctcttccttcagatttattaatatttgctttatataatttaagtgctgtaatgttaggtgcatatatatttgaaattgttatatcccctgatgaattgacctgtttatcattatatgatgatcttctttgtatcttacgagagtttttgacttaaagtttattttgtataaatttagctattcctactctcttttggtttccatttgcatagaatataaccttccttatttacattgactctaagtgtgttcttaaagcttaagtgaatccgttgtaggtaccatattgtgtgtgtgtgtgtgtgtgtgtgtgtgtgttcaatccattgagcagtctatctttagagtatttaagcaatttatatttaaagtaattattgataggtaagcaattactattgccattttgttaattggtttctagttgccttgtagattctttgtttgtttcatcctctcttgctatcttcctttgtgaactgatgatttttttgtaatgagtggtatgctttgattcctttctctttttcttctatatatcaactagaggtttttggtttatggttaccgtgaggcttacaggaaataccttttagttataaaagtctattttaagcttataacaaattttctttgatcacatacaaaatctctatacttttacaccccttattttttgtttatgatgtcaaaatttatatctttttaatattatgtatccacagactattgtatttacagttttgttaatacttttgtttttaaactttaagtgatttacacaccattacagtattagaatattctgaatttattagagtattagaatattattagagtattctgataaacttccatttgtcagttttatactttcatatgttttcatgtcattaattagccttgtttcattttatcttgaagaactctctagcatttcttataaagcaggtctaaagtggtgaactcctcagcttttgtttgtttagaaggctttagatctccatttttgaagaacaacttttttaggtaaaatattcttggttagcagtatctttctttcttttaccagtttgaatatatctatataattctactatcttctggctgtaaggcttctgctgagaaatctgctaatagtcttatcagagtttgcttgtatgtgccaagcctcttttcttgttgctttcaaatttctgtgtcttcaatttttgacaattcgttatgcaggtgaaggatcccttatctgtagtgcatagaatcgaagtgtttcagatttcagattgttttagattttgaaatatttgcattatacttaccagttgagcatccctaatttgaaaatctgaaatctgaaatgttccaatgagcatttcctttaagcgtcattttagttctcaaaaagtttcagattttgaagcatttcagatttcaggtttttagattagcgatgctcaacctgtaatgtgacttgtgaggccttctttggattgaaccttattacagattgcaagctttgtatacctgaatgtccaggtttctccccagactttggaagttttcagccataatttttttaaataagctttctccgctttctgtctttgttcttcttctagaacatccataatgcaaatgttagctgtcttgatggtgttccactaatctcatcggttttcttcattccttttcattctttttaaaaaaaattttccttttctaactggatattttcaaatgacttttcttcaagttcacagattcttttttctgcttgatcaagtctgttggtgtttttattgcattttttgaattccattcactgtgttcttcagctctaggatttctgttcagtttccttttcatgatttctatctattcattggaattcttttgttgattcctattttctgttttatttagttgtctacctatgttttcttgtagctcactgagcttcattaaaatagttattttgaattctttgtcaggcaatttgtagatctcaatttctttgggaaaaatcaagttttcttgatttttcatgtttcttgaagtcttctgctgctgtctttccatttgaagaaggagtaacttccttcagtttttacttactataaataccttcaccaaccagattggttagtgattatgaggctctctcagactttttctgtggattcacccactccacacttcttatccattttgggggagggaaatgcttaagattatacactttctttcaatcttgcaaagctaggccagggctgagagcttcctgttttgattttctagagtggtgcactgaaatgctcaagtttgtgtgtcttcctccaaccctgcatagttgatacagatacctgcatgaagtgcttgcatttgctgttcacgcaggtgcatttagggaaccaatcttgggagcgagttgtgccaaacattttgagtgcccatgcaccagttcagggggtccaaacacaatgtgttccaagtgccttatagatgcacttcctgatggaatcacagagcagtaaattagatccccacctctcttccctgtcactgttctcttccaaccactaaaccataccaatcaccattgtagtttggataagatgagaaagtgggtgtcttgttcagtatcctacaaagctgggggagctgggcactcatgaaccatgcttgcactctccccacccaccaggagaaatcatggactgcaatgatctctcttggcattgagctatgatgccttggaggaaaggtaatgcaggtaaagtgaaactgtttttcttatctttttcagtgcatctattctcagatttttgttctgatggcgtgctaaaactttatctgctggattcttggaccccacaaaagtgctcttatagataattgtcaagtttgatgcttctgctaggcgataatggtagaacgctcttattccaccaccgcgtgaacatcactctgctttctctcttaattctgccttattctgcacattagcctcattttcctccttggagcttgtgaaggaattgaagatgccagaggcatcagtcttattttatgtaaggatgctcctaaaccactaatgataggacctaaaatctattgttgaagattctgagatatactctccgtcttttagctgatgacctcattcagggccatcacagcttacaggccaaactgtctactaaaaacattaggaagtgttaatcacatagacctcttctagagctgtgcagtgtgtgaccggcacagccatatgcattagccatgataccccctacttcatcaagatacagcagtaatgatatttagtgtctcttatcttttctacaatacccttgaatacctgccatcctacatatattttatgaaatgggagactgaaagaatgtattttcaaagtaatacactttatgtaatatgtggtttttacataaacttatttatggaaaattaatgaattcagtagtaggttttgacattttattattttatctggtaggaaaaagtccttctttcttaaataaggacttaattagtccttatttcttaaggcctggatttgcaagattgctttcaaaattgcttcatgcatatttttatattttcaattccatatgaattttaaaatcacctttcaattttattgtgcttgtatgaaagttttgggttaacttcaagacagctgacttttaacagttaaaactttccaactaaaaatgtggcttttctctcaaatgacaagctttgtataatttcttatagcttcccttcttgttttctcttcaaaagatttttagaatatttttgttatgatattatctttagatgaaggtcaatttgtatcttcttcttttatatttttagcttggtgggccttttcttgaagacacttgtctttctttaacattgaaatacatttatccattgttttaggcaatttgtacctctccattttctttgttctctcttttgggaactcgttttagtcaaactttgggcttcctgctttgatcttcattaatcctttagtctttgttctagtgtttttagtgtctgaagtactttttaaggttatccatctgggtatgctagagaatgctggtctgggtatatgttttacatgggcatatgacagaatcagcattacctcaaatggtcaagctgcctttcctgtgttgaggacacagagtttttacctggaaaaagtatggagacagaggagcaagaggagcctgtgctgagcactttctgtttgcccctccagacttacagttgacctttctcaattcacatctgccctttgggaggctgaccatatctgtgggctacttcatctttgggctttctgtggtgccctggaagaaggtaagagtgtggggccgtaacattggttcctcccactctctctccacgtggacagcccaactgcctcctctcaggcctccctctctgccagacctctggcgctggctttctgcagttgctccttcccttgcccttttggacccagaggttgtaattataaccccagcgtcacctctcaggatactgtattatccatccctgtgattttcccaccctggcccatacttgcgtaaaagtccttttattattctcaaataatttaaattgcatgttccatgtatttcctacaggtactctgaaaaatataaatgcccgtaatcccagcactttgggaggccaaggcgggcggatcacaaggtcaagagattgagaccatcctggcctacatggtgaaaccctgtctctactaaaaatacaaaaattagctgggcactgggctggatgtggtggctcgcgcctgtagtcccagcactttgggaagccgaggcgggtggatcatgaggtcaggagttccaagaccagcctggccaagatggtgaaaccccatttctactaaaaatacaaaaaattagctgggtgtggtggtaggcacctgtaatcccagcaactcaggaggctgaggcagagaattgcttgaacctgggaggcagaggttgcagtgagctgagatggcgccactacactccagcctgggtgacagagtgagactccatctcagaaaaaaaaaaaaaaaaaaaaagggtggcatctgcttgtagtcccaactactcaggaggctgaggcaggagaatcacttgaacccaggaggcagaggttgcattgagctgagattgcccaccacactccagcctggcaacagagcgagactgtgtctcaaaaattaattaattaattaattaattaattaacataaacaacatgtaatagagaggttcaataaggccaaaagtggttcctttcaaaatttgaatgtaacataccaacactgacctaagacatattagacattaataatccaatggctaataagaaaatacattttttttttttagatggagtctcgctttgtggcccaggctggagtgtgcagtggcgcgatctcggctcactgcaacctccaccttccaggttcagccagtcctcccctctcagcctcccaagtagctaggattacaggcatgcaccaccatccctgacaaatttgtttttgtatttttagtagagacggggtttcatcatgttggccaggctggtcttgaacccctgacctcaggtgatccaccctccttggcctccgaaagtgctcggattacaggtgtgagccaccatgccaggcctagaaaatacatttttaaattaaaaatattacttctgcaatatctccagacctagaggcttcaccagtaaattttgctaaatatataagaaagaataataccaatcttattactcatgaaattgataaataccagtgagcttgactgaggaaaaaggggcaaggacacaaccaatgacagaaataatacatggaattcagtatagtcttctaaaacattacataatggtaagacgatgttatatacaattttgtatcttgcatttgaaaatgtatatgaaaaagacatgttcctagaaaaataaagctcattagaactcacactttatcttcctcttctctctctgtttctttgttttgttttcttttgttttgtcttctttcactcagacatataggaggtccaggcagcatgaacagctccctggtcagagacacatggatttgctcactggttactcaaagctgattcaaagccgattaaagctgctgcttcatctggggtcccaacctccagtgggaaaaacattcttcttttcctgctggtgtcacccactgttccacggatccaaaacaacacccaatgtttggtacaaatttagtgaaacagctctttccattcttaactcatgccaagcatctcagcttggggtcaggaaaatgccaggggacatgagctcttctcctagagttagagaattctctgccttagttgcaataaaggaaaagatacacattcttcctacaaatgccaaagtaggctcaaaatttggttcctagagtagagtattgaagtcgtggcaaagatctttccagtgatcaaagcagtggctcgttatgttccctcagactgaagctacagtctcatcttcactttctgttagctccctccatcctctgcgtaggcccacacctgcttcttacagttgtgtggattatagcacctcctctccagcctcaggacctttgtgagtgctgctccttcttccttgactgctcttcaccagggatcctcagggcacagcccttacctcctgcaagtcttgacttaaatgtcactttctcagggaggcccacactcatcaccatttcacacccacctcccacatgaccttattttacctgttctctcttctcctcttttttttagagtacttatgatctcatgtggtacattttggggtttttggttcttctgtatccgccactgccatgatcagttagaatgttggaaaccaaggaaacttggttttttggcctgtgatgaaaactatggggtctaatagtatctgataaagtggcagaccctcaattattatttgctgagtaaatgaatgaaggtgtgtagacaactagctctagaagcttaaatgagtgataccatgttttataacattggaagaggccgggaatggtggctcacgcctgtaatctcagcattttgggaggccaaggtggatggatctcttgaggtcaggagtttgagaccagcctggccaacatggtgaaaccttgtctctactaaaaatgcaaaaattagctggacgtggtggcacacgcctgtaatcccagctactctggaggctgaggcacagcatcacttgaacccaggaggcagaggttgcagtgagctgagatggtgccactgcactccagcctgggcaacagagtgagactctgtctccaaaaacagaaaaaagaaagggggggaagaaaagaagaaggaagaggaaagggaggaggaggatttatcattcacttacactagaaacagtgaaaatagataatagctataatttactcacatcttatctaaaacacaaattcagggtaatttatgagcaagtcattttccggtgggctttcgatagtgtgtgaatttggaatgaatgctggtacttccagctcccttccacctgcagcaccaggaagccattgttgtggggaggccaccaacttggctggcatgttgcttctgcctcagttagtgatgatggtgatttggagagaaaggacactctgctaggctccaaatccaaaggatcaagtggataaatgaaatgaatatctaaataaatatcaattaggtcaaaagtttgttttcatctaaatgaaatctgaacactacttagggctatgaaacatagccagaggacatggccagctctggagtggggcctggacttgctctcccctgctggaagtgcttttcctcccagagctcagagcaccatgtgcgtgtgacccctgccttttcacaggccattgccacagggcatctccctggtccacccgccccaagatgagccagcctcccactcaggaagtgggtggggaagggaaagaaagacagaggagagagagacagtcacacacaggcagtggagctcccctgcacccaccagggagcttgagcagctcatctgcagagcagggaaacatttttactaccattgggaagacgctgagcagagaggtgaggggacagcatttcttgtctccctgtggcttgttccactcacagttcagtttctcctgttcttggggaaaaggagggaaactgtattagtcagggttctacagagaaacagacccaataagatgtgtgcatgtgtgtgtgtgtttatatatgttcacagaatgtatatatgtgtatatatatgtatatggataactgcatatatatattatttatagagagagagaagagcaggagacagagataaagagagattcatataaagaattatattcataatttatataataatttgttcctttaatcataaagtctggcaagtccaaaatctgcagggcaggccagaagcctgggcaccccggaaagagttgcatctagactctgaagacggtctggaggcagaattccctctttcccagggaattccagtctgttttctctgaaggcctttactgactagatgaggcccccacacacatggaaagcaatctgccctactgaaagtctactgacttagaggtttagctcatctaaaaaataccttcgtagcaatttcgagactggtatttgaccaaatagctgagtaggttggcctagccaatctgacacataaaattaactatcacagaaacaaaataatcaatataggtaataactgtgccagaatgctgtgatgtttcaggatgaccttgtttacatttacatttattgtcaaaacttaccttctctttttatatgggcaattaaatctgctactgagggtatcaagtactgatttaatttacaatcttaatagataagataggttcctattttctcctctccataaaagtaataagtttggagaaaccaggtcggaaatacctctccagattttaaagcataacctcttgtttggaataataagtatgtaaataagcaccataaaatatgaaaccaaacatttcatcattcttttatatacattatcccttgcatttttaaaaaataaggaacaccttattagccatattttcaaatggtgaaaccaacacccccagctcagactctgccgtggtaggctccagggtcactgataccagatcccatggtattttcactatatcccactctttctttgcatgtggctcttttttagctgcattgcgggtaaacaggtgtggctcttttcaaaccaattccatgcatatgtgaagaaaattgatcctgaagttccttttgccaaagatgcttatggagaagtgtctgtgtctggacagacaaaagtgtccatttttgcctcgaagcttggcaaaattgaaattgatgatggggaagctagaaatacttcagtctacatttcgaatcccagctgcggggaggctggttgaggattgcccatccctcagtctgggctggattctccctccagtctctggggttctcttttctattcacaagagggtgctaatgagatggtttaatctctataccctgtggtccacaaatacaagatgccagcgtggccaatggggcttccataagagtggcaatcaggggtctcaagcttaccatgacgttttgggccctggaatcagatcatagttctacagttgtcctggcactagaactcatgacaaggttgtgactagacagaaggagagaaggctggaggctgacaggaagcaatgtgaacaaatgccttcgcaggatgcatgggtttgggcaacagatggtcaggggaggtgctggtgcagacgggctcagtagcaaagcaataactgtggatggccattttatggctgcagatcacagcacatttataaaagatgtgtgtttcatgaaaatgtgcatttcatcgtggaaatactgtggttggaggagatttctcaaagctgataaataagtgtaggtgacttaacttgcaaaagatgatcatatgtgagaacggatgtctcaaattaggaaataacttgttaagtaaaaaagcctcatgtattgatttgaagaaaaagatattttggtgctcatcaaaataaaagtataataagctgaa

SEQ ID NO: 2222 - DNA, 28015 bp, Homo sapiens
gccaagtcctcggtgccccttgccattttccagccgcgctcccacgagggtcacggcggcggggagaggtggagccgcgagagctcggccgggggccccgcctggtggtcgcggccatgacagcggctcgggactggctccttttccgcgcccctcccgccggaggtgaggggaagatgtccatgtccgggttcaagggcaaaccgaagttactggcctctatcttccaggagaaccaggagccacagccgcggctcacgccccaccgcaacattaaggtgagtcgccgggtggcggcctggcggggcagggcgagggcggaaagcgggtgcccagagtcccaggagaaaggggaagctgccccagagaggccgcggttccccgcccctttctcccgcaactggcccgcccggcaaggcagaggcttgggtgggagaaggcggagggcgcgtctctccaactcctagcgcggggctggcttgggggctgctggcccctctcggcccctgtcgctgcgcctcgaggtgggagcccgcggctgcgggagctctcttgggacccatggtcgccctcagtcagcccacctgctctagggaccgcgacagggcggggcagggcggctcccgcgttgttggagcccaggcggggaaggggaaaggcctttaagattttcggttttttggccgggcgtagtggctcacgcctgtaatcccagcattttgggaggccaaccgggctgatcacttgaggtcatgagttggagaccagcctggccaacatggtgaaacccatctctactaaaaaatagaaaaattagccggtcgtgttggcaggcgacttaatcccagctatttgggaggcagaggcaggagaatcgtttgaacccgggaggcggaggttacagtgagctgagatcgagccattgcactcaaacctgggggagaagagcgagacttctctctctctctctctcaaaaaaaagttttctttctttttttctttttgttgagacagagtctcactcactctgtcgcccaggctggagtgcagtggcgcgatctcggcttactgcagcctacctctcttgacagtccactggttaaagcgattctcctgcgtcagcctcccgagtagctgagattacaggcgcccgccaccacgcctggctaacttttgtgtttttagtagagacggattttttagtagagacgcggtttcaccatgttagccagcatggtcttgatctcctgacctcatgatccacccgcctcagcctcccaaagtgctgggattacaggcgtcagccaccgcgcccgccctctgttttgttttatacatgtaatatattcacaagtatctttacgaagtgattttgatactcttttgtcttctccctagaatctctttgttctgtaataattttttcttagtttatattgatcttattttcctttttaaagcctttccttacatatctattctatgttgcttatcatttgtagtttttttattttttatttatttatttatttatttatttatttatttattttttattttttttttttgagagggagtctcgctctgttacccaggctggagtgcagtggtgcaatctgggctcactgcaagctccgcctcccaggttcacgccattctcctgcctcagcctcctgagtagctgggactacaggcgccagccaccacgccccaacaattttttgtattttttagtagagacggggtttcaccgtgttagccaggatggtctcgatctcctgacctcatgatctggccaccttggcctcccaaagtgctgggattacaggcgtgagccaccgtgcccagccctgattctatattatagtgagttgtacaattatttcattatatgttacaatgtaataataatagaaataaaatgcacaataaatgtaatgtccttgaatcatcccaaaatcatctcccccaaccttgtctgtggaaaaattgtcttctgcaaaactggctcctgatgccaaaaagtttggggactgctggcataagtggtctcatatagtagttgtccttttgtgcctggcttatttcacttagcataatgtctttaacgttcatccatgttgtagcatgtgccagaatttcatttgtttttaaggctgaataatattcccttgtatgtatttaatatgcctttttatcttttcctctgttgatgaatacttgggttgcatccacctattggctattgtgaatagttttgcattgcctgtctttctcatgatcgccatcctatttcgcatctagcaggtgtgaaattccattgattgagtgattgattgagacagggtctgactctgtcgcccagtctggagtgcagtggcatgatcttggctcactgcaacctccatctcccaggctcaagcaattcttctgcctcagccttccgagtagctgggattataggcatgcaccactaccagctggctaatttttgtatttttagtagagacagggtttcaccatgttggccaggctggtctcgaactcctgacctgaaatgatccacctgtctccgcctcccaaagtatttggattacatgtgtgagccactgcgcccagctagtaggtgtgaatttctatgtcttagtggttttgatttgcatttacctgatggcaaatgatgttgagtatcttttcatgtgtttattggccatttgtctgtttttttggggaaatacttattccaaaatttaacttatttttaattgggttatgtatctctttattatttagctgtaagaattttttacatattctagataggagttataacaactttcttcctttttctggattgtcttttttctttcttgatggtgtcctttgaagcagaaagattttaaattttgatatagtccaatttatcttttttcatttgtgtttttttgctccttgtgcttttggtgtaatatctaaaaaaacgttgctactccaaggtcacaaaggtttctgcctatgtttttttctatgagttttatagtttatcaatatctcttatattgagctcttttatccatttgaattaatttttgcatgcggcatgaagtaggggggtatagcttcattgttttgcacctagacatccagttatctcagaactatctgttgaaaagcttattctttccccattgaattgtcttggaacgcttattgaagatcaattgactgtatatgtgaaagtttatttctggattctattcttttctctgttcatctgtccttataccagtagcacactcttgattactgtagctgtttagtaagctttgaaatcagaaagtatgaatcctccagaaagttttttaaggtgggtttggctgttccgggtcacttgcatttccatatgaattttaagatcagcttgtcagtttctgcaaaggagccagctgggattttaatcacagtcgcattgaatatgtagatcaacttagaaagtactgccattttaacaatattaagttttcctccatgaacacaggatgtatttgtactaatttaggtcttcctttaatttctttcaatcgtagttgtgttgaatgcagacctactttgaattaattctaagtaatttttatgctacttattggttgacaaatataattgcttttagtttttaactgtagttttgatgtaatgtgaactgtatttggaccttgtgaagcttatttctgctttgaaatttagtataaattggttataataaaatctgactgtgctaattttttggttatgtgaaatagaaaatcaatgtaaatttaaaaatttattctgggccgggcgcagtggctcacacctgtaatccaagcactgtgggaggctgaggagggcagatcacaaggtcaggagatcaagaccatcctggctaacacagtgaaagcccatctgtactaaaaatacaaaaaattagccgggtgtggtggtgggcacctgtagtcccagctacttgagaggctgaggcaggagaatggtgtgaacctgggaggcggaggttgcggtgagctgagatcgcaccactgcactccagcctgggcgacagagttagactccgtctcaaaaaaaaaaaaaaaaaaaaaaaaattcattctgaaatgcgatagatgttgaagctcttctggcagatggttataaagaggaatatataatcattctattgagaaaatataatcaataatgtgaatacctaaggtagtttattttacatatatatctcggtatttatttatttttgagacagagcctcactcctgtcacccagggtggagtggagtggcacgatcatggctcattgcagcctcaacttcttgggcttaggtgcttatctcatctcatcgcagccacctgagtagctgcgactacaggtgtgcgccaccatgcatggctaattttttgtatttttagtagaggtttccccatgttgtccaggctggtctgaaactcctggactcaagtgatctgcccgcctcggcctcccaaagagctgggattacaggtgtgagccactgtgttggccttatgttttataatttttaaatgatactttttattctattacaaaacatatataattgtaaaaaacttgtaaaatataaaagaggacaaagacagtagaaaaattatttacaatgtaattcccaagtaaacactgattacctttttttttttttttagagcctgttgctcaggctggagtgcagtggcaccatcatagttcactgtaacctcatacatctcatacattttgatattactacttctggttttatacataatgtgttcactttgaagcaagagagtataattttataacgattattttcatttaatgatcgtgatctcattgcaattattgatcatttagtttattcctgaacattttgttttatatatttttgctattgtgagtgggatatttgttataacttggcatttgtgcctacactcaatttacctataggaaactaatttttgcatacaattgttttaattggtgcagtggcacaatctcaactcactgcaacctccgcctcccaggttcaggtgattctcctgcctcagcctcctgagtagctgggattacaggcacatgccaccacacccagctaatttttgtatttttagtagagacagtgtttcaccatgttggtcaggctggtcttgaactcctgacctcgtgatccacccgccttggcctcccaaattgctgggattacaggcttgagccaccgtgcccggcctcggcctctttgtgtgttttcgtatatctttcatctgagttgcaaggggcaccttgggtttccaggaattttcttagctaactctgttcctttatctatgacccttcctcactagttttggataatttattttccttcttccttacttcactgatttacttttctattttatttagtttgctagtcattgtttcttttaaggttcttaagcataaatccttttttttttctgatgggaaatactggggcatagcactaggaatacaaattatgtttaaatagagcacaaagaaccatctcaaaggaataactgatggtgaatgtctggtgattgattttattatgtatcatctctaatgaggcttaataaataattgaggtttaacacttaggtaaccggtctgtatttaagtctgaaaatttttgtatgttacagtttcaacttcacattgaatattctgtaaagcagaaataaattgatcagcattctatgaatgaaaaataaagccatgggtcgggtgcagtggctcacacctataatcccagcactttgggaggccgaggcaggtggatcacctgaggccaggagttcgagaccagcctggccaacatggtgaaaccttgtcctagctactggagaggctgaggcaggagaatgactttaacccaggagacagaggttgtggtgagctgagatcgcgccactgcactctagcctggtgacagagcaagactctgtctcaaaaaaaaaaaaaaaaaaattagctgggcatggtggtgcacacccgtaattccactacttgggaggctgaggcaggagaatcacttgaacccaggaggcagaggttgcagtgagccagggttgcaccactgccctccagcctatgtgacagactgagactccatccctaaaaaaaaaaaaaaaaacaaaaaaaaaccatgctggtaatcgaaaaagcagtttgcctcatcagagtttagaacgttgaattgtaaagatcttttttgtagtcctagccagttttaatggtaacatgagcaattcagttactttctcagagttttatatttttatctgtaaaatggaaattatggtacctacagtttaggatttttgtgaaaatcaagtgagactgcaagtgtcttgaatagcagtggaagtacattgatataggtgatattttacagtggtgtcttcctcagcatcatattagttcagtgttttaaagctctatattagtcacagaaacaaagtcaaatttttgttctcatttcagattacaagtggacacctgagtcagcaggacctggaatcccagatgagagagcttatctacacgactcagatcttgttgtcacccccattattgacaatccaaaggtgcagaaagcactctgacaagtgagttgtagactttactgagatctgaaatctgcataagattttcattcagaatattatttactgtctaatctttcctgtttctcttgtccgctactctttcatttgtgctgcatgtctgcatttccagctcccgctctgtctgcaaccctttcctctgccttcacttccgcttcactggagttctaagttttcccccctctgttttgaatgagtcagctctgcttctcactactgctttcttccacatgccacggaggggttgccagcctcttgacctcagaccttagctctcagtcccatcgtttctccatctgcactaatgtgaatcactctaagtattctagtctctgatgtgttttgaaggcagaagcagtcagagggcactgctcaccaggctgggctgggcaggcagatcacacggaagccctgccctgtcacaggttgttaatactgcaggggagatggtggggagacactatgggaacttgaggagtcatggttcacaatgtacttctaaaccactgtgagtttttttgcttcttgtcttttggaatataatactttattgctgggggataatgagtatttactttaaaaaacagatgcatttctaagtccctctgttttgtcttgacttccagctccccaacatactcacattccactacttattctctattttaactttactgcttcttttacttttttttagttttacttttattttttatttttttgagacagagtcttgctctgtcacacaggctggagtgcaatgacgcgattttggctcactgcaagctccgcctcccaggttcatgtcattctcctgcctcagcctcccaagtagctgggactacaggtgcccgccaccacgccctgctaattttttgtatttttagtagagacagggtttcaccatgtaagccaggatggtctcgatctcctgaccttgtgatccacccacctcggcctctcaaagtgctgggattacaggcatgagccaccacacctggccttctttttcttttttaaatatctttttctgtattaattcatgactgtttttttcttgtctcattgggaacattagtgtggtttagaacaatgtaagggtttttggattcatgtttattttctagatagacagcattttatatagatgatttagctgtttttcataatggagctaattctttttgtgagttcatatgtctggcagtgtaactttattatgctaagtttgatgtgcattggcgcattttcaaaatgggctttctagaacaatttgtgatatctttcccaggggtgtccagtcttttggcttccctgggccacactggaagaagaattgtcttgggccacacataaaatacactaacaatagctgatgaactaaaaaaccaataaaaaaaaattgcaaaaaaattcttacgatgttttaagagagtttatgaatttgtgttgggccatattcaaagccgtcttgggccgcatccagcccacgggctgcgggttggacaagcttgctttacacaatattctgtgtttccttttttcctcttataaccatatttgatagtttatgggaagccttcatcagtggaaatttttgtgtttaacttttaattctaaactacttttagagaaaagattaaaaaatagttgagaactcctgtatagcttttgcccagctgctcttaatgttcacatcttataggtctatagtatagttagcaaaacctgggaattaacattggtatagtgttagtcaggcgggataatccttacctgtgcctccttttggagggcagcagaatgtggtagttggaattgcatgatacttgattcatatctctgtgtaatgatggcatgcaataccctgactgctcctttcgaattcttcctgaaaagggaaaaataaaacatgagaatagtgctgctaactaccaaatgcatttgaattttaccggttgcctctaatgtcctctttttttttgttccaggatcccacattacagttagttgttatgccttcttagtctcatatagtctgtcctagtttttcacggttttgtcagaatttctcagactttgcttgtctttcatgaccttgacagtttgtcttttattttgttttgttttgttttttgtcacccaggctggagtgtagtggcgcgatctcagctcactgcaacctctgccgaccgggttcaagctattctcctgcctcagcctcatgagtagctaggattacaggcacctgccactgcacctggctaagttttgtagttttagtagagatggggttttaccatgttggccaggctggtcttgaactcctgacctcatgatccacctgcctaggcctcccaaagtgctgggattacaggcgtgagccacggcacctggcctttgtatgtttttgtaatacatgttataaaacgtatgactcaagtccttgacactttgaagagtaactggttgggtgttttgaagaatgtcccttaatttaggtttgtctaagggtttctcatgactcgaatgagattatgaatttggattatgagattagaatgagaatatgcattttagtaagaatactacagtaaatacagtaatgctggttacttaattagtaaaggttttaaaaatattacatatagaagttttgcagaagttaggtatagaaatgatggttgaatttttaattaaaagtctcaagatgcagtatctggctgtcctaagctcatggatccaactacatggtttcttcacatttctcaaataaattatgcactttccaattcatgctattatggcttccttgaatggtgtcttctctgatataatcataaagttctagccatccttcaagaccgcaacccaccttctacgtcttccgtaaacccggtgtcaagtatatcaagtaaagtgcttgctgtattctctaaactactatttacaaaaaaaattctttctgtccagggttttgtctgtagttatgtcctgcctcttttgaattgtgaaatattttcttgtttatcaaatgtttgtctcatcttcccaaccagaaagtcagctcgctgaaaataggattgtgtcttttatatctttgtatcccccttagcacttgacatagagccttaccttggcaggtaagcaatagatatttgttgaaagactgaatttctaattagacgtaaattacctaaaaagtaagccaggatggggtgaattttttctttgaagctttattttattacagatatcaattgaaatgattttaaaaaataaattattatctatatatgtatgttttaatctgaaaaggcatcgttctttttgtttttggtaacaaattttacacattctttttttgtcctcattgatttattatctgatataagggacatataaggagacagatatccatctttaaaattgcctcaaaagttttttttttttttaaccacagataaggaaacaaccaccatcggttaaatttgatgcaaaaatattgcatctaccagcattttcaggtaggatcataaaggacttatcgaacatgtagactgtctgtatacagatacgaatatgaaatttattcacaaatggaatatttgtatgtgaacaactaaatttattttgtcttgacaattggttatattcttgggtcagtgttatgtgaattgtaaataatctgtaattcatttgtgccagctgttgacatttctcagctgagtctgggctgccctgtcctcttgtgagtggggaggttcctgtagatctgggcaagttttcctgtagagtgggtggggggcctcctcccttccgttcatagagctggttgaatttccaccatttatggcaggtgtaggtgcacagggttggggacaacaaggaaggattgggattctattggcgggaccaggacatttgagaacgggactaggtggttcatgactgtggagatggtgtgggagtggagatacttaagggataattattacatttctgttgagctaatgaaaatcttatttacggtgaaagtcagaaatttttacataccttaaacttttttttttttaacaaattatattttaagctgttaaactcaatttggggaaaattattcattgtggctagagtagaatctatgatttgaagtaaatttaaaatatatttaggtttaaataaaccagctaagggtttatatcagtcaacttaattagtgataaaaacaaccaaaaaaacctgtgtagaaggacgtttttgaaagaccaaagtgaagcaaaatattaatagtgctttcagtgccaagtaggtctatttatgcaaacctagagaattattatcgggaaatactatttcctttttcttctttgagttacttaggaaattatatttacaatttctttgtctaaagattgagatcagcaaaaacatgttagcaaaaaattttagggagtatcacatttcctagattttgccctttttttatagggatttggaggtaggaatttcaggtgattttagctatcatgttatcctcgttatttttttacagtaatttcattggaactttttaataactgtgtggtttgtgcttttctcaatatctgagagttgatttatttatacaaaggcttttttgtcttttactccagttgtattgaactttgcattttgttataatctaggttgtgagacaattctgctttagacatctgcttggtttgaaagcatagttttccattgaagtgtttaaaaagtttccatggatagataaagagatgaggaatatagaaggacaaatagaagtagtgtcatctttggagtatttttggtgttgacagagtaatgttttctttgtcctcatcttagctgtcgtaactctgtgtttatttctcatgtaatgtttccagcagttgtttttctcatcatcatacttttgttattttctttccttggcaatggataagttataatttctgaaagaccaagattggaatgactttttgtaacaagtgtgctcgcagatcgactccagtgagaagagctcggggacctcctgagccaagcttaatctcctttgctgtttgtgagtggtggctggtcaccaggaggtggccaccaggctcctcctttccccgctggtaggcctctgtgacatgacttatgcatttaaatttatgttttttatagaggctcaaacaagtgctaaaatagcaatttgatttaactaccatgaaaaaactgatttatcacgattttaggtttatgcaaattatcctctgcttaatccttacgtcttaaagtagataagagtagacggtgattttgaactttttgttgttgttgttgtttgtaatactcaggtttccattttatgttaacttgtaagatttttaaaaaatatgtgaaatcaggccgggcgtgatatcataagacagaccttttaccttctcatcagtgactggaatgaacgcctgtaatctcagtactttgggaggccgaggcaggtggatcacctgaggtcagcagtttgaaaccagcctggccaacatggcgaaaccccatctctactaaaaatacaaaattagcagggcgtggtggtgcactcctgtaatcctagctacttgggaggctgagacaggagaatcacttgaacccaggagccagaagtcgcagtgagccgtgatcatgccattgcaccccagcctgggcaaaaagagcgaaaccccatctcaaaaaataaaaacaaaaaacaaacaaaaaaaaatgtgatatcataagacagaccttttcccttctcatcagtgactggaattaactgcccatgtggaacgggttgtgggtgttggttcctttactgggtcatctggtaaactgcaaggtttctgctgtgacattgaaggcagacatcaaccctctaagacatttttttcctatcctctgggaatattactttttggacaatcttggtccattggtaagctcatgggaatttgtcagagtttttttgtttcttttggctcatgtttagcatcgattggcagagtgtttggagtcatcctcagaaaggaattacagtggttcggaggtgttttctgtagtgggccctcatttgggaattggcttgaaaaaaatgtaagttcacttgcttccaggatggtattaagattgctttttttgatagttggcgtgtgtctatcaggtaagggctgtcatttagagaatataaagtggtaggagaaactaaaagtactgttcttagtttttattttaatcttattcgtatacaagtgcctttgtaatttagcaaatatcatttttggtgtacagtataaatttcctttttataaagatctgagtttttaactttgctgtcactttctgtgtttcatgacttaaatattttaattttttctttttttacatttacattttttattctagttccaattgctaatccagcatttgtggatagctgcaaactgcgatatgtaagtaacatttacattttaaaaattatttctcatggttttattaagtagttacagcatacatatttatcaaaagcagagtcctaagtaattatcataaattttcctgatgtaatgatgaatttactcataggcaatttttatgggcattccaattataaactttagaatatttaaaaatagcccttctcctaatatagatacgattctgggattatctaagctactcctggaaactttattaactgttgttgtttttttattttcgtagagacaaggtctctcactatgttgcccaggctggtttccaactcctgggctcaagtgattctcccatctctgactcccaaagtgttaggattacagacgtgagccactgcgccaggctaactgttactgttttgagtattggttataaaatacttcaaccctgatccctgtgtattaatttagttatacttcctcaaagtttcccttgggcacccttatctgtccctatgtagcacatagcttccctatgatgttatttataatctaatgagattaattatgatttataaactcccgatggaaggaagtgtccttactttttatagaagcaacataccaggtggaaagcaccgtagatcaagtgttagaaggctctgggttcctgttgcctataagacttggccaaatgattatctttttctcaatctctgtttcctggggagtgtgggtgggacaaggaaatggcataggtttaggattcagacagacctgggtgtggatcaaagatccgctttctgggccaattactttaattgctgagccgcagtttcctcatctgtaaaattgggatgggataactacttcatagatttttggtaattattcaactttgaatgtggtaaatatgtgagatacctggtatagtgcctgtttctttctttcttttttttttttttctgagtcggcatctccctctgtcacccaggctggagtgcagtggtgcgatctcagctcactgcaagctccgcctcccgggttcacgccgttctcctgcctcagcctccttagtagctgggactacaggcgcccgccaccacgcccgcccggctaatttttttcaccgtggtctcgatctcctgacctcgtgatctgcccacctcagcctcccaaagtgctgggattacaggcatgagccaccgtgactggccgtatagtgcctgattcttagtgggtatttcattgacagtggggttggggttgtagaagttgtagttattatcatgaagcttgcttatctcatgattgttaggacaggcacatgaaaaaacggaggtgaaaggattttgtgaattgtggcagtggtataataattattcttctatgctggtgaaatatgggtgaaacaataggagtttagaaaatgtttaataataagggtaattcttattatacgtcttctaatgttactctcgcaaaataaaatctggtaatagaaagtaggatttttaggtaatggttgagcatttaatactttgagaaggcttatggtatgctcattaaaaatgaatcaatgaaatatgtatctaaacacttttatttaaaacgtgttatatacctgaatggggtgctccctgctgacattttcagacagacattccaaatcatttccgagaacagtcatccctctgtatcagccaggagaatggttctagtatccccttggatactaaaattaacacatactgttttttcccccactgttaaaaattgaggtttgattgtaaaacagttttaatttgaataaaatgatactgaggtagacaagttctctggtaggaatcttcttttattctctttctccatccaaagccacttccagcgaggttttctctgacctcaggttatattaccttgatagcatatgataaagggtccttaacttagtctgggagataattattattgaagtagatacttagttttgttttgcttataaaaaattagaatcacatgatatagttttttatgtttgttttcccccataacatatatattatgtattttaaatgttatcaacattttaaaataaaatacataatacttaaggtaaacgttttatatgttgtgaatatctgatcattttgtttactatttttggatagtattataatgttgtaaacaacattttgatgaacatttttgagattaaatcttcgtgcccgctttttctttttccctttaggaaagattcatagaactagaacaaatgggtagaaggcagtaaatatctttgtgacttctgaaaaattgctgaaatactcttaaaaaaacattgtatcaatagataatcccagtcaatgtgtttaaaatgccttttgttagaacttccaacgttgagtatttatcaaattgtatatccttttatccttgccaatcaactttatgaggtataattcatatatagtaatagtgtaatactgtaactttaaaatgtgttacttgtaaattacacataatttaaaatgttccattttagctatttttatgtgtacagtgacatttagttcattcccattgttgtgtaaccatcaccactattcatttccagaactttttcgtcatcttaaacagaagctctttacccgttaaacataacttcccctttcctttcccttccccagtcctggtaacctatactctacttattctatcttggtaaatttgcttatggtgagtacctcatattgctactgaaacatcgaggggtttggtctaggtcctgttgctcacagcgcagaaagccaatcacggagacgatgagtgttgctagggaacaaggcttcaattgggtgctgcagctaaggagatgggagatcaatctcaaatttgtctcctcgactgactaaaaccacaggtttatttagcagggaagaaatgtaaccatgtatgggaaaacaggagttagggaagggtgagggagaggagttggtcgacaggaagcaggtagttggttaggcaattgtgatgggtgaggtggtctggtgtcttatggtccagatgtggtgatctggtaagtttcagttccttgataactatctgggaggcctgatggttggtttcccaagaaaggaactcagataagacaaatgtaactttctcaagttttaagactgggagggtcaatttctatctttattttaaaagactgtaaacatcagttctataggacaattgggctggtttcatttgcaaggtttatccatgttgtaactaacatgtgtcagcatttcattcctttttaaggctgaataatatccctttgtatgtaatataccacagtttatcttttcatctgttgttgggcactggcttgtttatatcttttggctattgtgaacaatgctgctatgaacattagtgttttcacacctgatgggtatgaagttagtatctcatgggtttgatttgtattttgtgactagtgatgttgaacatctttttttgtgattgttggctatttgtatatcttccttggagaaaggtctagtcaagtcatttgccaatttttttttctttttttgagattgagtctcgctctgtcgcccacgctggagtgcagtggcgtgatctcggctcactgcaacctctgcctcccaggttcaagcgatcattccatctcagcctcccaagtagctgggattacaggcacctgccatcatgcccagcaatttttgtatttttgtagagacgaggtttcaccgtgttggccagatggtcttgaactcctgacctcaggtgatccacccgctttggccccccaaagtgctgggattataggtgtgagccaccgcacccagctggtagattttttgttttgttttgttttcaagaaggcctctcagtggcttacctctgtgccatgctttggagtttgagctgtcttctctttactaactgtagctctgtaggacttgggagtcaaccttaccttcttttttcctccctattttgtaggtcttgtttgagttagcttttctttttattccaggcctgtaaattttactagattgtctctaggaatttcattttactaatttgcttcagcctgcctgcctgccatctctttttactaatttgcttctgcctgcctgcctgcttccttccttccttctttccttccttccttccttaattccttccttccttccttccttcttcccttcctctctctctccctccctcccgtcccttccttcccccctcccgtcccttccttcccttcttttctttccatttattttgagatagagtcttgctctgttgcccaggctggagtgcagtggcgcaatcttggctcactgcaacctccgcctcccgggttcaagcagttctcctgccttagcctcataagtagctgggattacagttgtacgccaccatgcccagcttatttttgtatttttagtttagagatgggttttcaccatgttggccaggctggtctcgaactcctgacctcatgtgatcctcccgccttggcttcccaaagtgctgggattacaggtgtgagccacaatgcccagcctcctcacccctcctttagctattatattacttcctagatttcttcctctctatttcaccctttttctgttcctgaaacccctacaggatgggtgtgggagtttgtgtctcatgactcttctttcaaattttcttttgctttctcactttctcttgtttattgagatataattcacataccataaaattcaccattttaatgtgtacagttcagtaggtgtcagtatattgaaaactgttcaaccattgccactatctaatttgagaacagttttctcacccagtgaaacccagtacccattcttctccaacccctggcaacaactaatctacttcttgtcagctgatttgctattcttgatatttcatataaatggaatcatacagtgtgtggccttttgtgtctagcttctgtcatttagcataatgttttcaaggttcctccgtatggtggaatgtgtgagtacttcattctttttctagctgaataatctttgtatggctattccacattttgcttatgtggtcttgatggacatttggggttgtttccacatttggctattatgaataatggtgctctgaacatttgtccacagggttttgtgtgaacatatacgtttttatttctcctacagtggtgagattgctggataaaatggtaactctgtgttgaaccttttgaagaactgccaaagtctctttgttaaacttttattttaggttcaggggtacacatgcaggtttgttatataggtgaactcatgttatgggggtttgttgtatgaattatttggtcacccaggcactaagcttggtaaggaccaattgttattttttctgatcctctccctcctcccaccctccaccctaaataggcccccgtgtcgattgttccctctttgtgtccatgcaaactttcttcttttattgctcttccttgactttatctttgagctctcaaacttgatatttatccccactcattttattatttaggatttccagttaattttttaatttcaacaatcatatttgaaagtttttgttcattttctttttctctgattggtcctttttcctagctgcctatatttggtatataatatacttttgaatttgaggataaatattaggattataaaaatcctcatcttggagcagaatttagaattaaatattgttattaatatttaaggctaaacattaggattatataatataagcctggaacctggactttgaaaaaaagggaacaaaattaggattatgaacattgtattcttatctcttgaacttgcaggtcacttctttttcatcatggtcctgctttttaatgctgtttatttctcaaatgcctggtgatctctggttcttcatttatattatgaataaatgattaaattgattggtatagaagttggcaatatgagtttcctttattcttgcctaagtctctttctccaatagcttctcctttaaagaaagggctggtatgtgggtaggtgaggcctgttgactggttgactttaatttgggattccagctggctgaagatcagtaggcaggctggaggcctctgcaattgccagggtgggtttttctttgcagtggagctggctttcctcatttattcccttccccgcttcggtatctggaggaccacagttgctgcttcccacatccatccatccagtgagcaaggtggattgctcactgtaggaatgattttccacatttactcaggaggccagggctgcagggtttattctgtgtaccagggaagggagatggaaaagagacaggacctgattggctctgctgttccttgtacaaggacacaatttttccttgtgcagttgtttaatctgattattgtcctgtggctcattctttctttttgtctttgtttattccaagtccctgaggcttccttgggaacgtctgtctacctgtggttcttagacaggggattcctttgttgattctctgtcagtcttaattctatttgtgcatgtcatctgagattttctcaaactttctagtccacttttagccctcctttttgtttccaattatcatttaataaaaagagcttgtattttagagactctggagggttcagaaaagtgagtgtcaagtgttcagtgtgcaatcattaaagacagagaatatctcataagtttgcatctgtgttacttacacgattgtgatttacggatgctttatttctttccctttcccttttatttttccttttgtttcttttatgtatttattattattattatttttagagactcactctaaaaaaaaatagggtctcactgtgttccccagactggaatgggactacaggtacatgccaccatgcctggctaaattaaattttttttttttttttttttttttttagagacagggtctcactttgttggccaggctggtcttgaactcctggccttagtgatccttccatcttgtcctcctaaagtgctggggattacaggtgtgaaccactgtacctggccaaagtttttattttttaatatgatgtataaggtttagaagtgctttattttatttatttatttatttttgagacggagtctcactctgttgcccaggctggagtgcagtggcacgatctcggctcactgaaacctccacctcctgggttcaagcgattctcctgcctcagcctcccaagtagctgggattacaggcgcccaccaccacgcctgactaatttttgtattttttagtagagatggcatttcaccatgttggccaggctggttttgaacttctgacctcaagtaatcagcctgccctggactcccaaagtgctgggattacaggcgtgagccaccatgcccaggagaagtgcttttaactccacacgtgtttaggttttttggtttgtatttgttatttttacttttttccttttactacatcaaaatgagtcctttataatttctgccctagggaattctaataatttttctttgtggtccaatataaaatcatttttaatgtatgccatgaatgtagtcaactattgataataatgtagtactagtagtttgctcagtcagcacaaattgtcaggacacagtggtaatttctgcatgtggattatctcctgattcttagaacaacatgaaaccaggctcatgaaagatgagtaattatcccagggtactgtctccctcacctccaatggtgggccagagctaggtccaagactttgaattctagagtgttagacaccatcctatgcagcctcccactgagtaagggtggtcactgtttgtagggtgtagagtttgatagatacgtctgttactttgacttcattagttttatttagaatgcttgaatgtgtgaatgtattgattaatatattcgttattgccttctctctgtgcttggaagagaagaaaattgaagtttaccactaccatgggtttactttgcgtgctttgttatttggtgtataaagattcacatcttagatcttctgtaggtcatatggtgtttcgtttaaagggaatcttcttctgaagagtttagccttgaattctgctgagatttacattggcaatcctgtttgcattttgtttgccttggacagccatacttttatgcactcctttcctactaatgtgtttattttgcttttgatgttgatatatttgttcaaccaacatttttagatgcccgagtgcgctccaagcactgtctaggtgtcacagtggcgattgggatacagtcctgccttcatggatcttctgggctggtcgaggagacagacaataaaccagtcaatgaatgaataagtaactgcaaaattttagttctgctctaatgtggtagccattcacttcatgggggttatttaaattagttaaattaatagtagcttactcattcagcatgtattgtcggacacaatggtactttctgcacatggattatctcctttgattcttttaacaacatgcggtatgtattgttatcggtcctacttacgaggtaaccaggactaggcacatgaaagatgagtaattaccccagggcactgtctccctcaccctcaactgtgggggtaatttttaaaataaaaattaaggccaaatacagtggctcacgcctataatcccagcactttgggaggctgaggtgggcagatcagttgagctcaggagttcaagaccagcctggacaacatggtgaaaccctgtttttactaaaaatacaaaaattagccaggtgtggtgacacacacctacagtcccggctacttgggaggctgaattgggaggattacttgagcccgggaggcattgcagtgagcggagactgcgccactgctctctagcttggatgaccctgtcttccaaaaaaaaaaaaaaaaattaatttgaataaaatttgttgttcctcacttgcatgtgtcatatattatgtgcttgatagtcatgtgtctagtggatactggattgaacagtgcagatgtgggacatttgtcagtgcacgaaggtttggtagacagtggtgccttagatgccgtcatggagatgggttggttctgaggtacagtgtcaagtcactgggggcacctggagtggtgacctgagaaaacctgaattttgagaaggaacctgtactgtgagggtgttgtctatggggcatgtggtacttgtatttaggattttggtaaaaagtgactattcataagctatttaaagtttctattttaaaagtatagggtttttaggtagtgtgttttcttttgttctaataggaattgttttggtcatattagggaaaataattggcttgttgatacatttttatttccattgattaaatctggtagccattatttacttttatagattgaaaaatggttcagtgtttcaaaagtattttgagcttgtctttgaaaagagatagacaggcaggtgcagtggctcagacctgtaatcgcagcagtttgggaggctgagatgggaggattgtttgtcaggagctcaaggccagcctgggcatcatagcgagaccccatctctacaaaaagtaaaaaaattagctgagcgtggtggtgcacgcctgtagtcccagctacttggggggttgtggtgggaggatggcttttccaattatcctacagatatttttcaaaatgattacttttaaactataatctttttattcagaggtaggatgctagttctacaattgcctaggtcttctttaatttgtatatgttaagaaattttaatgggcaatttaataagtgttgaaatttctaagaattatttctgtatgttagagttgtgataacgcagacattttccctgaagtacttctctgagtctgatttgttttcctccatgggtgccacataggtttcttttaagaaggtaaaaaataaaagctgactaaggtacatattgattattccagacaacatgcagacatcactcaatgagtgcagttctcatcaactcaccatttgtttcaattagaaaaaattctcatcaaaactaatttttctgcatgaaataccttttcaaatcacactgaatgtgatttattaattgtgatttatcaaattcagttttctgctggatactaaaggcacacctcattaagactagtgattatggaaatagtacaatattttagaaacttttgattgtaaaaatttcttttaaaatgaatacatacagatatgttattgttcagatatttaacacttacgtagaaactcactgatctactaacaagtagaaaagagacctttagccaaatgcctctgtactcagcaataaaatgattaattactgtgttgctcttttctctggttaaggcttttaacaaattttgtttttccttttactattacaccataacttgtttaaattttgttgctgttgcagaattacagcagacattacagttcatgtctccctgtgtatacgagggagagtttctctgggctgtgtacatgggggagtgtgggcctgacctgtcacattcaatttttatttcacagtcttatatctaatgctcatcattgcataatgtaactagctggggttagtttcctcagtccctgactcttctcttcagagcctgttttctctccgtttacagatgggccaaggttgctcgggtgattggtttactggcttcgcacaaaactgatctccaggaaaatacacctgttgttgaggtaatgtcttttatgactgaaatgtgatgaatgacaagaaatactgttgttgattctgtaatttagaacatgtggctttccttgaccttcacttgacttttctttgtgggattgtggaaattgttcaaaaacttatcacctcaacagacctttaggcttaaacatagcggctcatttacaatgtagtccatcattaaaatggcacagcagagttaacaaggctcgtgaaccctactcatcattatttcatttgtttttgaataagacttgttcatttcccgttttcttgtagtctgtccaacattttgttacagctaatgtatttcctaattaaatcatagcttataattcaaaattcaaattcttctggcttttagtgttttcgtatgaaagattactttctacctattctgttaatgtatattacactttattggtaatagagtgttataccttgaactgggagaggctcaagagtcagtgtaggtgaaaagaaccaaggctttttaggggaaatagcaagaggtcctgaaggaagttaaaaagggtaagggagagaggattttgtagagctgaagctggttgtgtggtatttggggctttaagaggaattggaaaactttctatgtctgtgttgtccactatagtagccaattggtatttggagcctcaagaggaattggaaacttttctctctgtgccattcactgcagtagccaattgctgggatagtataccagctggccttacagtgtctgggtggagattaatataatttcactgtatttcccttgcttacaattacatctctatttcctgcaaactgttggatctctgagctactagtaaaatgccactaagtctaattgtttccttttttggggggcctaaaataaatgaattgtgacctgtgtgattactgatggtacccaacttggttctcagagatgtgtcgagtagatttttatctaaaagattgagcatatagggcagtattaccaggaagatgagaaggcttaggatcttaaaaatgggggttccttctgatggctcagagcaaaaggtctccagtgagatggagtagctgtagaagatgggagagaacataaagtccaagacaaagtcccaagattttagaggatattcatgcatcgtcagagcaggcatttgttgctcagaagctgtgaagaaagagcctctgaatatgtaaaatatgactgttgaattaaatgattcagtagttgcagtagattatggatactttaggaagctgagttagtgaatttgaagatcagttggatgaattctcttaggattcagaaagaaagaggataaagattgtgaattaaaaaggcatggatgatagtttcagatgtgttccactatccagtatagtagccaccagccactgtggctattgagtgcttgaagaacagctagtctgaattgagatgatcaacttatagaaaagaatactatgggcaccctgtaatttccaaaccccttgttctacttgatctttttcacagcatatatcaccacctggcattttatgtatttatttctctttccatactagactacaagctccattggaacagggattgtgaattgtcttgttcaacactccacccccgtgcctagacagtgtcttgtgtatatctagatactgacaaatattttgaaataagtgaatgaaagtgtatcagtatgcttgggactccctgtagcagtgcctggaagatggtatgttttgctgctgcaggaattctcaagggactgggcagagggcatgtgaagtaatctgggacctgcttgtcaccctgggtgatgtgctgcccttgttctactggtacttgctgttgcggctgctgcactcccacttggagagtttggcccagcagttcctggaccatatttgttacttgtgctcactcaggttgagttctgtggccagtttgtattctcaaagtatttctgctactccagttatactttgtcaacgttgtattcctggtcctgcctcaactgagaggaaagggtgggtgttaattcccgaggttcttgtatctttgattccggtactgttctcttcatgggtgtttgctgatgctttattaatttgaaatgcaagaccttagggaaaatcatacttatttcatttaaaaaatggtgtgtactgaactatctggtgaactgttttgaattacacacactgtattgtgaactacatttggttggatagtagggagcttatataataacttgaaattgagccaggtgctcctttgtgatgccatcttaattttattatttctccacaccttttagttctttagttcgttacttttaatggcaaaatctgtgaatttcttttacatcaacctatttcctgctgtgagcaattggctgtgataatttaaggagccactagaggtcattcaagcactagaaaaaaagttgtgcaagttttaagaatttgtttcaacttctggaagcaggatctgtagaggctgagcaggtacatggtaccacgtttcatctttttcctggttttttagaagtttctgctacaggatgtgtggctccattccactggtgatttttaccatttgagaggaatcagatgaatgaaaaccattatagcctctccagaaaaatgcagtcagcacctagcacatgatttcaggggatctgaaaactctgcggagtccactggtgaatctttggttcataactcctgagaccaggtttctgtaaaactcacaattgggtgcttgtagataatttttcagtaatcagtaacaaaatttcaagtgtaagataaatcctgaattctctattagatttactatcagtgaacaagaaaaattgtggttgaagttcctgtaagcattttattttttattttacttatttattcatttattttttgagacagagtctcgctctgttgcccaggctgtagtgcagtggtgtgatctcggctcactgcaacctctgtttcccaggttcaagagattctcagcctcagccccagccccacaagtagctgggactgcaggttcatgccaccatgccccgctaacttttgtatttttagtagagacagggtttcaccatattggccaggctggtcttgaactcctggcttcaagtgatccacttgccttggcctcccaaagtgctgggattacaggtgtgagccactgcaccagcctggtactttctaatattttggatgctttcttacttgctaagcactttctcttacctggaatgttttttacattaccccctcccccagtgatctaatttctactttctctttaaagcccagctaacattccattttctccatcaggccttccctaacagtcccagaactcctacattgcctggtgtgctgacctaaagccctcattaagaccagtaacaaatcaagcctatcttatcaactgacaacacattctggaaccatggcgtgtccatggataagacatgaagtccttctttcaagacttggttttctggtcctggaaaataccaatatggataaaagaccttcaaagctgctacgatgggtaaggaacaatgcacacagtataccattaaggcaaagaagatagtcttaatcctgtatgaaatgccaatgaagatgtaattaatgaatagacatttcattgaaatgaaatcaaaagacattttccttctctgacataacagagtagaactctctagtaagaacacaaaactgaccagcctgaccaatgtgataaaaccccctgtctctactaaaaagacaaaaattagccatgcatggtagcagatgcttgtaatcccagctactcaagaggctcaggcatgagaatctcttgaacccaaaaggtggaggctgcagtgagtcgagatcgcacaactgcacttcaccctgggcgacaaagcaagactttgttttttaaaaaaaagaagaagaagagaa

SEQ ID NO: 2223 - DNA, 28189 bp, Homo sapiens
aggggtgaggggtaagaggtgaggggcgacgaggaccggggcggggtaggggcagccctttcccaggcggtagcgggggcagtggtgctgttgcccttttaaactgcggcttgacgggagccgcgcctcctgtcggtggagtcggttataaagggagcagccccgcaggccgccacatagctcccgccaagtcctcggtgccccttgccattttccagccgcgctcccacgagggtcacggcggcggggagaggtggagccgcgagagctcggccgggggccccgcctggtggtcgcggccatgacagcggctcgggactggctccttttccgcgcccctcccgccggaggtgaggggaagatgtccatgtccgggttcaagggcaaaccgaagttactggcctctatcttccaggagaaccaggagccacagccgcggctcacgccccaccgcaacattaaggtgagtcgccgggtggcggcctggcggggcagggcgagggcggaaagcgggtgcccagagtcccaggagaaaggggaagctgccccagagaggccgcggttccccgcccctttctcccgcaactggcccgcccggcaaggcagaggcttgggtgggagaaggcggagggcgcgtctctccaactcctagcgcggggctggcttgggggctgctggcccctctcggcccctgtcgctgcgcctcgaggtgggagcccgcggctgcgggagctctcttgggacccatggtcgccctcagtcagcccacctgctctagggaccgcgacagggcggggcagggcggctcccgcgttgttggagcccaggcggggaaggggaaaggcctttaagattttcggttttttggccgggcgtagtggctcacgcctgtaatcccagcattttgggaggccaaccgggctgatcacttgaggtcatgagttggagaccagcctggccaacatggtgaaacccatctctactaaaaaatagaaaaattagccggtcgtgttggcaggcgacttaatcccagctatttgggaggcagaggcaggagaatcgtttgaacccgggaggcggaggttacagtgagctgagatcgagccattgcactcaaacctgggggagaagagcgagacttctctctctctctctctcaaaaaaaagttttctttctttttttctttttgttgagacagagtctcactcactctgtcgcccaggctggagtgcagtggcgcgatctcggcttactgcagcctacctctcttgacagtccactggttaaagcgattctcctgcgtcagcctcccgagtagctgagattacaggcgcccgccaccacgcctggctaacttttgtgtttttagtagagacggattttttagtagagacgcggtttcaccatgttagccagcatggtcttgatctcctgacctcatgatccacccgcctcagcctcccaaagtgctgggattacaggcgtcagccaccgcgcccgccctctgttttgttttatacatgtaatatattcacaagtatctttacgaagtgattttgatactcttttgtcttctccctagaatctctttgttctgtaataattttttcttagtttatattgatcttattttcctttttaaagcctttccttacatatctattctatgttgcttatcatttgtagtttttttattttttatttatttatttatttatttatttatttatttattttttattttttttttttgagagggagtctcgctctgttacccaggctggagtgcagtggtgcaatctgggctcactgcaagctccgcctcccaggttcacgccattctcctgcctcagcctcctgagtagctgggactacaggcgccagccaccacgccccaacaattttttgtattttttagtagagacggggtttcaccgtgttagccaggatggtctcgatctcctgacctcatgatctggccaccttggcctcccaaagtgctgggattacaggcgtgagccaccgtgcccagccctgattctatattatagtgagttgtacaattatttcattatatgttacaatgtaataataatagaaataaaatgcacaataaatgtaatgtccttgaatcatcccaaaatcatctcccccaaccttgtctgtggaaaaattgtcttctgcaaaactggctcctgatgccaaaaagtttggggactgctggcataagtggtctcatatagtagttgtccttttgtgcctggcttatttcacttagcataatgtctttaacgttcatccatgttgtagcatgtgccagaatttcatttgtttttaaggctgaataatattcccttgtatgtatttaatatgcctttttatcttttcctctgttgatgaatacttgggttgcatccacctattggctattgtgaatagttttgcattgcctgtctttctcatgatcgccatcctatttcgcatctagcaggtgtgaaattccattgattgagtgattgattgagacagggtctgactctgtcgcccagtctggagtgcagtggcatgatcttggctcactgcaacctccatctcccaggctcaagcaattcttctgcctcagccttccgagtagctgggattataggcatgcaccactaccagctggctaatttttgtatttttagtagagacagggtttcaccatgttggccaggctggtctcgaactcctgacctgaaatgatccacctgtctccgcctcccaaagtatttggattacatgtgtgagccactgcgcccagctagtaggtgtgaatttctatgtcttagtggttttgatttgcatttacctgatggcaaatgatgttgagtatcttttcatgtgtttattggccatttgtctgtttttttggggaaatacttattccaaaatttaacttatttttaattgggttatgtatctctttattatttagctgtaagaattttttacatattctagataggagttataacaactttcttcctttttctggattgtcttttttctttcttgatggtgtcctttgaagcagaaagattttaaattttgatatagtccaatttatcttttttcatttgtgtttttttgctccttgtgcttttggtgtaatatctaaaaaaacgttgctactccaaggtcacaaaggtttctgcctatgtttttttctatgagttttatagtttatcaatatctcttatattgagctcttttatccatttgaattaatttttgcatgcggcatgaagtaggggggtatagcttcattgttttgcacctagacatccagttatctcagaactatctgttgaaaagcttattctttccccattgaattgtcttggaacgcttattgaagatcaattgactgtatatgtgaaagtttatttctggattctattcttttctctgttcatctgtccttataccagtagcacactcttgattactgtagctgtttagtaagctttgaaatcagaaagtatgaatcctccagaaagttttttaaggtgggtttggctgttccgggtcacttgcatttccatatgaattttaagatcagcttgtcagtttctgcaaaggagccagctgggattttaatcacagtcgcattgaatatgtagatcaacttagaaagtactgccattttaacaatattaagttttcctccatgaacacaggatgtatttgtactaatttaggtcttcctttaatttctttcaatcgtagttgtgttgaatgcagacctactttgaattaattctaagtaatttttatgctacttattggttgacaaatataattgcttttagtttttaactgtagttttgatgtaatgtgaactgtatttggaccttgtgaagcttatttctgctttgaaatttagtataaattggttataataaaatctgactgtgctaattttttggttatgtgaaatagaaaatcaatgtaaatttaaaaatttattctgggccgggcgcagtggctcacacctgtaatccaagcactgtgggaggctgaggagggcagatcacaaggtcaggagatcaagaccatcctggctaacacagtgaaagcccatctgtactaaaaatacaaaaaattagccgggtgtggtggtgggcacctgtagtcccagctacttgagaggctgaggcaggagaatggtgtgaacctgggaggcggaggttgcggtgagctgagatcgcaccactgcactccagcctgggcgacagagttagactccgtctcaaaaaaaaaaaaaaaaaaaaaaaaattcattctgaaatgcgatagatgttgaagctcttctggcagatggttataaagaggaatatataatcattctattgagaaaatataatcaataatgtgaatacctaaggtagtttattttacatatatatctcggtatttatttatttttgagacagagcctcactcctgtcacccagggtggagtggagtggcacgatcatggctcattgcagcctcaacttcttgggcttaggtgcttatctcatctcatcgcagccacctgagtagctgcgactacaggtgtgcgccaccatgcatggctaattttttgtatttttagtagaggtttccccatgttgtccaggctggtctgaaactcctggactcaagtgatctgcccgcctcggcctcccaaagagctgggattacaggtgtgagccactgtgttggccttatgttttataatttttaaatgatactttttattctattacaaaacatatataattgtaaaaaacttgtaaaatataaaagaggacaaagacagtagaaaaattatttacaatgtaattcccaagtaaacactgattacctttttttttttttttagagcctgttgctcaggctggagtgcagtggcaccatcatagttcactgtaacctcatacatctcatacattttgatattactacttctggttttatacataatgtgttcactttgaagcaagagagtataattttataacgattattttcatttaatgatcgtgatctcattgcaattattgatcatttagtttattcctgaacattttgttttatatatttttgctattgtgagtgggatatttgttataacttggcatttgtgcctacactcaatttacctataggaaactaatttttgcatacaattgttttaattggtgcagtggcacaatctcaactcactgcaacctccgcctcccaggttcaggtgattctcctgcctcagcctcctgagtagctgggattacaggcacatgccaccacacccagctaatttttgtatttttagtagagacagtgtttcaccatgttggtcaggctggtcttgaactcctgacctcgtgatccacccgccttggcctcccaaattgctgggattacaggcttgagccaccgtgcccggcctcggcctctttgtgtgttttcgtatatctttcatctgagttgcaaggggcaccttgggtttccaggaattttcttagctaactctgttcctttatctatgacccttcctcactagttttggataatttattttccttcttccttacttcactgatttacttttctattttatttagtttgctagtcattgtttcttttaaggttcttaagcataaatccttttttttttctgatgggaaatactggggcatagcactaggaatacaaattatgtttaaatagagcacaaagaaccatctcaaaggaataactgatggtgaatgtctggtgattgattttattatgtatcatctctaatgaggcttaataaataattgaggtttaacacttaggtaaccggtctgtatttaagtctgaaaatttttgtatgttacagtttcaacttcacattgaatattctgtaaagcagaaataaattgatcagcattctatgaatgaaaaataaagccatgggtcgggtgcagtggctcacacctataatcccagcactttgggaggccgaggcaggtggatcacctgaggccaggagttcgagaccagcctggccaacatggtgaaaccttgtcctagctactggagaggctgaggcaggagaatgactttaacccaggagacagaggttgtggtgagctgagatcgcgccactgcactctagcctggtgacagagcaagactctgtctcaaaaaaaaaaaaaaaaaaattagctgggcatggtggtgcacacccgtaattccactacttgggaggctgaggcaggagaatcacttgaacccaggaggcagaggttgcagtgagccagggttgcaccactgccctccagcctatgtgacagactgagactccatccctaaaaaaaaaaaaaaaaacaaaaaaaaaccatgctggtaatcgaaaaagcagtttgcctcatcagagtttagaacgttgaattgtaaagatcttttttgtagtcctagccagttttaatggtaacatgagcaattcagttactttctcagagttttatatttttatctgtaaaatggaaattatggtacctacagtttaggatttttgtgaaaatcaagtgagactgcaagtgtcttgaatagcagtggaagtacattgatataggtgatattttacagtggtgtcttcctcagcatcatattagttcagtgttttaaagctctatattagtcacagaaacaaagtcaaatttttgttctcatttcagattacaagtggacacctgagtcagcaggacctggaatcccagatgagagagcttatctacacgactcagatcttgttgtcacccccattattgacaatccaaaggtgcagaaagcactctgacaagtgagttgtagactttactgagatctgaaatctgcataagattttcattcagaatattatttactgtctaatctttcctgtttctcttgtccgctactctttcatttgtgctgcatgtctgcatttccagctcccgctctgtctgcaaccctttcctctgccttcacttccgcttcactggagttctaagttttcccccctctgttttgaatgagtcagctctgcttctcactactgctttcttccacatgccacggaggggttgccagcctcttgacctcagaccttagctctcagtcccatcgtttctccatctgcactaatgtgaatcactctaagtattctagtctctgatgtgttttgaaggcagaagcagtcagagggcactgctcaccaggctgggctgggcaggcagatcacacggaagccctgccctgtcacaggttgttaatactgcaggggagatggtggggagacactatgggaacttgaggagtcatggttcacaatgtacttctaaaccactgtgagtttttttgcttcttgtcttttggaatataatactttattgctgggggataatgagtatttactttaaaaaacagatgcatttctaagtccctctgttttgtcttgacttccagctccccaacatactcacattccactacttattctctattttaactttactgcttcttttacttttttttagttttacttttattttttatttttttgagacagagtcttgctctgtcacacaggctggagtgcaatgacgcgattttggctcactgcaagctccgcctcccaggttcatgtcattctcctgcctcagcctcccaagtagctgggactacaggtgcccgccaccacgccctgctaattttttgtatttttagtagagacagggtttcaccatgtaagccaggatggtctcgatctcctgaccttgtgatccacccacctcggcctctcaaagtgctgggattacaggcatgagccaccacacctggccttctttttcttttttaaatatctttttctgtattaattcatgactgtttttttcttgtctcattgggaacattagtgtggtttagaacaatgtaagggtttttggattcatgtttattttctagatagacagcattttatatagatgatttagctgtttttcataatggagctaattctttttgtgagttcatatgtctggcagtgtaactttattatgctaagtttgatgtgcattggcgcattttcaaaatgggctttctagaacaatttgtgatatctttcccaggggtgtccagtcttttggcttccctgggccacactggaagaagaattgtcttgggccacacataaaatacactaacaatagctgatgaactaaaaaaccaataaaaaaaaattgcaaaaaaattcttacgatgttttaagagagtttatgaatttgtgttgggccatattcaaagccgtcttgggccgcatccagcccacgggctgcgggttggacaagcttgctttacacaatattctgtgtttccttttttcctcttataaccatatttgatagtttatgggaagccttcatcagtggaaatttttgtgtttaacttttaattctaaactacttttagagaaaagattaaaaaatagttgagaactcctgtatagcttttgcccagctgctcttaatgttcacatcttataggtctatagtatagttagcaaaacctgggaattaacattggtatagtgttagtcaggcgggataatccttacctgtgcctccttttggagggcagcagaatgtggtagttggaattgcatgatacttgattcatatctctgtgtaatgatggcatgcaataccctgactgctcctttcgaattcttcctgaaaagggaaaaataaaacatgagaatagtgctgctaactaccaaatgcatttgaattttaccggttgcctctaatgtcctctttttttttgttccaggatcccacattacagttagttgttatgccttcttagtctcatatagtctgtcctagtttttcacggttttgtcagaatttctcagactttgcttgtctttcatgaccttgacagtttgtcttttattttgttttgttttgttttttgtcacccaggctggagtgtagtggcgcgatctcagctcactgcaacctctgccgaccgggttcaagctattctcctgcctcagcctcatgagtagctaggattacaggcacctgccactgcacctggctaagttttgtagttttagtagagatggggttttaccatgttggccaggctggtcttgaactcctgacctcatgatccacctgcctaggcctcccaaagtgctgggattacaggcgtgagccacggcacctggcctttgtatgtttttgtaatacatgttataaaacgtatgactcaagtccttgacactttgaagagtaactggttgggtgttttgaagaatgtcccttaatttaggtttgtctaagggtttctcatgactcgaatgagattatgaatttggattatgagattagaatgagaatatgcattttagtaagaatactacagtaaatacagtaatgctggttacttaattagtaaaggttttaaaaatattacatatagaagttttgcagaagttaggtatagaaatgatggttgaatttttaattaaaagtctcaagatgcagtatctggctgtcctaagctcatggatccaactacatggtttcttcacatttctcaaataaattatgcactttccaattcatgctattatggcttccttgaatggtgtcttctctgatataatcataaagttctagccatccttcaagaccgcaacccaccttctacgtcttccgtaaacccggtgtcaagtatatcaagtaaagtgcttgctgtattctctaaactactatttacaaaaaaaattctttctgtccagggttttgtctgtagttatgtcctgcctcttttgaattgtgaaatattttcttgtttatcaaatgtttgtctcatcttcccaaccagaaagtcagctcgctgaaaataggattgtgtcttttatatctttgtatcccccttagcacttgacatagagccttaccttggcaggtaagcaatagatatttgttgaaagactgaatttctaattagacgtaaattacctaaaaagtaagccaggatggggtgaattttttctttgaagctttattttattacagatatcaattgaaatgattttaaaaaataaattattatctatatatgtatgttttaatctgaaaaggcatcgttctttttgtttttggtaacaaattttacacattctttttttgtcctcattgatttattatctgatataagggacatataaggagacagatatccatctttaaaattgcctcaaaagttttttttttttttaaccacagataaggaaacaaccaccatcggttaaatttgatgcaaaaatattgcatctaccagcattttcaggtaggatcataaaggacttatcgaacatgtagactgtctgtatacagatacgaatatgaaatttattcacaaatggaatatttgtatgtgaacaactaaatttattttgtcttgacaattggttatattcttgggtcagtgttatgtgaattgtaaataatctgtaattcatttgtgccagctgttgacatttctcagctgagtctgggctgccctgtcctcttgtgagtggggaggttcctgtagatctgggcaagttttcctgtagagtgggtggggggcctcctcccttccgttcatagagctggttgaatttccaccatttatggcaggtgtaggtgcacagggttggggacaacaaggaaggattgggattctattggcgggaccaggacatttgagaacgggactaggtggttcatgactgtggagatggtgtgggagtggagatacttaagggataattattacatttctgttgagctaatgaaaatcttatttacggtgaaagtcagaaatttttacataccttaaacttttttttttttaacaaattatattttaagctgttaaactcaatttggggaaaattattcattgtggctagagtagaatctatgatttgaagtaaatttaaaatatatttaggtttaaataaaccagctaagggtttatatcagtcaacttaattagtgataaaaacaaccaaaaaaacctgtgtagaaggacgtttttgaaagaccaaagtgaagcaaaatattaatagtgctttcagtgccaagtaggtctatttatgcaaacctagagaattattatcgggaaatactatttcctttttcttctttgagttacttaggaaattatatttacaatttctttgtctaaagattgagatcagcaaaaacatgttagcaaaaaattttagggagtatcacatttcctagattttgccctttttttatagggatttggaggtaggaatttcaggtgattttagctatcatgttatcctcgttatttttttacagtaatttcattggaactttttaataactgtgtggtttgtgcttttctcaatatctgagagttgatttatttatacaaaggcttttttgtcttttactccagttgtattgaactttgcattttgttataatctaggttgtgagacaattctgctttagacatctgcttggtttgaaagcatagttttccattgaagtgtttaaaaagtttccatggatagataaagagatgaggaatatagaaggacaaatagaagtagtgtcatctttggagtatttttggtgttgacagagtaatgttttctttgtcctcatcttagctgtcgtaactctgtgtttatttctcatgtaatgtttccagcagttgtttttctcatcatcatacttttgttattttctttccttggcaatggataagttataatttctgaaagaccaagattggaatgactttttgtaacaagtgtgctcgcagatcgactccagtgagaagagctcggggacctcctgagccaagcttaatctcctttgctgtttgtgagtggtggctggtcaccaggaggtggccaccaggctcctcctttccccgctggtaggcctctgtgacatgacttatgcatttaaatttatgttttttatagaggctcaaacaagtgctaaaatagcaatttgatttaactaccatgaaaaaactgatttatcacgattttaggtttatgcaaattatcctctgcttaatccttacgtcttaaagtagataagagtagacggtgattttgaactttttgttgttgttgttgtttgtaatactcaggtttccattttatgttaacttgtaagatttttaaaaaatatgtgaaatcaggccgggcgtgatatcataagacagaccttttaccttctcatcagtgactggaatgaacgcctgtaatctcagtactttgggaggccgaggcaggtggatcacctgaggtcagcagtttgaaaccagcctggccaacatggcgaaaccccatctctactaaaaatacaaaattagcagggcgtggtggtgcactcctgtaatcctagctacttgggaggctgagacaggagaatcacttgaacccaggagccagaagtcgcagtgagccgtgatcatgccattgcaccccagcctgggcaaaaagagcgaaaccccatctcaaaaaataaaaacaaaaaacaaacaaaaaaaaatgtgatatcataagacagaccttttcccttctcatcagtgactggaattaactgcccatgtggaacgggttgtgggtgttggttcctttactgggtcatctggtaaactgcaaggtttctgctgtgacattgaaggcagacatcaaccctctaagacatttttttcctatcctctgggaatattactttttggacaatcttggtccattggtaagctcatgggaatttgtcagagtttttttgtttcttttggctcatgtttagcatcgattggcagagtgtttggagtcatcctcagaaaggaattacagtggttcggaggtgttttctgtagtgggccctcatttgggaattggcttgaaaaaaatgtaagttcacttgcttccaggatggtattaagattgctttttttgatagttggcgtgtgtctatcaggtaagggctgtcatttagagaatataaagtggtaggagaaactaaaagtactgttcttagtttttattttaatcttattcgtatacaagtgcctttgtaatttagcaaatatcatttttggtgtacagtataaatttcctttttataaagatctgagtttttaactttgctgtcactttctgtgtttcatgacttaaatattttaattttttctttttttacatttacattttttattctagttccaattgctaatccagcatttgtggatagctgcaaactgcgatatgtaagtaacatttacattttaaaaattatttctcatggttttattaagtagttacagcatacatatttatcaaaagcagagtcctaagtaattatcataaattttcctgatgtaatgatgaatttactcataggcaatttttatgggcattccaattataaactttagaatatttaaaaatagcccttctcctaatatagatacgattctgggattatctaagctactcctggaaactttattaactgttgttgtttttttattttcgtagagacaaggtctctcactatgttgcccaggctggtttccaactcctgggctcaagtgattctcccatctctgactcccaaagtgttaggattacagacgtgagccactgcgccaggctaactgttactgttttgagtattggttataaaatacttcaaccctgatccctgtgtattaatttagttatacttcctcaaagtttcccttgggcacccttatctgtccctatgtagcacatagcttccctatgatgttatttataatctaatgagattaattatgatttataaactcccgatggaaggaagtgtccttactttttatagaagcaacataccaggtggaaagcaccgtagatcaagtgttagaaggctctgggttcctgttgcctataagacttggccaaatgattatctttttctcaatctctgtttcctggggagtgtgggtgggacaaggaaatggcataggtttaggattcagacagacctgggtgtggatcaaagatccgctttctgggccaattactttaattgctgagccgcagtttcctcatctgtaaaattgggatgggataactacttcatagatttttggtaattattcaactttgaatgtggtaaatatgtgagatacctggtatagtgcctgtttctttctttcttttttttttttttctgagtcggcatctccctctgtcacccaggctggagtgcagtggtgcgatctcagctcactgcaagctccgcctcccgggttcacgccgttctcctgcctcagcctccttagtagctgggactacaggcgcccgccaccacgcccgcccggctaatttttttcaccgtggtctcgatctcctgacctcgtgatctgcccacctcagcctcccaaagtgctgggattacaggcatgagccaccgtgactggccgtatagtgcctgattcttagtgggtatttcattgacagtggggttggggttgtagaagttgtagttattatcatgaagcttgcttatctcatgattgttaggacaggcacatgaaaaaacggaggtgaaaggattttgtgaattgtggcagtggtataataattattcttctatgctggtgaaatatgggtgaaacaataggagtttagaaaatgtttaataataagggtaattcttattatacgtcttctaatgttactctcgcaaaataaaatctggtaatagaaagtaggatttttaggtaatggttgagcatttaatactttgagaaggcttatggtatgctcattaaaaatgaatcaatgaaatatgtatctaaacacttttatttaaaacgtgttatatacctgaatggggtgctccctgctgacattttcagacagacattccaaatcatttccgagaacagtcatccctctgtatcagccaggagaatggttctagtatccccttggatactaaaattaacacatactgttttttcccccactgttaaaaattgaggtttgattgtaaaacagttttaatttgaataaaatgatactgaggtagacaagttctctggtaggaatcttcttttattctctttctccatccaaagccacttccagcgaggttttctctgacctcaggttatattaccttgatagcatatgataaagggtccttaacttagtctgggagataattattattgaagtagatacttagttttgttttgcttataaaaaattagaatcacatgatatagttttttatgtttgttttcccccataacatatatattatgtattttaaatgttatcaacattttaaaataaaatacataatacttaaggtaaacgttttatatgttgtgaatatctgatcattttgtttactatttttggatagtattataatgttgtaaacaacattttgatgaacatttttgagattaaatcttcgtgcccgctttttctttttccctttaggaaagattcatagaactagaacaaatgggtagaaggcagtaaatatctttgtgacttctgaaaaattgctgaaatactcttaaaaaaacattgtatcaatagataatcccagtcaatgtgtttaaaatgccttttgttagaacttccaacgttgagtatttatcaaattgtatatccttttatccttgccaatcaactttatgaggtataattcatatatagtaatagtgtaatactgtaactttaaaatgtgttacttgtaaattacacataatttaaaatgttccattttagctatttttatgtgtacagtgacatttagttcattcccattgttgtgtaaccatcaccactattcatttccagaactttttcgtcatcttaaacagaagctctttacccgttaaacataacttcccctttcctttcccttccccagtcctggtaacctatactctacttattctatcttggtaaatttgcttatggtgagtacctcatattgctactgaaacatcgaggggtttggtctaggtcctgttgctcacagcgcagaaagccaatcacggagacgatgagtgttgctagggaacaaggcttcaattgggtgctgcagctaaggagatgggagatcaatctcaaatttgtctcctcgactgactaaaaccacaggtttatttagcagggaagaaatgtaaccatgtatgggaaaacaggagttagggaagggtgagggagaggagttggtcgacaggaagcaggtagttggttaggcaattgtgatgggtgaggtggtctggtgtcttatggtccagatgtggtgatctggtaagtttcagttccttgataactatctgggaggcctgatggttggtttcccaagaaaggaactcagataagacaaatgtaactttctcaagttttaagactgggagggtcaatttctatctttattttaaaagactgtaaacatcagttctataggacaattgggctggtttcatttgcaaggtttatccatgttgtaactaacatgtgtcagcatttcattcctttttaaggctgaataatatccctttgtatgtaatataccacagtttatcttttcatctgttgttgggcactggcttgtttatatcttttggctattgtgaacaatgctgctatgaacattagtgttttcacacctgatgggtatgaagttagtatctcatgggtttgatttgtattttgtgactagtgatgttgaacatctttttttgtgattgttggctatttgtatatcttccttggagaaaggtctagtcaagtcatttgccaatttttttttctttttttgagattgagtctcgctctgtcgcccacgctggagtgcagtggcgtgatctcggctcactgcaacctctgcctcccaggttcaagcgatcattccatctcagcctcccaagtagctgggattacaggcacctgccatcatgcccagcaatttttgtatttttgtagagacgaggtttcaccgtgttggccagatggtcttgaactcctgacctcaggtgatccacccgctttggccccccaaagtgctgggattataggtgtgagccaccgcacccagctggtagattttttgttttgttttgttttcaagaaggcctctcagtggcttacctctgtgccatgctttggagtttgagctgtcttctctttactaactgtagctctgtaggacttgggagtcaaccttaccttcttttttcctccctattttgtaggtcttgtttgagttagcttttctttttattccaggcctgtaaattttactagattgtctctaggaatttcattttactaatttgcttcagcctgcctgcctgccatctctttttactaatttgcttctgcctgcctgcctgcttccttccttccttctttccttccttccttccttaattccttccttccttccttccttcttcccttcctctctctctccctccctcccgtcccttccttcccccctcccgtcccttccttcccttcttttctttccatttattttgagatagagtcttgctctgttgcccaggctggagtgcagtggcgcaatcttggctcactgcaacctccgcctcccgggttcaagcagttctcctgccttagcctcataagtagctgggattacagttgtacgccaccatgcccagcttatttttgtatttttagtttagagatgggttttcaccatgttggccaggctggtctcgaactcctgacctcatgtgatcctcccgccttggcttcccaaagtgctgggattacaggtgtgagccacaatgcccagcctcctcacccctcctttagctattatattacttcctagatttcttcctctctatttcaccctttttctgttcctgaaacccctacaggatgggtgtgggagtttgtgtctcatgactcttctttcaaattttcttttgctttctcactttctcttgtttattgagatataattcacataccataaaattcaccattttaatgtgtacagttcagtaggtgtcagtatattgaaaactgttcaaccattgccactatctaatttgagaacagttttctcacccagtgaaacccagtacccattcttctccaacccctggcaacaactaatctacttcttgtcagctgatttgctattcttgatatttcatataaatggaatcatacagtgtgtggccttttgtgtctagcttctgtcatttagcataatgttttcaaggttcctccgtatggtggaatgtgtgagtacttcattctttttctagctgaataatctttgtatggctattccacattttgcttatgtggtcttgatggacatttggggttgtttccacatttggctattatgaataatggtgctctgaacatttgtccacagggttttgtgtgaacatatacgtttttatttctcctacagtggtgagattgctggataaaatggtaactctgtgttgaaccttttgaagaactgccaaagtctctttgttaaacttttattttaggttcaggggtacacatgcaggtttgttatataggtgaactcatgttatgggggtttgttgtatgaattatttggtcacccaggcactaagcttggtaaggaccaattgttattttttctgatcctctccctcctcccaccctccaccctaaataggcccccgtgtcgattgttccctctttgtgtccatgcaaactttcttcttttattgctcttccttgactttatctttgagctctcaaacttgatatttatccccactcattttattatttaggatttccagttaattttttaatttcaacaatcatatttgaaagtttttgttcattttctttttctctgattggtcctttttcctagctgcctatatttggtatataatatacttttgaatttgaggataaatattaggattataaaaatcctcatcttggagcagaatttagaattaaatattgttattaatatttaaggctaaacattaggattatataatataagcctggaacctggactttgaaaaaaagggaacaaaattaggattatgaacattgtattcttatctcttgaacttgcaggtcacttctttttcatcatggtcctgctttttaatgctgtttatttctcaaatgcctggtgatctctggttcttcatttatattatgaataaatgattaaattgattggtatagaagttggcaatatgagtttcctttattcttgcctaagtctctttctccaatagcttctcctttaaagaaagggctggtatgtgggtaggtgaggcctgttgactggttgactttaatttgggattccagctggctgaagatcagtaggcaggctggaggcctctgcaattgccagggtgggtttttctttgcagtggagctggctttcctcatttattcccttccccgcttcggtatctggaggaccacagttgctgcttcccacatccatccatccagtgagcaaggtggattgctcactgtaggaatgattttccacatttactcaggaggccagggctgcagggtttattctgtgtaccagggaagggagatggaaaagagacaggacctgattggctctgctgttccttgtacaaggacacaatttttccttgtgcagttgtttaatctgattattgtcctgtggctcattctttctttttgtctttgtttattccaagtccctgaggcttccttgggaacgtctgtctacctgtggttcttagacaggggattcctttgttgattctctgtcagtcttaattctatttgtgcatgtcatctgagattttctcaaactttctagtccacttttagccctcctttttgtttccaattatcatttaataaaaagagcttgtattttagagactctggagggttcagaaaagtgagtgtcaagtgttcagtgtgcaatcattaaagacagagaatatctcataagtttgcatctgtgttacttacacgattgtgatttacggatgctttatttctttccctttcccttttatttttccttttgtttcttttatgtatttattattattattatttttagagactcactctaaaaaaaaatagggtctcactgtgttccccagactggaatgggactacaggtacatgccaccatgcctggctaaattaaattttttttttttttttttttttttttagagacagggtctcactttgttggccaggctggtcttgaactcctggccttagtgatccttccatcttgtcctcctaaagtgctggggattacaggtgtgaaccactgtacctggccaaagtttttattttttaatatgatgtataaggtttagaagtgctttattttatttatttatttatttttgagacggagtctcactctgttgcccaggctggagtgcagtggcacgatctcggctcactgaaacctccacctcctgggttcaagcgattctcctgcctcagcctcccaagtagctgggattacaggcgcccaccaccacgcctgactaatttttgtattttttagtagagatggcatttcaccatgttggccaggctggttttgaacttctgacctcaagtaatcagcctgccctggactcccaaagtgctgggattacaggcgtgagccaccatgcccaggagaagtgcttttaactccacacgtgtttaggttttttggtttgtatttgttatttttacttttttccttttactacatcaaaatgagtcctttataatttctgccctagggaattctaataatttttctttgtggtccaatataaaatcatttttaatgtatgccatgaatgtagtcaactattgataataatgtagtactagtagtttgctcagtcagcacaaattgtcaggacacagtggtaatttctgcatgtggattatctcctgattcttagaacaacatgaaaccaggctcatgaaagatgagtaattatcccagggtactgtctccctcacctccaatggtgggccagagctaggtccaagactttgaattctagagtgttagacaccatcctatgcagcctcccactgagtaagggtggtcactgtttgtagggtgtagagtttgatagatacgtctgttactttgacttcattagttttatttagaatgcttgaatgtgtgaatgtattgattaatatattcgttattgccttctctctgtgcttggaagagaagaaaattgaagtttaccactaccatgggtttactttgcgtgctttgttatttggtgtataaagattcacatcttagatcttctgtaggtcatatggtgtttcgtttaaagggaatcttcttctgaagagtttagccttgaattctgctgagatttacattggcaatcctgtttgcattttgtttgccttggacagccatacttttatgcactcctttcctactaatgtgtttattttgcttttgatgttgatatatttgttcaaccaacatttttagatgcccgagtgcgctccaagcactgtctaggtgtcacagtggcgattgggatacagtcctgccttcatggatcttctgggctggtcgaggagacagacaataaaccagtcaatgaatgaataagtaactgcaaaattttagttctgctctaatgtggtagccattcacttcatgggggttatttaaattagttaaattaatagtagcttactcattcagcatgtattgtcggacacaatggtactttctgcacatggattatctcctttgattcttttaacaacatgcggtatgtattgttatcggtcctacttacgaggtaaccaggactaggcacatgaaagatgagtaattaccccagggcactgtctccctcaccctcaactgtgggggtaatttttaaaataaaaattaaggccaaatacagtggctcacgcctataatcccagcactttgggaggctgaggtgggcagatcagttgagctcaggagttcaagaccagcctggacaacatggtgaaaccctgtttttactaaaaatacaaaaattagccaggtgtggtgacacacacctacagtcccggctacttgggaggctgaattgggaggattacttgagcccgggaggcattgcagtgagcggagactgcgccactgctctctagcttggatgaccctgtcttccaaaaaaaaaaaaaaaaattaatttgaataaaatttgttgttcctcacttgcatgtgtcatatattatgtgcttgatagtcatgtgtctagtggatactggattgaacagtgcagatgtgggacatttgtcagtgcacgaaggtttggtagacagtggtgccttagatgccgtcatggagatgggttggttctgaggtacagtgtcaagtcactgggggcacctggagtggtgacctgagaaaacctgaattttgagaaggaacctgtactgtgagggtgttgtctatggggcatgtggtacttgtatttaggattttggtaaaaagtgactattcataagctatttaaagtttctattttaaaagtatagggtttttaggtagtgtgttttcttttgttctaataggaattgttttggtcatattagggaaaataattggcttgttgatacatttttatttccattgattaaatctggtagccattatttacttttatagattgaaaaatggttcagtgtttcaaaagtattttgagcttgtctttgaaaagagatagacaggcaggtgcagtggctcagacctgtaatcgcagcagtttgggaggctgagatgggaggattgtttgtcaggagctcaaggccagcctgggcatcatagcgagaccccatctctacaaaaagtaaaaaaattagctgagcgtggtggtgcacgcctgtagtcccagctacttggggggttgtggtgggaggatggcttttccaattatcctacagatatttttcaaaatgattacttttaaactataatctttttattcagaggtaggatgctagttctacaattgcctaggtcttctttaatttgtatatgttaagaaattttaatgggcaatttaataagtgttgaaatttctaagaattatttctgtatgttagagttgtgataacgcagacattttccctgaagtacttctctgagtctgatttgttttcctccatgggtgccacataggtttcttttaagaaggtaaaaaataaaagctgactaaggtacatattgattattccagacaacatgcagacatcactcaatgagtgcagttctcatcaactcaccatttgtttcaattagaaaaaattctcatcaaaactaatttttctgcatgaaataccttttcaaatcacactgaatgtgatttattaattgtgatttatcaaattcagttttctgctggatactaaaggcacacctcattaagactagtgattatggaaatagtacaatattttagaaacttttgattgtaaaaatttcttttaaaatgaatacatacagatatgttattgttcagatatttaacacttacgtagaaactcactgatctactaacaagtagaaaagagacctttagccaaatgcctctgtactcagcaataaaatgattaattactgtgttgctcttttctctggttaaggcttttaacaaattttgtttttccttttactattacaccataacttgtttaaattttgttgctgttgcagaattacagcagacattacagttcatgtctccctgtgtatacgagggagagtttctctgggctgtgtacatgggggagtgtgggcctgacctgtcacattcaatttttatttcacagtcttatatctaatgctcatcattgcataatgtaactagctggggttagtttcctcagtccctgactcttctcttcagagcctgttttctctccgtttacagatgggccaaggttgctcgggtgattggtttactggcttcgcacaaaactgatctccaggaaaatacacctgttgttgaggtaatgtcttttatgactgaaatgtgatgaatgacaagaaatactgttgttgattctgtaatttagaacatgtggctttccttgaccttcacttgacttttctttgtgggattgtggaaattgttcaaaaacttatcacctcaacagacctttaggcttaaacatagcggctcatttacaatgtagtccatcattaaaatggcacagcagagttaacaaggctcgtgaaccctactcatcattatttcatttgtttttgaataagacttgttcatttcccgttttcttgtagtctgtccaacattttgttacagctaatgtatttcctaattaaatcatagcttataattcaaaattcaaattcttctggcttttagtgttttcgtatgaaagattactttctacctattctgttaatgtatattacactttattggtaatagagtgttataccttgaactgggagaggctcaagagtcagtgtaggtgaaaagaaccaaggctttttaggggaaatagcaagaggtcctgaaggaagttaaaaagggtaagggagagaggattttgtagagctgaagctggttgtgtggtatttggggctttaagaggaattggaaaactttctatgtctgtgttgtccactatagtagccaattggtatttggagcctcaagaggaattggaaacttttctctctgtgccattcactgcagtagccaattgctgggatagtataccagctggccttacagtgtctgggtggagattaatataatttcactgtatttcccttgcttacaattacatctctatttcctgcaaactgttggatctctgagctactagtaaaatgccactaagtctaattgtttccttttttggggggcctaaaataaatgaattgtgacctgtgtgattactgatggtacccaacttggttctcagagatgtgtcgagtagatttttatctaaaagattgagcatatagggcagtattaccaggaagatgagaaggcttaggatcttaaaaatgggggttccttctgatggctcagagcaaaaggtctccagtgagatggagtagctgtagaagatgggagagaacataaagtccaagacaaagtcccaagattttagaggatattcatgcatcgtcagagcaggcatttgttgctcagaagctgtgaagaaagagcctctgaatatgtaaaatatgactgttgaattaaatgattcagtagttgcagtagattatggatactttaggaagctgagttagtgaatttgaagatcagttggatgaattctcttaggattcagaaagaaagaggataaagattgtgaattaaaaaggcatggatgatagtttcagatgtgttccactatccagtatagtagccaccagccactgtggctattgagtgcttgaagaacagctagtctgaattgagatgatcaacttatagaaaagaatactatgggcaccctgtaatttccaaaccccttgttctacttgatctttttcacagcatatatcaccacctggcattttatgtatttatttctctttccatactagactacaagctccattggaacagggattgtgaattgtcttgttcaacactccacccccgtgcctagacagtgtcttgtgtatatctagatactgacaaatattttgaaataagtgaatgaaagtgtatcagtatgcttgggactccctgtagcagtgcctggaagatggtatgttttgctgctgcaggaattctcaagggactgggcagagggcatgtgaagtaatctgggacctgcttgtcaccctgggtgatgtgctgcccttgttctactggtacttgctgttgcggctgctgcactcccacttggagagtttggcccagcagttcctggaccatatttgttacttgtgctcactcaggttgagttctgtggccagtttgtattctcaaagtatttctgctactccagttatactttgtcaacgttgtattcctggtcctgcctcaactgagaggaaagggtgggtgttaattcccgaggttcttgtatctttgattccggtactgttctcttcatgggtgtttgctgatgctttattaatttgaaatgcaagaccttagggaaaatcatacttatttcatttaaaaaatggtgtgtactgaactatctggtgaactgttttgaattacacacactgtattgtgaactacatttggttggatagtagggagcttatataataacttgaaattgagccaggtgctcctttgtgatgccatcttaattttattatttctccacaccttttagttctttagttcgttacttttaatggcaaaatctgtgaatttcttttacatcaacctatttcctgctgtgagcaattggctgtgataatttaaggagccactagaggtcattcaagcactagaaaaaaagttgtgcaagttttaagaatttgtttcaacttctggaagcaggatctgtagaggctgagcaggtacatggtaccacgtttcatctttttcctggttttttagaagtttctgctacaggatgtgtggctccattccactggtgatttttaccatttgagaggaatcagatgaatgaaaaccattatagcctctccagaaaaatgcagtcagcacctagcacatgatttcaggggatctgaaaactctgcggagtccactggtgaatctttggttcataactcctgagaccaggtttctgtaaaactcacaattgggtgcttgtagataatttttcagtaatcagtaacaaaatttcaagtgtaagataaatcctgaattctctattagatttactatcagtgaacaagaaaaattgtggttgaagttcctgtaagcattttattttttattttacttatttattcatttattttttgagacagagtctcgctctgttgcccaggctgtagtgcagtggtgtgatctcggctcactgcaacctctgtttcccaggttcaagagattctcagcctcagccccagccccacaagtagctgggactgcaggttcatgccaccatgccccgctaacttttgtatttttagtagagacagggtttcaccatattggccaggctggtcttgaactcctggcttcaagtgatccacttgccttggcctcccaaagtgctgggattacaggtgtgagccactgcaccagcctggtactttctaatattttggatgctttcttacttgctaagcactttctcttacctggaatgttttttacattaccccctcccccagtgatctaatttctactttctctttaaagcccagctaacattccattttctccatcaggccttccctaacagtcccagaactcctacattgcctggtgtgctgacctaaagccctcattaagaccagtaacaaatcaagcctatcttatcaactgacaacacattctggaaccatggcgtgtccatggataagacatgaagtccttctttcaagacttggttttctggtcctggaaaataccaatatggataaaagaccttcaaagctgctacgatgggtaaggaacaatgcacacagtataccattaaggcaaagaagatagtcttaatcctgtatgaaatgccaatgaagatgtaattaatgaatagacatttcattgaaatgaaatcaaaagacattttccttctctgacataacagagtagaactctctagtaagaacacaaaactgaccagcctgaccaatgtgataaaaccccctgtctctactaaaaagacaaaaattagccatgcatggtagcagatgcttgtaatcccagctactcaagaggctcaggcatgagaatctcttgaacccaaaaggtggaggctgcagtgagtcgagatcgcacaactgcacttcaccctgggcgacaaagcaagactttgttttttaaaaaaaagaa

SEQ ID NO: 2224 - DNA, 28189 bp, Homo sapiens; identical to SEQ ID NO: 2223

SEQ ID NO: 2225 - DNA, 11407 bp, Homo sapiens
tactgcaagactggcctttgatcttacgacccagtcccctaagcgttctcaccccgtttctggttcctctggtcacagcacaaatttccagctggaaggggaatggagactatgggacctaggagcaagaggttccaggctgcctcactcccttacagatgttgacggtgggaaaagcctacacttcccccatgaactcaaaacgttgacagtatctctgggtggcaatgagagaatgggtttggtttggttttctcccaggcttctactttccagagagattttaacatttttttctgagttctccacctcatattctaattctccatggttctgggaccagactctccttcagtcagtggtctctgaagtgacatttgctcatcttctgtggaatagatcttgggaaactgaacttgacaccttgaatcttcctcatattatctcaaccttgggtactttgagtgccacaggataaatatgggacatctttctgaagcatcagtttcccttgattctcttgagatcaagagaaaaaacatgaatgtacttagggatgacagtcacataggtttctaagagtataccagacctctctctgaaatgaggcttgggttgtcctctttctgataaattctgatttaagagaaaggctgccttctgccatgaggacacattgatataagagtttgagaggtactggtgcacttcttcacactaacagacgtgtgaggatgtgtgactctaaaccacatggcatacagttcctgcctacttaatgtttacttttctacctctgcctctggttttggtccctggcagctgctgattcttggcaaaacctcagagcttggagtcagaagactgagtttcaaagttccagtattgcctttttcttttttttttctagccatgatatcaatccttctcagtcactaaatgagtgtgacaacaccttgtacagttgttggtgtcattaaatcagatggtgtgtaagtgtattttgtaaaaactgtaaaggaggatgtggctgtaggggctgacggttctcatgagtattactgctcttctttccaacagttaaaagaatattggcagaaaaacagccctagagttccagcaggagcgaacaggaacaggaaaacaaatggcagtatccctgagaaagccacttctggtggttgccagccacctagggatgtgagtcttggctgaccaggcttctggggacagggggcccaaggggcaatagagggtaattcttaagattgtggatggactgctgggtactggttaagaattctggctttagccgggtgtggtggcccacgcctgtaatcctagcactttgggaggccaaggcaggcggatcatgaggtcaggagatcgagaccatcctggttaacacggtgaaaccctgtctctactaaaaatacaaaaacattagccaagcgtggtggcgtgtgcctgtagtcccagctactcagaaggctgaggcaagagaatggtgtgaacctgggaggtggagcttgcagtagccaagattatgccactgcactccagcctggtgacagagcaagactctgtctcaaagaaaaaaaaaaaaaaaggaattctgggtttgaatcctgcctctccatctgctctgctagggatatgatttagggcaagttgctagacctcatcgggcctctcttttcacatctgtataatagaggtgttattgtttcacttccatttgtgaagtttaaatgagatttgttattgttgtttttatgttaatccctagtacatggcctgctgtaaacactcagaacacccaggatatggtttgattttcctcatccccagtctcagggggaaaccaggacaatgagaacagccacttgccatcaggagtcactgaaggggccccaggatgggatggtggggagataagaaccatgagagaagttggcacaaaggagttatgggacaaaaggtccaagataggcagaaaagaaaatgttgccagttgatggggaagaaaggaagtcagagggctcagacactgtgggggacagaacatctccatgtgcactctcatctcttgtagtcagcaacaggtttccacagggaaggccctacatcatctgctaccctgaaagatctggaggtaagaggctctgggcggaggtgcagtgacccttcgggtcaaccctccaacctcctcctccaggtgggactgggtgcccctctgccagctgagacagcccacacaccccagccctaatgattgttctctctacctctccccccactcctgctccacctcctcctctctgcatgcacctcagagcccgtgccaagaacgagcagtagtcctggattcaaggtccgtagaaatcagtcaactgaagaacaccatcaaatctctggtaagagtccactggggtcccctgattccacgctgccaatcctgggctccagtttccccttggggccctgaagaaaggggctgggggtccctggtgcctgggacaaatagggagcttgggtgcccaggcctcacctggagggaccccagagcatgcagcatggctcttcttttgctgccctctttgccgactctctcctctccagacacccctgctcgagtccttgctacacacgccctggggttgttgcctcttggggaagtgctagcctgactggttgtcaagggccccgtatttctgccatgactcagtccctaatttgctctttgattctggacaagccacctctcctttttgggctcgtgtttccagaggaggtagtgagtatcaaaggtctctgttagctctcgagtctgagatttaaaggccccctagaacggaaacctcagggctaagggctcctgtctgtccttttccatcctatatctgctgtaaagaaccgtacctggcccatacatgctcagtaaatgtttattgaatgaacccacttctctaaatcacaagctgccagaaggaggggcctttctgaaactccatctctagaggtttatattgctgtcctctcaagagattccagattcagactttgagttctgtggctgtgggcaaaagccaacaaagacccaaatcctctgtccttgggagcttgaggagagtttaccggttcgtgttcccattatgtctgagaactttgcctttaaaatccattcctggcccctgcctaccgcttcctggtctggggaatagagttgagggggccaccctcccatccaccttatttgactctccccacagaaacaacagaagaaacaagtggaacatcagctggaagaagtaacgtgatttcgtttcctcgcaacatgactgctgggtttggggggcactcagacatacaggccccagtctcgtctcacccactcccagcctggggatgaaggctcacccttcagattccaccccatccccacagggcccctgataacctggtcccatgggtgggcctgtcctggggcattggtggcattctgggggcatgtctcttgctgtgccatctctgcctccccctggtaagagctctgtcttcctcttcctacaggaaaagaaagcaaacaacaagaaacagaaagccaaaagggtgctagaggtgagtggagggtgtgcagtttcctcctgtcctccggagaaggtttctttccttctctttcagcacttgcttggcttttctcccaaaggttcaaatccagacattgaacatacagaaagaggaactaaatacggacctgtaccacatgaaacgttctctcagatactttgaaggtgggaatctgggcaccctgtcatccttcaacctggcactttgacaggtcttcagggggagtcctttgggccccatctcaactctctcattacagaaaagtccaaggatctggctgtccgcctgcaacattcattgcagcgtaaaggagagttagagagtgttctctctaatgtcatggccacacagaagaagaaggcaaaccaggtgagtccaaccacctgccccatcccctgggagcctggctttgcagatggaggagtgagcctaaaggtcccttctgcaggatggagtgtcctgcccagaaggcagcatggccatttcttgctacttttttgtatggtttttagtggcagcctggggctgagtcagctgctgtgggtgagttgggggtcactgtgtggagtgagcactggacgcagagcttggaggccaagtgcctgccccgcccttacctggctgtggtcttgggcaagtcctagtcctaggtggggtattgggtacttgtactgtgaaggtacagaagagtacctttagtatgttaccatttctgtagaaagaggaaacgtgtgtgcgtgtgtgtgtgtgtgtgtgtgtgtgtgtgcatactgtgataatatacataaaacatgtctgcaagggttcataaaaaagtcaggagagagcaacaagatggccgggagatacttcccttctgtaccttctgagttttggactatgcaaatgtatcatcctttcaaaaagtgaacaaaagattaattttccccttcctatctgtgcccccatccccagcaagaaaaacgggcttagagaattggatagacctgggtgtttatatcccagctctgcctaagtgaacttaggcaagcacttaacctcaaatactccatgttttttcatctccacaatagagggaatcatagtaactgtctcctatggtggttgcgaggattaaatgggattgttagcacggtacctggtgaagcattccacaaaggttcaaacagtggtaataataacagtaataacaatagcaatattatctgatctctctgggcctctgttagccagctataaattcaatctcattccctgtccgttccaactttactgagttcttttaaaaaccagaccacgggcttggaaatgccttgatctttactgaccgagttgtatattgggcctagccctagcccttttaaggggcactgtgtggaaatgcccaggctctccagattgaaacttctcactcttcaccatccagttgtccagccgcagcaaagcacgtacggagtggaagttagagcagtccatgcgggaggagacactactgaaagtgcagctgacacaggtgaggttttctgagggagttatgtggaaggaagatgaccccaggtggccaggagcaggtgaggaccagtgacagcccttcctaagttctgtgcccattcttgcagttgaaggagtcatttcaacaagtccaattagaaagagatgagtattctgaacatctaaaaggagagagggcccggtggcagcagaggatgagaaaaatgtcgcaggaggtgagatctgacccttcagcccccccacattagataggtcactggatctttctggtcatctgtaaaatgggaatagtagagccagaggtggtcatgggtctgggctttgtggaggtgggggcagagagggagagggcagcctgtccagccaccagcccctctctccaaggccctttccccttgtgctttgggcagatttgcacattaaagaaagagaagcagcaagatatgcgtcgggtagaggagctggagaggagcttgtccaaactcaaaaaccagatgggtaagatggggctggcatgacctaggagcaggactggcatcagagggctgtgagggtggcttagagtgccccagggaggtgggtggatggaagggctttgaggcagagggaaagagatctgtgccaggagacggcgagtcttgtcatctcaatgagtctcagtgtctcagtgtccccatcaggaaagagggcccgttgtcagccacccgcagtgctctttctctgaaagtgctttggaagactggctaccatctgggtgcgaggaatcattagcagtgaggccaagtttgaggagcctgagaggagctgtgcgccaagaggagggtttttcttttccgagaatccagaggcccttattatctgcttcctttgtcagctgaacccttgcccccggagcccccagcagtgccctctgaggtggagctgcagcacctgaggaaggaactagagagagtggcaggagagctccaggcccaggtcaaaaagaatcagcgcataagtctcctgaaccagcgacaagaagagaggattcaggagcaggaagagaggcttcggaagcaggaggagaggattcaggagcagcacaagagccttcagcagctggccaagccacagagcgtcttcgaggagccggtgcgttgcccaaactggggagcttgccctcctccctagccctccgggcctttgtttccccacctctaaaatggggcagtgtagccctcacatgaaatgttacttctaaaggcacctgtgagccaggtggctgtgggagagagggagtgatttttctaacctgcctccagccttcccagtgccatgggaggcagacaccaagttctggggtctccagctgcagtgggtggctgctgattgcttctctctgtccagaacaatgagaacaagaacgcactgcagttggagcagcaagtaaaggagctacaggagaagcttggcgaggtgaaggagacggaaacctccaccccatccaagaagggctgggaggcgggcagcagactctggggaggggaggtacgaggccagaggcagcttccagcctgggggctggtgaccacagcaccccccagggcagtcctgtttcttgcttcctgcctctgacttttaaaggtgggtagccctgggatcctctcaggtctggacatcatcatcctagctagaggcatggagcccccaatcacaggggaagagacagtggtataacaggctccttatgccaggtgcagtggctcatgcctataatcccagcactttgggaggctgaggcaggagaatcacttgaggtcgggagtttgggatcagcctggccaatgtggtaaaacctcatctctactaaaattacaaaaaaaaaaaaaaaaattagcaggacattgtggcgcatgcctgtaattccacctactcgggaggctgaggcacgagaattgcttcaacccaggaggtggaggttgcagtgagctgagattgcaccactgcactccagcctgggccacagagtgacactcttgtctgaaaacaaaacaaaaagactccttagattaaaactggattccagcctcggttgcactggtcaccattcaagtactttgcatctctaagtctctgtttctttaacttcaaagggaagttagcattttccttacagaggtgctgaggattaaatgagaagagggtatgagatttgaggctggggaaggaggcatggggttctaggaaagggaggcagtcacttaggcctggagtaaggggacaggggcctgggcagctgacagagccccacagtgccctcgctaccctattaatgggcccagaatctggaaaccagccaccacgtgccctcacacccagggtcttcctgcaggtggagctgaagagccaagaggctcagagtctgcagcagcagccagaccattacctgggtcacctgcagcagtacgtggccacctatcagcagctgacctgttagaaggaggcgctgtacaggcagtgactgcaacagacccagctaatgaaccagctgcagcagcaggaagcttggggcaaagcggtggctgagatggcctgccaaaagttgcaggagacccaggggagggagctgccgaggatggggctgtgagggggatgacctggcaaactccaccccttctcactctgtcctggcccctcaggagcacctggaagctgccagccagcagaaccagcagctaacggcccagctgagcctcatggctctccctggggaaggtacgggagactgctcagaggaagaggagagagccccaggaggaaggggggactgctagcagcataggattgaggagttggaagagacctttagaacagctggtcattatgccgaccgggtgcctgcactaagttcggcatcagtgtggtgacctcctgtgagcggggggtcaccaagttgcctaaggatggctgaactggccaaggtcagaaagggagcaggtcagaactcccacatcgaccagtagtgggagtgtgcctgggcggaatagcaagatcttgattcttaaaagtaaaaataaagaacaacagctcattcctctctggggaggggctggctcagggttacacagtgagggtggaggtagaggtgggcccacagtacctcccttgttgggttgtctgaagacccctctggccaccccccacaggacacggaggagaacatctggacagtgagggggaggaggcacctcagcccatgccgagtgtcccagaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtggccaacaggtgcactctctgaggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagccagaggccctggagccccagggcctgggggcgagtctgtgagtagggagacccactgggccctgcaggaagtcacggagaagctggcccatgccaggactcacctccaccttctccatgacttgaaaatgccacctgagggcaggtcgctgccgagatgtgactgcaatattttggctccagagcagctttatggaccacctgaaggagaaggcagacctgagtgagctggtgaaaaaagaactctgcttcatccaccactggcgagacagacgccatcagtgagtgggaggccagggcacggcagggggagctacagggccgtcggaggggccccagcgtctgagccctgtcctcccgcaggaaaacccatcaccttttatcagaaccagggggctgtgccaaagatgcggcactgggaggaggacaccatcaggctggagctcagggaggagatgaaggtagggtgtgcaacatctctgtgggggtgggggtgggggtgggtgtgagggtgggcgcaagcagcggcatggcagctgagcacccctccctccaggtgaagctgctggagctgcagcagatggtattgcggcttacagcaactacaacaatgggcacagaaaattcctggccgctgcccacaaccctgctgatgagcccggtccaggagccccagctccccaggagcttggggctgcagacaagcatggtggtgagtagagccctcaggtggggtgggcaggcaggaagagggggctcccactgtgctcagatccctgcctccctctctccaaagatcttcgtgaggtgagcctcacctcctctgcccaaggagaggccagggaggatcctctccttgacaagcctactgcacagccgatcgtgcaggaccaccaggagcacccaggcttgggcagcaactgctgtgtgccattcttgtgctgggcttggctgccaagaagaaggagataaacatcaccatcctcaaagagctgctcaagaaatttttaaataagaaaccaagttatggggttaatctcctacacaattcatttacttcctttgaatgttagactcactcatgattatttgtgtttctaatttatagtttaagtttatttgtaaaaagttaaaagagagtgggtgtctgtggctctcactgatgttcactctggcatcctttagcatttttcttttttaatttcataattgtaggtcattagcgtgcatatcgagtttgcccttacgtggtgggagttcaaacacacaaagacccactctttgcccaaaactgttctctttggtttggaataggctgccatgcttttttaatgttattgcagcatgtatattcactacagcattcagacaaaatttgcctatgttctgctgttgtttgatctaatcttaatcacagtgagctcttccttagctcaatatgtagtttgcccccaagtgtgcactgtttattactttgtaatacgccactatgagtactgacatttagagttgtttaaaggccaagaactggaaacagcctttcctccattttctgtgtattggtgatgggagtgataaccttttgggggagctttttaaatctcacagaagaggaaagtggcctcctctggcaggtatgtgcaggatagagtgtgtttcatctgttccggtgccaggaattagcggtgtattatggtggttcccttaggatttgtatgtgctctgggctcatgaagatattgcatcatgagctgcagcagttgtactctttttcgatgacctaaaaagggcttatttctgaggaatgaaaggttcccatcgttgactgtggatgtggaaaacctttcctagcttagagcatttgtatctacaatacattttaaagtcagagttcatgttacctgttttaatcacatgactacatgtcccagtacacaaaagggcactggttggcattcttcttaatgtatttagtgaagatcataagaaatcctttatgagttcaaacgtccctggaacaggcatacaggctctagtcaagaatgaattagagtgaaggaaagctgtgtgacacctggcattcctctctgttcacggagattctttgaggcttgaagattgattttaccatctagacctctttggctaatacctattcttcaaccaccttggttactctgacataggaatttacttctttttccttgaatggaaaacactttaaaaaataatagaaacattattataaactaatatatgtgagatacttagttgaaacaaaaaggagttttagtagatggtattgtactctctttgaaaatcaaggagaagtttatgaaacttaaaatgtgtacaaactgcagtgcaatctactgttcgtgaatgtcaatgtattatcaggaaacgtgtctatacaatcacagagttatattttctcacagacttctttacaaagtgaaatatgtttttgtacctctgggtttctgttcgggacatattttgtgcgatatttatgtgattgtgcctatgcatgatgaatgaatacatttcagttatatattgcctaaatcgtaacttgatgatgcttgggaaagact

SEQ ID NO: 2226 - DNA, 117519 bp, Homo sapiens
ggccaggctcgccgcggggcgctgagcaggccgggacaccgcggccgaggttatcgttaggcatctcccaggcgaccggctccgcagcaagatggcggacgagaaggacagggaaggtaaggtaggggagccggggagccgctgccctcgccgcccgccgcgaccccgggctgcacggggaagcgccgggtggggtgggccctcgtccatctggagttcccacccgcagggaaagggcggcctgaggagggggccacccggcagcagcagtcgccctgcccccgtccccgtagcccgcccggcccgccgctccgccccgccccgccccgcctctctcccccgccccgccccgcctctctcccctcttccctccctcttctctctcccctcctcccgccttcttctttctcctcccgccctcttcaccctcttcccctcctcccgccccgtcctccttccccctccctcggaggccgggccttgcatcctgcgcgggctgcgccggaggcgccggcagggggtgctgataatggcgtcgttgttcacggtcgcggggaagccgccgccgcctccacactctcgcctggggtctcggtgccgcaggcgccacgcccgtagctgtccaggctgtgggccccggggggtggcctgggtgaggaggagttctggccgcctgaatctgacgggatcctctgtttgcgccgaaaccccgcgctggcgcagcctgatggcgttcgcggccaccattttgcctccttaatgaggacgcaggaggacggtctggaggtcacagccgctgcctccgagcttcccggtcctccgaaatgcctgccccgccgccggctagcgccgcgcaattggcctagtgtcttgtcttaaaaaaaaaaaaagacacacacccaaacagcaattttaataacgacgaaaaaccaaaacctggttgagatcttggaaccgctgtgcgccggccgggcctctcccaggggaccacccagccccgcgcggtggccgcctgcagaggcgggactgcgcttcgaggcttaaggtcgccagttcggaggcatcgatgtgttgtctgtgcggagaagccaaaaagtgattacgtttatttgcaagaccgttcatgttgttttcagttcatggtatgattaaaacccgatcctttgttaccatgcccttaggtactaaaaaataattgtgtttgatagttggcagtcacccaaaaatatccaaaaagccatgaaacagtaaaggtaaacaagtaggaagtgaaaataatattcgtcctttgttttctttctggagtgctcaaaacaccctctcaaaccatttttctcagcatagaaccaagtgtggtcaggttaacagctaatatttacaagggaagaaacgaaccctgagatatttagtcacttgttccggtgatcacagaaaatcggcgaagaaacacatgaaactgccaacgatctctctattgataacaaggataccgtgatttttatgtaatattaatctgagaagccaggattattttgtaggtattagctttacgaagatgcccttacatacaaagaaaaggataattttaaaactttcccagaaaaatggatggcttatttttgttctttaccaaaaaaaaaaaaaaaaaagccattaggagataaactagcaaggtaattatggatatttattttcttaaaaaagacttggttaggtcagcatgagaaaaaacgcactggagtatggtacaaatacagtatttctcgttttttaaaaactgagagctttcctgatttttcagcttttgaacaatttttttccatttaaagtaaattcagagaaacaattttgtcgataactcatagaagtaatgactgttaaaagctggatgccattcattcagaatacatatattcaatgccattatgtagataaggcattctacttagaactttgaaagatacgaaaatgaaagacattgtctttgcttccaaggaaggtgagatgagtaagggagatgagaaatttacaaatgggaggaaatagttaactgggctgagtagtctgggtgccaaccactgtgctaggtgtgtatccttgtagtccgtggacagcagcctggacatcactggctgccaccgacctaataatgaatcagtcttcattttaacatgtttgtaggtgatttgtatgtacattaactttcgagaaggccgggcgcggtggctcacgcctgcaatcccagcactttgggaggctgaggcgggcggatcacgaggtcaagagatcgagaccatcctggccaacatggtgaaccccgtctctactaaaaatacaaaaattagctgggcgtggtggcacgccctgtagtcccagctactcaggaggctgagacaggagaattgcttgaaccggggaggcggaggctgcagtgagccaagatcacaccactgcactccagcctggcgacagagtaagactccgtctcaaaaaaaaaaaaaaacaaaaacaaaaaacaaagttcgagaagcactcatgtgctgtatctcatttattgttaacagttttatggattaactaattgcagtttgtgaagggtattatgaaataaaggcattttgttagaggataaactaagtagagactcattttggtggtaagatctttttatggaaatagtctattactatatttgattgtcagctactgtattttgaattttcagaaattacgtctaaccaattaatcagaattgattaagttttgaggattcactcaactaaactcataaaagactgatgtgcaaacctgaatgatttattaatttaaataagggtatatacattgacttgaaggctgattttgccaatatactaatataataattttggcaatatactaatataataatatactgttttatgggtactaagcttcgggtagtgtgaatttgtatttcagaagtcatttgatgaccgtggaatcacacaaaagaaaggataattttgaaggatgtgttcagtaccctctaagttccaaaagatctgggaccatttctgatctgttaatactgagtgttgtgcagagtgcttggaacgtggtaggtaatcaataaatatttgttgaattcagaacatttgaattaatcaaagacagcttatgagattttaaccaaagcattcctagctattttccccaaacttattctatacctaaaagtacacaaaactcgttttaggtctcttttcccctctgctttaccggtaagatacattcttctattccatctggctcaacaaaacgttttatttcacagtgccacggtattcactagcatgtctttaaaaaacaactacaaaaaacctcattgtagaaatacacatatgttttaaatagttcatccttaatattgagatttctaaaagttctaaagggggaataagtttcagggtacctatcctatccactcttcttcaatatttagagattaactttgatagaagtattgagaatattgataagaaaaattacctaaattagaaggggctattgtgctcataaaatttttttctaagattatgtacgttgaagttgttatacttatttgtagcattttttgctttcatacagtataatttattttttcatagattaaaaattatacagaattatattagctaaaagtttaacctttagaaccaaattatttttaaaaccacttttttaactgaaagaagaatgtttgaaacgggatgagaaaaaatatttttgaaggtttattatttttccaaagtttcctcagccagaacattttttgttttgttctttcttttccttctgttttgtctgtttaaatggagagtcaatgcaattgttgattctttggctccttaaatcttattgtttctgtctcttagagaattttatataggactggaaggatcttctgtttgtaattagactcacgtctaggaaacaaactgcttagttataaaatttgaacttttggcagccagtgagctttggaaagtaagaactttttagtaagctgcagatattaaaagctcactctaggatttactatttttgtttctattaaaatattctttgttactttgcgtgctttgataacattgcttgataaagtgcctctaattcaattatcacctcctaaatggaagaggttttacaaggtttgttgttttgtttctgatttccttcattgtgccactcttttgaaaacccaacatttggaaatataaagtaaaaaacagaaatttcaggtgcctattactttataaaaagggttcccttaaataacgtctttgttttttttttcttcttttattttgagacagggtcttgctctgctgcccaggctggaatgtggtggtgcaacctctgttgcctaagctggaatgtagtggtgccatcacggctcactacagcctcgacctcctgggctcaagcgattcccccgacctcagcctcccaagtagctgggactacaggcgcaagccaccatgcccgactaatttttttaatttgtagagacagggtttcactgtgttggctacgctggtctcaaactctttattttttttatttttattttttttttgagatggagtctcgctctgtcgcccaggctggagtgcagtggcacgatcttggctcactgcaagctctgcctcccaggttcacaccattctcctgcctcagcctcccgagtagctgggactacaggtgcctgccaccacgcccggctaattttttgtatttttagtagtgatggggtttcaccgtattagccaggatggtctcgatctcctgaccttgtgatccgcccacctcggcctcccaaagtgctgggattacaggcgtgagccaccacgcctggctcgaactcttgagctcaagtgatctgcctgccttggcctcccaaagtgctgagattacaggcatgagccaccctgcctggcctcatagtaactgtcgatagtatagagtgtagcctgtgggacagtacaaaggttgagctttgaagtaagacttgaatttgaattccgtcttccccaagctctaattatctgatcttagccgagatgctaaacataagtagcttcaagttcctcagatgtaaagtggggataattatacccccaatatttcataatgttgtaatggggacaatgttttcttattcatttttacatccccagcacctgccacagtgcctggcatcaaaggaatgctgaggccggctcacgcctgtaatcctagcactttgagaggcccaggcaggtggatcacttgaggtcaggagttcaaaaccagcctggccaacatggtgaaaccctgtctctactaaaaatacaaaaaattagctgagtgtggtggcgcgtgcctgtaatcccaactactcaggaggctgaggcaggagaatcgcttgaacccaggaggtggaggttgcagtgagctgagatcacactactgcactccagcctgagtaacagggtgagactctgtctcaaaataaataaataaataaataaaaaatacaataaaggaatgctgaataaatgggaaagaaagtgtttggtacgtatctagtgaattagtaagtattagtatctgcttaacataaaacataagagttggccaggcgtggtggctcctgcttgtaattccagcactttgggaggccgaggtggggagatcacctgaggtcaggagttcgagaccagcctgaccaacatggtgaaacgctctctctacgaaaaatacaaaaattagttgggtgtggtggtggttgcctgttatcccagctactctagaggttgaggcaggagaattgcttgaacctgggggatggaggttgcagtgagcctagatcgcagcattgcactccagcccaggcaacagagcaagactccatctcaaaacaaaaaaacaaataaaacataagagttaagaaaacttttaagtcttaccaattgggatcatgcataatgcattcctgcatatttctggggtaatttaataagttttcttcctgttttagaccaatataaatatccggttaagactaagcaaacaagaagactagctttttgaagcctaatttgtttcctcttattcagaataaaaaaaaatttgaagaaaaactggactgaaatttgtttttgctctgatatataaaatttacagaaatgtctcaagaatagtcataattttaaagatcaaatggacagtgagatactacctcacgcctgttaggaaggctattatcaccagaagtcccccaaataataagtattggtgaggatgtggagaaactggaaccctcgtggactgttggtggcaatgagaaatggtgcagctactatggaaagtggtatggcggttcctcagaaagttaaaagttgagttaccatgtgacccagcagttccacgtgtgggtatatatccacagtaattgaaagcaaggcctcgaagagatatttgcacaaccatgttcatagcacattgttcacagtaggtaaaaggtggaagcaagccaagtgtccatcagcggatgaatgaacaaaccaaatgtggtatatacgtgtagtgaaatattattcagccttcaaaggaggaaattctgacacatgctaccgcttgaatgaacctgaaagacatcatgctaagtgaaataagccagtcaaaaagacaaatactctgtgattccacttacatgaggtacctagagaagtcaaattcatggagacagaaagtagattgctggttgccaggggctgtggggagaggagaatgggaagttgtttaaggagtgtagagttccagttctgcaagatgaaggaagttctggagattggttgcccagcagtgtgaaggtacttaacactattgaactatatggttaaaagtggttaatacagtaagttttacattatgtgtattttaccacattttagtaaatagaaaatgttgagtacattcagaatgaaagaaatggtacattgtttttcaaaggcaatttggaaatttgtattgaagaataaatgatgatggctaggcaaggtggctcacatctgtaaactcagcactttgggaggctgaggtaggaggattacttgagaccaggagttcgagaccagcctgggcaacatgctgagacctcatctttgctaaaaataaaataaataataataaagaagtcgggggttccctctgttggctttggagcccccatccctctgtctctgtacagggaagcttcttccttctcctttcttgctccttcttgcctgttaaactctctatttcttaaaaccaaaaaaataaaaaataataataaaaagtgatgtccacatgctttgagctttaatatacttctggatatttatccttagaaatatattctgaaaagaataaaaaatgctctaagcacaaaaatgatcaacataaagttatctataaatttgaaaatatagataacatttgcatgtccaactaatggggcatacaaaataaatggttgtatgtccacttgttgggttgcagccaaatatataaaaattatatgtgtaaatgggtaaggacacgtgggggagcccaggagatgatgatgatagcagggtgattagacttttaggggcacttatttttaaaatctcattttaatgtcagttctacaaaactttaaaaacccacttaaatatgctaattaaaaattattcttacccacttgtgaaagtgtgtttaccagatcctgtacttgacaatcctttgtaaacctctagtatggattttatagatattaagactgtaaaaaagtaattttagtttttatttttattttttaagagatgagatctaggccgggcgcagtggctcacgcctgtaatctcagcactttgggaggctgaggctggcggatcgcctgaggttggaaattcaagaccagcctggccaacacgggaaaaccccgtctctattaaaaatacaaaattagctgggcatggtggcgcatgcctgttatcccagctactcgggaggctgaggtaggagaatcacttgaacccgggaggcggaggttgtgatgagctgagagcaccattttactccagcctaggcaacaagagcggaactccgtctcaaaaaaaaaaaaaaaagagacgaggtctcactctgtcaccctggctggggtgcagtggcttgatcacagctcactgtagcctctactttctgggctcaagtgatcttcccactttggcctcccaagtagctgggactgcaggggcgtgccactgtgcccaactaacatttttatttttggtagagataagatcttgctctgttgcccaggctagtctcaaactcctggcctcaggcaatcctaccaccttggcctcccaaagtgctgggattacaggcttgagccaccacctctggcccataattttatttttttaaatgcactagtaaaattgggagtttaaaaacctggactagaatttggacattgcctttttttttattctttttaagattttgcttgttagtgtcaatttatctgacctttggtttgaagaatttccatctaaagaggaagataggcagctaaggagacaatgatacaataatgtgataagtgctatgatagttgcacatgtatgatgattgggtgcctggggagagtcacctgattcacacacaccctctttaaattatagcccctttttattccctctcatagctatttgtttttttcctctttcatactatattttgtaattgcctgtagatgtgttgtttgatgtctgcttctcctagactcttaacttccaaaaggataggggtcatgctcatgcatatacccagagcatggcatatagctcagtatttgctgaatgttgaatcaaagttggctttctgaaggagataaccgaagcttatcttttttttttttttttttttttttttttttgagacgtagtcttgctcttgtcgcccaggttggaatgcagtggcgtgatctcggctcactgcaacctctgcctcctgggttcaagcgattcttatgtctcagcctcccaagtagctgggattacagacatgtgccaccatgctgggctcatttttttatatttttagtagacggggtttcaccatactggccagtctggtctcgaactcctgacctcaaatgatccgcctgccttggcctcccaaagtactaggattacaggtgtgagccactgcgcctggcctaatttttgtatttttagtagagacggggtttcaccatgttggccaggctggtctggaactcctgacctcatgtgatccgcccaccttggcctcccaaagtgttggtattacaggtgtgagccacgactcccagccccaggcttatcttgaaggtgtaatagcacagagaacaagtaggggatggatatttcaggaagagaagaaataacatacttgaaattgtgaagactcaatatggccgaaatttaggatgggttaggagatgtgggaatttttattcttaaagcattggtgagtgattaaaagtttttaacaaggccgggtgcagtggctcacgcctgtaatcccagcactttgggaggccgaggcaggtggatcacgaggtcaggagatcaagaccattctggctaacacggtgaaaccccgtctctactaaaaaaaaaaaaaaaaaaaaaaaaaaaaattagctgggcgtggtggcaggtgcctgtagtcccaggtacttgggaggctgaggcaggacaatggcgtggacccaggaggtggaggttgcagtgagccgagatcacgccactgcactccagcaagggcaacacagcgagactccgtctcaaaaaaaaaaaaaaaaaagtttttaacaagatgggaggctgaggcaggataatcacttgaacccgggaggtggaggttgcagtgagccaggattgcaccactgaactccagcgtggctgacagaatgagactctgtctaaaaaataaaaatgaaaaaataaaaaataaagttttttttagcaagagacaatcatatttgttgtctagaaaaatcacttgggcaagtgtgctcagtggattagatggactccaggtttgggactccaggtttgtcccagtatagtagtccagaaagataaaaccctgaaccaaagtaatggaagtcaggaatgaaacaaggagataggctagaggaaatggatagattttgtaataggacagatatgaatattgagtcaggtcagggacacggtttctgattgggtaacaaagaataaagaggaatagtagagttatgtaaataatagttctagtcttgcacatgttgagtttgggtgcctgtgaggcattcaggttgagatataacataggcagcactgtgtgcttggtacctaaatatctgttgaatgaaaaatgagaatgatgtgtgttggatcgcttgaatgtattcctctgtaagtggttgtagtcttgggaatggttgagaatgtccagaaaaaatggatacaattttgttgactgaggccgggcgtggtggttcacgcctgtaatcccagcaccttgggaggcccaggcgggtggattacctgaggtaggcagttcgagaccagcctgaccaacatggcaaaaccccctctctacccaaaacacaaaaattagccaggtgtggtggcaggcgtctgtaatcccagctacttgagaggctgaggcaggagaatcgcttgaacctggggaggcagaggttgcagtgagccgagatcacgccattgcactccagcctggatgacagagtgagactctctgtccccaccccaccaccccaccgccaaaaaaaaatgttgactgaaaggagaagtgactaggatcagaactctgggtaaaaatcagtaattgaacagagaaaaataacttgtgaataagattgaaagcacaattgcaaaatcatgggaaaatgagcaaatagtgtcacaaaagccaagtaggaagaatttcatgaaggaagcacttaaaaatgttgggaaaaactccccaatggttaacatttatagagcacttactctgaagtaggcactgggctgaatgttttacgtgtattatgtcctttaatccttacaataaatctatgtggtaggtgcctctgttacccgctttccacaagtaaggaaatggaggcttagataggtaaagcagccttccagtttcagctcaaaaggtaagcgcttggaagtcatcactccggttgctcctggagccataaactgcaagaaatatttgttaattttgacaaattggtggaggctgcgtgtggactgtcatgagagtgagaaactcctggaggcctgcagtcttaggcggtccctcacacttcctccggttttactcctaggaaccccacggggttattctggtgaagagccaagcaaggttggtttaacaggggaaggggaaagcaacgcttttgaaatatgctagtgcattcttcataaaaaggccaatttcagtggccgctagtctggtcttatctcaacggatggaaaaagctgaaaaacacttgtgaaggtcacagcccattgacacaggtccactaaaagactgagatttcatcgtaagttgatagaattctcctcacccatccctcaccaccacatcaacaggaatacaactcagaccaactgacagcggcttgcagctggaagacctacaaggtggagactctatttaaggacaagttcttagggaagcctgaagaggaatctggcacctacagctacagcaaacattaaacacagccctactcctagccagattggggtaaagcctcacactagtagctgattactatcatgtctggcttccaacaaaaaatgacaagacatgctaataggcaagaaaaacagcccgaagagacaaagcaagcatcagaaccagacttagatatatgataatgggtgttttgtaattatcaaggaatttaaagaactgtgattaatatgttaaaggttcaggccgggcttggtgacgcatgcctgtaatcccagcactttgggaggccaaggagggtgggtcacttgaggttaggagtgtgagaccagcctagccaacatggcaaaaccccatctctacaaaaagacaaaaattagccaggcgtggtggcgtgtgcctgtagtcccagctacttgtgaggctgaggcaggagaatcactcggaccctggagtccatagactcaatgtggctgaggaaagaatcattgagcttgaaggtatgtcactagaaactttccaaactgaattgcaaagagagaaaagaatgaaaaaacaacacccaagaaccatgggataatttaaaaggtgtgaaataacatgtaattgaatgccagaaggaaaagaaagaatagagcagaagaaatatttgaaaaaatgggctgagcgggcccagcactttgggaggctgaggcgggtggatcacctgaggtcaggagatcgagaccagcctggccaacatggtgaaaccctgtctgtactaaaaataaaaatacaaaaaattagccaggtgtggtggtgggtgcctgtaatcttagctacttgggagcctgaggcagaagaatttcttgaatccaggaggcagaggttgcaatgagctgatatcgcgccattgcaagagggtgagactccaatctcctagggaaaaaaaaagaagaaaatcatctggaaagcttgttaaaacatagattgttgggtctcaccctcagtaatctggagtgagggggtctggaaatttgcatttctaacaagttaccacaggatgagcatgctgttaagaaacattgatctaaaatttaaagtgaattttgccatttcagtgtatttccttctaggttttgtctaggcagatttgtattttgttttgttttacaaacttgagatgatattgaatatggttttatgtccagcttttttcacttactattagaaacattttttcatgtcacaagtatttcttaaagacatataaaggagttgcattcattatattaggttggtgcaaaagtaattgtggtttttgctattaaaagtaatcgggcctggcgtggtagctcacacctgtaattccagcactttgggaggctgaggtgggcggaccacttgaggtcaggagtttgagaccagcctggccatcatggtgaaaccctgtctctactaaaaatacaaaaattagccagttgtggtggcgcatgcttgtaatcccagctactcgggaggccgaggcaggagaatcacttgtactcaggaggcggaggttgcagtgagccaaggtcatgccattgtactccagcctgggcagtagagcaagactctgtctcaaaaaaaaaaaaaaaaaaaagtaaccggaaataccgcaattacttttgcaccaacttaacctaacattaatacttatggtcactatgatttacttaaggtttgtctaactgttagatatttaaattgtttaaaaatgttctgttgtaaatgttcttatacaaggattttttttttgacccagctttgatcctcatcctctacccactttggaaaaatttcttttttttctggagagacagggtttctctctgtcatccaggctggagtgcagtggcccaatcttagctcactgcagcctcaaactcctgtgctcaagcggtcctcccacctcagactcctgagtagctgggactacaggtgtatgccaccgtacctggctaatttttttggggggggggaataattttgttgaatcccatctctggtgggtcttcctagttacagaggataacccaatttcccaattctgtgagtaccttgtgatccttttgtattaattacattatttctctccaattttaaagaaatcaatcatagacccacatattgccattcagagcttatgatcaggataaaatacagatttgcttattgtctctctatcctgttacagtggaaatgataggaaactagatattttgtttcttttgttactaaatccctggatttagaaaatgtgtaggatatagtaatcactgtaaatatttgttgcaagaatgcaggaaccaggagtagcacattgatggcaccttgcatcttcttattaagagtaaatgtatttttctgtgaatccttttaaaatactgaaaataggctatgtgtggtggctcacacctgtaatcccagcactttgggaaattgaggcaggtggatcacctgaggtcaggagttcgagaccagcctggccaacacagagaaaccctgtctctactaaaagtataaaaatgagccaggtgtggtggcacacgcctgtagtcccagctactcgggaggctgaggcaggagaatcgcttgaacctgggaggtggaggttgcggtgagccgagatcatgccactacactccagcctgggcgacagagcaagactctgtcaaaaaacacccccccttcaaaaaaaaaaaaaaactccctcaatttcctgacacatacgtgtttatctgtacttactggctccttacaaaaacctcttacctggtttacttgttttcatttattatgctgtaaatctggttattggttaatgaattctctacctaaaatccttaatgtcttcccattacccttaggatagtctgaattctaacaaaacagacaaggatgtcttctgtctccagggttttttttttttttttttttttctgattacatgtgtggtatcaccattcacgcattctacacttcattatacgcttcatcatagagagcaatttctttgttgttcctgtaatgaaagtgctagcctgcgcacatattgtttccttatcccagacttcatttagtaaatagcattgcttagtggttaagaacatgaagtctgtagttaatccttatgggctcaaattctggctttgccactttagagctggataactttaggcaaggtacttaggtgttctaatttcttcacatgtcaaatgaggagcatagcagagcctgtcccatgtggtggtaaaggatgttgtggagaacttcacatgccgtaagagctctagaaatgttatgagtccttacttaccgtgttaggcctggtgctagatgttggggaataaaacagatttgggccctgtcctcttagatattgctgtagaggagagaaccattaaagagttacataattattgggccaggtgtggtggcacacacctgtaatcccaatactttgggaggccaaggtgggcagatcactcgaggccaggagttcaagaccagcctggctaatgtggtgaaacccccgtctctactaaaatacaaaaattagccaggcatggtggcacacacctgtaatctgagctacttgggaggcggaggcatgagaattgcttgaacccgggaggcagaggttgcagtgagccgagatcgtgccactgaactccagcctgggcaacagagggagactccatctcaaaaaaaaaaaaaatacataattgttataagcagttcaaaaaagttcagggttccacaaaagggacatctgatttaaatttttcttttttctttcttttatttttttttcagacagagtttcactcttgttgcccaggctgaagtacagtggcatgatctcagctcaccacaacctccacctcccaggttcaagtgattcttatgcctcagcctcccgagtagctgggattacaggcgtgtgccaccatgcctggctaattttatatttttagtagagacggggtttctccatgttggtcaggctggtcttgaactcctgacctcaggtgacccgcccacctcggcctcccaaagtgctgggattacaggcatgagccaccatgcctggtctgatttaaatttttcttacttcagtggctttgaatgtgacatttcctctaccaaaaactactactagtaacagatggaactgcgaatttacaagcctgaagtaagaaaggagcatagcttattagaggagttgcacgaggctccattgtggctggaatggagacatgaaggtgggaagaatggtgtgaaatgaagtttgaaagtaggcagaggccaggtctttgtgaagaccaggtcagggaggctgacttctatacaagagcaagagggagccattggagctttttaaacagggaaatgatacaattcattatgtttttaagaggtcacttggccagatgtgatggcacgagcctggagtcccagctacttgggaggctgaggtgggaggattgcttgagcctagaagttcgaggatgcagtgagctatgatcacacctgtgaatagccactgcactccagcctgggtaacatagtgagaccctgtctcaaaaaaaaaaaaaaaaaagatcacttgcttgcactgtggaagggtggagcacggcaagagcagataatgatggtggtgtcttggattagacagcagcggaggaaatggcagagaaggtttgagagtcaagagagtctaaacgtttttgtgactggatgtggggactggaggagacagggatgaatgaacacctttcagtccaacttctgactcttgcttctcatctttatctaaggtccatcctcaagtctgaggtgggtgccactcttgtgcctccgtagggctgtctgtgtatgtcactaagttttagcactgatctgttgtgatttactatagctggtctgttttccttttaagttagaatgtatttatagtagatggtagctgatcaacaaacatttcataaatgaaagcacagattaacataaaagtagatgatgattgagtacagtatttctttctttttttttttttgagatggagtcttgctctgtcgctctggctggagtgcaatggcgcgttctcagctcactacaacctccacctcccgggttcaagcaattctcattcctccgccttccgagtagctgagattacaggcgtgcatcaccacacctggctaatttttttttgtatttttagtagacatggggtttcaccatgttggccaggctggtttcgaactcctgacctcaagtgatccgcccacctcagcctgccaaagtgctgggattacaggtgtgagccacagctacggtatttcattttaagcctagtgttttggtggtatattgtctttggatcaagttgtttatgaaaaaagaattctcaaagaactattcctaccacctctctcccctgacccccccagccaaaggccaagaattggattcttgatttttttttttttgacagcatatgtctggaatatgtattggtattaattgggtcaaatagaacaataacattatctgtactttcagttaattaaccttgagggcatttctttaccttcttttttgtatgctttaaacagttcccatggtaagtattcctcttggggcttattattttatcttaatttctgtaggtgggattttgagtatctaattagatatttaaatatgtaaacagacatctccatgttagaaaaaactcagctgcactatttgtttaaaaaacttctcttatatccttaggtgatttgacttgtgttttgttatgactgctcctttgtatttattatcattaatttgttctttcgaaattaagtttaactttttttgttgtttttctcctatggtttagattttaacttagtgcaatatgtagttttttagtctttgcagcatttccattgatggaaaacaaatacagtgtgaaattgttggctttcatatacccaatatggaattaaagtgaaaagggaactatttaatttattatttttttaaatgagatcgggtcccactatgttgcctaggctggccttgaactcttgggctcaagcgatcctcccgccttagcctcctgggtagctagagaattattatataatggtataacttgcctcaactgggatttttatcaattaagtggcattttgttattatattgacatactaatttagttatatttattttataataagcaacactgctgtttatattttgtggcctattagagtaggaacaactaaaaataaggtaaataatatatttttaaaggagcatgaaataaaaaattttatttaatatttaggaaagatgatatgcgtatccaacccattgcaaaaattatagtaattgctagttccaaaatattgttagtgaaatgtcatcagattcctataaggcttatatcttcatgaaaagtaatgctaataacactgagtgtgacattagacctttgcctgttttctctctttccatatatgcttcctgtgaatgactaatagaaaacttattttctctcaaccaaatctgtgtaacttactttcctgagatactaggcaacttccctacgttacaaaaaattagtaatgataatgggtaactttgattgaatattcctatagttcaggtggtaaccctcaaaacaaccttgtcagctagatactcgatattgtgcttttcacagatgagaaaaactgaatatttgagcagttatttatcctaaagattacagagctatgtacgtatgaatatgtaagaatatgatctttaaaccaggtggtctggttctagagtctgtgatcttaaccatgacactgtattgcaacctagaaatggtggcaaaatttgttcaaagtacaatgttaataaagtaattttgatttatttagttattatttatttattttttgtagagacaaggacccactttgttgtccaggctggtcttgaattcctgggcacaagcgattctcccaccttggcctcccgaagtgttgggattacaggcatgagtcaccacaccaggccaataaagtaattttaaaaattaactaaagtccatactttactcagattttcttaatttttacctaatgtccttttctgctccggagtcccatcaaggacaccaggttaccatttagttgctatggctccttcggctcctcttggctgtgatcgtttctcaggttttccttgtctttaatgacctccttgacagttttcagaatgggtcagaatgcccctctattagaatttgatgtttgtgtcctgattagactggtggaatgggattttaggagggagaccacagagttaaagtaccattttcatcacatgacatcaaggttatgtactattaatatcaatacaattgatcactgttgatgttagcctcgatcgcctggctgaggtagtgtttgtctggtttctccactgtggtaactctgtctccccattccgtagtctttggaaggaagtcatatgtgcagcccacactcaaggagtatggagttatgcttccctccttgagggcagagaatctacatgaattatttgaaattcttctgaacagaagatttgtatcttttctcctatatatttatttacagtttcctctattcatggtttggctttccgtggttttagttaactaaggtcaaccaagatctgaaaatattaaatggaaaattccagaaataaaccattcattttaaattgcatgctattttgagtatcatgacgaaatctctctctgtcctaccaggatgtgaatcatcgctttgtccagtttatccacattgtatatgctacctgtctttaatcattgacatcttctgcttctgacatttaaccatgaacattgtcatggctcgggatgacccgggatctcccaaggcaggtgctcttccttttggtgtatcatcaggtcaacagtagcctgacactgcatcatggtgctctgtgtcattcacctcacttcatctcatcacgtgggcattttatcgtctcacatatgacaagacgcatgagtacagtacaataagatattttgagagaggccattcatatagcttccattacagtatgttgttatgattattctattttattattggttactgttgttaatttcttaatgtgcttaatttatcacaggcatgtatgaataggggaaaacatagtatatatagggcttggtgttatctgaggttttaggcacccactgcaggtcttgggacttatccctcgtggataaggggagactactgcacttgatcattcattcctgtcagtatggacacattggatgtttattttatactttgggttatgagccagtactactttattcattttgttgctcaaattgtttcagctttggccattggaagctcttttcgctggctcctatgtcactatgacatagccccatcaaggtgtggtgtttttggggggttttattgagacagtgtcttgctctgttgcccaggctggaatctcgatttactgcaacctccgcctcccaggctcaagcagtcttcccacctcagccttcctagcagctgggactacaggcatgagccactgcgcctggcctaatgtgggtggtgtttttttttttgtacttctactactactactactactgctaggatctagttctactcagtacttctggcaccaaatgtgtgggttttccacaccaaacaattctccagttccctgtggacaccaactgggagtcctacaattcaactcaatttaataccaactacccagagttactacagatcccacaggttaaggatttggtcccacaagaccattccctaggaaagtaggctaactgctgattaaaggtagtggatccttaagttactcacacttcagttagatgtggctacaaattgggggtttccataacccccttcttagttccataatttgctataaaggttcacagaactcaaggaaacactttgtttaacatttactggtttatcataaaggatgcaaatgaagaaacagatggagtgacataaagggtgcggtgagctctgccaggtaccccagctgaggagcttctgttctgtggagttgggtgcactattctcccggcatgtggatgtgcttgccattccagagctcttggaacccctttgtttagggtttttgtgggggttccattatgtaggcatggttggttcgatcactggccattcgagattcgctcaatccccagcctcttccctctctggaggtcacagggtggggtcaggtttggggaatgagtcagaatttttggcagataatttctattttgtattagctttctggattattctgattccattattgtaacttgtttactatggtccagctttatgccctttgtatacattatgacttttaatcctcgtaacagccctgtgaggtagagaaatagagcagtaggagtcagggcctgtttggtcagcattttgctattaccacctttttaaacttttataggagtggctctgaatctctagaaagtcatgtaaagatcttgatatttatttaaaatcataaacaaatattcacaaggaaactttttttcttgacattcagtatgttttaagtaattttcatgtggttcgagccttgtaaaggtttttctggttttcatagtgtagaaagtaaagaaagctgttacaattgactgtctggactgatttattcaagagaaaatcacttggtttatagaaggcctttaacattttgtgagtatgtgttttaaaccaaaacccatagataggaagagccgacagggagctggaaactgcaataagctttcttctaactagcaaacgcagttgacagacatctttttatagacgtatctgtgattgcacgctgtttttaggcttgataattttttcaacaaggaaaaacttttcttcaatttgaaaaagctgtttacagtaaaatggcaaagtatgagaagacagaaagccatcctgctcattctaaagctaaattgggccacatttcccttaaagtatagacaacagcagcagtggaacacagttaagtgtgtgtttagtgaaggaaagttttttgaatactgccgccacaataatttttcaaaccttgaattctttattgagaaagtgacaaatcagtgagagagggaaagggaaaagaaaattaattgaatttgcaaaatttcttaaacaactaggattacagaagtaaaagaatgaatttgaaggctgggcgcagtggctcactcctataatcccagcattttgggaggctcaggcgggcagattacaggaggccaggagtttgagaccagcttggccaacatgctgaaaccctgtctctactaaaaatacaaaaaattagctaggcatggtggtacccatctgtaatcccagctactctggaggctgaggctggagaatcacttgaacctgggaggcgaaggttgcagtgagccgagattgtgccactgcaccgcagcctgggcaacagagtgagactgtgtctcaaaaaaagcccccaaaaaaacaaaaaacaaaaagaatgaatttgacgtagtgcctgtgtcagttagctattgctctgtaaccaattactcccaaatctagcagctaaaacccacaaatatttattatctctcataatttctggctgtagctttactgggtgattgtgcctaagggtctctcatagtctggggctcactcacatgacttttggcaggaagccttggttccttattggttgttggctggaggcctcagtttcttgacacatgagactctctataggccacttgactgtacatgcaacattgcatctggtatcccatagagtgagtcattcaagagacagaaagagatgacacagaagccacaatatcttttataacataatctcagaagtaaccaaacattacttttgctctattctattggtgacataaactaaccctatataatatcagtggtgactgcgcagtggtataaatagcaagaggtgagggtcatcgggaaccatctcagaggctggctaccacagtctgccttctggcctccagtgattcacgtttctcgcacatgtagaatgcactcactctctccaaaggcccactagaatgggccttccgtcccattacagccattacagcatcagctcaaagtccagaatatcatatctaaatcaagcccaggtggtaatgaggttccttggctgtagctacttatgtatgacttcttgagtggtttctcttgatctatagacctgtgaactagagagatgttacttgccccttaccactcaacatacaatgggaaaaggtaacatccacagacacttctatcaaaaaagaggatgtcttcgtgtatttgtgctgctgtaacaggataccacagactaggtaacttatgaagaacataaatttatttctcacatttctggaggctggaaagtccgagattgagggtctgcatctggtgagggccttcttgctgcatcataacatggtagaaggcatcatatggggatggggaaggaggctgaactcattcttgttaaggaacccactcctgctataacatacgtgctcctaagataacagcattaatccattcatgagggcagagccctcgtggcctaatcacctcttaagcttccacctcccaaaacttgcatgggggtttcagtttccaacacacgaactttggggatacattttttttttggtatactttttggtattcctccatagtaaggaggaaatgggaggaacacaggagtcgtggttcataaaactgagcctggcaagtattggacatttattgattaggactcagtcttactgtccagaagtgattctaggtggcctttagctctgtcccctgagctcttggttagactctttgtcatcttttcttttacgagaagtagtacatgtttacagctaagcagttttctaagcctgattcctgtcaatagaagttttgggagtccaaagaacgtttttccttttgtaatctctttgtcatttttagttcaggcttaaggtgtttctgcaaatagcttccttttaaaatttttcataggtctcccacgaatcttattgtccattagacaaaagccatatacacaaatttgtttgagataagctgttctctgtctttggctcctactaagatagctaagagacattaaacttctttttttattttttttcttagatggagtcttgctctgttacccaggctggagtgcagtggcacaatctcggctcattgtaacctccgcctcctgggctcaagtgagtctcctgcctcagcctcccaagtagctgggtctataggtgcatgccaccatgcctggctaatttttgtatttttagtagtgatggggtttcaccatattggccaggctggtctcaaactcctgacctcgtgatctgccggcctcagcctcccaaagtgctgggattacaggtgtgagcccctgcgcctgggacattaaacttctttttaaaccctgttgtttgagtgaaaggatctgtaagactcaccctcaaactttctagagattctttgctagtctgaatgttgccttgatgcaccacatttggtaattctgaagtcttaagaaaggactgtagaaccatatactgtattatgttttcctggcagtgccctaaatttgatctttaagaagccacttcttagtgttttcttgccatctggagatctagggaattttcacaactagcaattcctggctccttgttgtttaacaggctttcctttaggttatctctcctcttgtattttattttttgtttgtttgtttaaaagagacaggttctcggccgggcgcggtggctcacacctgtcatccccacactttgggaggccaaggcgggcagatcatgaaatcaggagatccagaccatcctggccaacatggcgaaaccccgtctctactaaaaatacaaaaattagccgggcgtggtggcaggcgcctgtaaccccagctacttgggaggctaagtcaggagaatcgcttgaatccgggaggtggaggttgcagtgagccgagattgtgccactgcactccagcctgagtgacaagagcaagactccatctcaaaaaaaaaaaagagggacaggttctcactctatcccccaggctggattgcagtggtgcgatcatagctcactgtaaccttgaactccttgggctcaagcgattttcccacctcaccttcccgagtagcaagaactacaggtatgtgccactgtgcctcactatttttaaatttttttgtagagatgaggtctctctgtgttgctcaggctggccttaagtgattgtgatcctaccacctcagtctcccaaagtgtggatgacaggcatgagacaccgagcccacccatctcttgtattttattatgcgcaactggaaggaaccaggaagcaccttcagtgcttttcctggaaatccccttatctagattacccagtttattttctactttccatgttgatacaggtgacaatgttgcaaaatttctgctattgcataaaaaggatctctctttgcagtttccaatgtgattttcctcactttcccttaagctctaacctagagcctacggaagggccagtactgcttggctgcaaagcctctcccacatttttaggcatgtgttacgccagctccccgttttcccgtaccatacctctagatgttatctagtactattacctattagtcatctattttgtggtaacaaattacccccaaaacttagtggcttaagacaataaacatttattttttcacacagtttcttagggtcaggaatctagaagttgtttaattgggtggttctggctccgagtctctcatgaggttgtagtcaagatgttggctggggctgccgtaatctgatggattggttgggcagagactctgctttcctggggtttcccataggctgcttgagtgctgcttgagtggggttacccataggcagctggtttcccgcaggactcgtgataagaggggtgtgggggggccaacatgaaaatctagtatgaaagtgatgtgctgttacttctgccatattctgttggtcccatgggtcagccctggtgtattgtgaaaggggactgcacgaatgtgtgaaagccaggaggcgggaatcactggaagccatatggacgttaccaggaggcaggaatcactggaagctatctggacgttgtcttctacaaccctgtcttgaagaatttcgtagcctactgggcacgagtgcctacatgttctaagcattgtgttagactgtcacatgttgttgatttggcatttacaatccagaaaggaactgctacccccagttgaagtttaaagagatcaagtaacttgttcacgacagattcgaatctagcctgggaataaacgcttggagcctaggccttaggtaaaggagtggataaatattctatagcatcattgcctttgtatttaaatatgaattttcttcattatacttatgtttagcagcagccatttaatgtctattttatatgtggacacctctgctcaactgttttttcttgtattcccttctccatgcagtcaccccttggcatgtggcggggataggctccaggacctcctgtggataccaaaatccacggatgctgaagtcccttacataaaatggcagaatatttgcatataacctatgcacatcttcttgtatacttcaaatcatctctagatcagttataatacctaatacaatgtaaatgctgtataaatagtttttatactgtattgtttagggaataatgataaggaaaaaagactgtacatgttcagtacagatgcagttttttccccaaatattttcaatatacagttgaatccatgggtgtacagagggctgattgtgtagctctgacctttttattttttttaacctatcctatctcgttcttctactgactttccttccaacactttccatagagtcctttggagcgtcagacttactctaacgtgaataaacttctttacaaatactctttttatagactacccctctcatctctgtcttaactaaatcctggctttcctgctagaatgccactcttcggggaccatcttgaatgaaagctgttcattcttccataccattttgtcttcaagccagtaagctgaatcagtctacttccaattccaaatcattgttctttcaccctcatgtaaaaattcttcttcctttgaaattcgtgccatctttttttttttttttttggtttatttttattttttgagacggagtttcgctcttgttgcccaggctggagtgcaatggtgtgatctcggctcaccacaacctctgcctcctgggttcaagcaattctcctgcctcagcctcctgactagctgggattacaggcgccctccacgacacccagctaattttttgtatttttagtagaaacgaggtttcaccatgttggccaggctgattttgacttcttgacctcaggtgatccgcccacctcggcctcccaaagtgctggggttacaggtgtgagccactgtgtctggccctgaaattcgtgtcatcttaatcattttctgtcattctttgtcactgtcatttattagtctgcctgtagcttatcccttgtttatcaaagactttggcactcttttctcagttttctgtccatctcttccactatcattctgggtggcttcagtagccaggtggactaccatgcaacatgctagtttcatcatccttgttcttttcaactccagtgaccttcacttccacttctttccaacattttactatcatgacttttagactgtaagacactctgaaatcttgactccttcattctattgactgaccaccatctcctaatttccagaggtactctgctcccttacatatatatttattttatttttcttttttcttttgagaccaggtcttgctttgttctccaggctggagtacagtgatgcgatcacagctcactgcagcctcgaatggctgggctcaagcaatcatcccacctcagcctcctgagtagctgggactataggtgtgcaccactgcatttggctaattttaaaattttatttttagtagagatgaggtcttgctatgttgcccgggctggtcttgaactgagctcaagcaatccttccaccttggcctcctgaagtgctgggattccaggcgtgagccactgcgcccagctcccttacatatataataccggtgttggatcttaccaagatgtctaggctgacccccttcccccaattggcttatcagtcaaacaaatggctaatatcaaacgattctggctaatgaagtagaaaaggaatttattagaagatagtaggtagctcacaaaatcaacagggaagctggagaaccagcttggaaaatgggcaggaagcaaagaggcccagcagcatataccccagctaatgccatggcactaggacagtggttaatgtgctgttgctcctacattcttgctgttatttcttctgccattcccataaataattttaatactgtctctccatttttatattacctgcttaggattcaaaatcttgcacaagaacatctgattggctgagtataggtcacatgcctattcctttgctaccagggagctgggagaggaaagatctgccttctttggcttacttagtgagaaggtagacacttttctgccaatattatacataataggattccctcaaaagacaacgaatgtttggatcctgggtcaaaaaaaaaaaaaaaaaaaaaaaagaaagaaaaggagaggaaggggaggggaagaatagaaggaggagaaaaaggaggaagtggaggaggaggcagcaatattgacaaatgtctactttagcccactactggcttgggaatggggagaagtctgcctttaagcctcctgaaaaaaaaaaaaagcctcctgatccaactttaacctccaaattctcactagatgatcttgcttcttatttcaaaaataggagccattaggcctggaatcccttcacttgttgcctctgtctttaaatgtacctaatcaacattgtcttttcctgtttccctttagctatcttagtagaagagctcttccttctcttgttcaaggctaatttttccatttatattcatgatgtcatccacacttgtcttctccaggacccctcatcattaattaagccttccttcttagttaagattatttattaatattccttttttgtcagacattgctgaatacaggagatataaagatgaatttgatatagctttgaagtatttattatttagtgggaaaaagacagacacaaataattgctgtgcaataatttaatcatgattgtaattatagtagttccttactttatccatggggaatactacaccaagacccccagtggatgcctgaaacaatggatagtactgaaccctatatataccatggtttttcctatacatacatacccatgataaagtttttttgtttttttgttttgtttgttttttgaggcggagtcttgctgtgtcacccaggctggagtgcagtggtgcaatcttggatctccgcccactgcaacctctgcctcccgggttcaagcaattctcctccctcagcctcctgagtagctgggactacaggcatgtgccaccacactcagctaatttttgtatttttagtagacatggggtttcaccatgttggccaggctggtcttgaactcttgacctcaggtgatccacctgcctcagcctcccagggtgctgggattacaggcgtgagccaccacacccggccaataaagtttaatttttaaatgaggcacagcaagagctgaatactaataactaatgataaaatagattagttttaacaatatactgtaataaaagttatgtgactggtctctctctcaaaatatcttattgtactgtactcacccttcttgtgatgaagaagggatggagtggaatgacgtgagatttcatcatactgctcaactgcgtgcaacttaaaacttaagaattgtttatttctggaattttccatttaatatatttggaccacggttgagtgtgctaactgaaactgtggaaagtgaaactgtggacaaagggagactgctgcatttgtgtaatttgtttgatacatgattttctattagaatgtgtcttcagtggccaggcacggtggttcaagcctgtaatcccagcactttgggagccaaggcaggcagatcatgaggtcaggagattgaaactatcccagctaacacggtgaaaccccgtctctactaaaaatacaaaaaaattagctgggcatggttgcaggtgtctatagtcccagctactctggaggctgaggcaggagaatggcgtgaaccctggaggcggagcttgctgtgaccacagattgtgccactgcattctagtctgggcaacagagcgagactccatctcaaaaaaaaaaaaaaatgtgtcttcagtgtctaatacctaagaggtgctcaataaatattattgaatgaatgaagaggggtaagcacagggtactgtggaatcatagaggataggtacttggccctcccctaggagggaaggaagattgggcttatgtcagtggaggcttggtggaggagactgcagcagccagcaggggaaaaaaaatcaggggaaagtaccaggcagagagaggggcatgaacaaaagttgagaatggtgaggaggtggagatggtttgaacagttaggtgttaaatagagttattaacagttaacatctattgagtttacatacatacatagtatatgtttatgtatacttgttaagtactttacatatattttctcatttaatacttacagtattctttgattaaggtattattcccattttagaatagaaaaatctctgcaatacgtagggaaaatagttaacttgcccaagaccatttagcctataaaggatcaaggagggatttgttttggggtctttctggatgcaaaacctggtgctctttataaatgccatgttatactaatacagtgtggttcccaaacttggtggctcatcagagtcccctgaggacctttgtaaaaatacaaattcctggccataccccagacctgttgagtcagagtttccaggggcagagcttatagatctatatttttgggtggttcacatgtaactggcctgggactggttctctcaccctggggagttattgcaggtggtgtcaagagcaaggcaggaatagctgactagccagggaggttttcctgtgtcttgctcctgatccttgactttaccccgtagatggtggggcactgaagctgagaagtgtcatcagatacacatattgtgcccaccactttagcaacagtgtgaaggatgaagttgaaggcacaggttacaggcaataagaacttacatctttagactgctgtcttgactgagttcgtcctttttcctcacattctcaagttttctaaattttttttctcttggttctgccaacccttcagttctcttttccctagctaatttcttgaaagaaatagttatactcaatgttaggtttcagtcagttcaagaaatgttccttactgacttactcttctttgaggtcatcttccatcaataaatgtttattgaatgttatttgaaagcatggtcctttctcagattttgctttgaagtgaaaataccagggatgatttattttttcatcacgtaatcactcatatgacaatttttattgatcaccaagtactcttcatgtgtctcctttatgctagggcctgggatacaacagtgatgagataaggcctcggactttactgatcgaacatctaatggaaggtggaagaagagaccatcacacaatgacggtgttatggggaacacagggtacagtgcattcatacctcctccccatcactgtgtcaatcgcttaaccatctctctgcctccagccttgcttccttccagttaagttatcctcattgattatacatctagccagatactccctactctataaatcttcatttgatagctattgtccttaaaataaaatccaaactccttcaatgtgtcttactaaaaaaacttgagcctatccccaccttgcgtactctcattctgtttcattatagggaagttaaggagcaagaatttgaacttttccttatgtttctttagtttcttttctttctttccaacatgttcttgttctgttgcccgagctgaagtacagtggtgtgatctcggctcactttgacttcccaggctcaagccatcctcctgcctcagtttcctgagtagctgggactacaggtgcacaccagcacgcccagctaatttttgtgtttttttgtagagatagggttttgccatgttgctcaggccttagtttcttttctggaagatttttttttttttttagtattttgaattatttttaagtaagagaaaaaaaaatcaaccttgttaatataaagggtaatcacttaaaaagcacacctaagaattagtatctcaaattgttgtgtagccgccaccaccatccaacttcagaacctttttgtcaccccaaactaaagctctgtgcccattaatcaataacttcacatctccccctcctggaaactaccgttctgctttctgccttaatgagtttgagcactctaggtacttcagataagtggagtcatacaataatttgtcttgtgtctgacttatttcacttagtataatgtcttcaaggttcatctaccctataagaatgtgtcagaatttccttccttttcaaggctaagtaatataccattgtatgtgtatgccgcattttgtttatccatctgttgatggacatttgggctgtttccaccttctgtctattgtgaataatgctactgtgaacactggtgtgtaagtatctgttcgagttcccacttacaatacttttagttatttactcagaagtggaattgctagatcatatggtaatttgatgtgtaactttatgaggaactacgatactggtttccaaagaagatactattattatcaccatgtggcaagtggggagacttgggcacagagaggttaagtaacttgcccaaggtctcacagctagtacatggtaaagccaatggtggctggctccaggtcagtgctcttaaccagcaatatatacatacttactggcctcttttgtaatctctgttataattatgttttcctatttggggaagattgacatcatttggaggttttttttgagatggggttttgctctgttgagcaggctagggtgcagtggtggaattatggcttactgcagccttgacctcctgggctcaagtgatccttccacctcagcctcccaagtggctgggactacaggcatgtgccaccatgcccagctaaatttaaattttagaattttaacttttttgtagagacaggatctcactatgttgcccaggctagtcttgaactcctggcctcaagcaatcctcccccctcagcctcccaaaatgctgggattacaggtgtgaactaccgcctgttttgttttgtttttagaggcagggtctccctatgttgtcaggctagacttgaactcctgggcccaagctattagcttgctgagtagctgggacaataggcatgtgccaccttcgagttttgagaattggactaaatcaaacaatattttactcgtagagtatttccttcttggattgatttttttgtttgtttgtttctgagatggggtcttactgtgtggccctggctagtctcaaactcctgggcttaagtgatcctcctgccttagcctctggagcagctgggactataggtgtgagccatggtacccagctttggattgattttttttttacatgacaaaattgttatagttctcactcttaaatattttttagaatagttctagatgagtatacaggaaactctttaggaatttgtattctacaaaacaaaatgaaaaacaaaagtatactgacacagtgtatcagtaacaaatagcctgactctcaaagtactctcattacaaaacttagaatgatactttttttttttttttaaaggtggtatgttacccagtctcaaactcctgggctcaagtgatcttcccacctcagcctcctgagtagcggggactataggcatgtaccaccacactcagtgaattatatgttttaaaaggatattttgtatattggccatttctctaacatttcccaaaactgcatgcttttggcatctgtgctataaacttagaccaaagtagcttcagaaatacagtagaagctccccttaacgtgtgtgccagattaacataaaacagacatttcctttctaagacatgcttattctaagggcacgcagaataccttttgccattcattaagtatgatgttagttgtgagtttttcataaataccttttatcctgatgaggaagttcacttctattcctagttttcttttaaacaataaccttaagaagtattttttaattgacacataataattgtacatatttatggagcacagtgtgacattttgatatgtacacataatgtgctatgatcaaatcactattcctagttttccgagtgtttttataatgaaaagatgttatgtattgtcaaatacttgttctgtgtctattgagatgacatggtttttttgctcctcttcgttctattaatgtggtgtattatggtgattggttttcatatgttcattctcgggagaaatcccatttggtcatagtggataatcccccataaagtggctggattatgttttcaagtgttttgttgaggattttgcatttatatttataatggatgttggtttgtagttttcttcttatgtctcagttttgttttttttttaaatcatgttaatactggccttatagaatgagttgggcagtgcttccgtctcttcaatttttgggaagattttgtgaaggattggtagattggtattaatttttttttttttagacggagcctcactctgtcacccaggctggagtgtggtggtgtgatctcggctcactgtaacctctgcctcccaggttcaagtttttctcatgcctcagcctcctgagtagctgggattacaggcgcacaccaccacacctggctaatttttgttagagacgggatttcaacgtgttggtcaggctggccttgaactcctggccttgagtgatctgcctgcctcggcctcccaaagtgctgggattacaggcgtgagccactggcacccggccttattgagtttttagtaggtttacaggtactatcagagttattctcaaggtgtttacagtatggaaagtgagacaaataagtaaactgctaattataatatggtttgatagactattatgatagagatagcatgtatgctacatgattacataggagggtacttaacaaaaaagagaagggaagccttcaaaaggtcagttactcttaaacgtgagtgacgaatgggagatagccaggaaggaggagagcaatattccaggcaggagtgtccgtcacaaaggcggagggcaatattccaggcaggagtgtccatcacaaaggcactgggaaaaagcattatcactgggacactacagagacttcctgcctagtgcatctgtgtggaaaagtgtgaagagatcacatttttgagataggtaggagcctaagttcataaagggctttgtgcgcctggttaaggagtctgaatgttagtttgaaaggccttgcgaaccattggaggattttaaaccagacggtcaaattactaaatttgcattttagatcatcctagcaaaatgtggattatggtttgatgggtggaatgggaagtgagagaaaggagactaaaggcaaaaaggcaggaagtgactacattaatttagctggaagtgatgagtgtttatttatttatttatttatttttgagacagagtctcgctctgcctcccagcctggagtgcaatggtgcgatctccacttactgcaacctccacctcccatgttcaagtgatcctcctgcctcagcctgtgattacaggcgcatgccaccacacccagctaatttttttttgtatttttagtagaggtggggttttatcatgttggccaggctggtttcaaactcctgatgtcaagtgatccacccacctaggcctcccaaagtgctgggattgtagtctaatcgtaagcaatgacaatggaaatggaagggaaagaacagagttcagaagggtttataagtagatggccgggtgcactggctcacgcctgtaatcccagcactttgggaggctgagatgtgtggattgcttgagctcagaagtttgagaccagcctgggcagcatggcaaaaacctgtctctactaaaaacacaaaaattagctgggcatggtggcacaggcctgcagtcctagctacttggggagctaaggtgggaggatcgcttgaacccaggaggtggaggttgcagtgatctgggattgcgccagtgaattccagcctgggcaacagagcaagactctgtctcaaaaacaaacaaacaacaacaacaacaacaacaacaaaaaaccccagaaaggttgaaaggtgttgatgatcaaatagaattaggaagatgaatttgttagaatgagaaatttggaggactgtgatcagggaatcagtagaagatagcagtgagaaggaatagtagattatgtgtcctcaagtgatgaaccttaatagagtagtagtttttaatatgaagttgaaacaaggatgctcccagacaagtccaggttgtgggccattctgtatgatgctataaagcctggtctcttcaacaagctaatttcatgtgtgtggggaggggtggggaaggatggaggactgttttagtttcaaagagaacaaaataatatgtaacagccaaatgcagtacataatctttgattggattttagtatgaaaaaaatacctatgagacatttagggacagatggagacatttgaatatggaatagatattagatgatcttagtgaatttttgttaatttttaaagatgtcataatagcattgggattatgcaggagaatgtctttatttttaggagatatgctgaagtatttagggatgaattattctgatgtctgcaattgacttagagacagacagacatggaaagaggaatcaaaaaatggcaaaatattaacaatagtttaggcggtgggtatagagttgcttgtaacactaagctttcaacttttctgtgtgtttgaaaatttccttcattagagaagctggcaaaaaatatggcagattaggagtatggggctatgagtagcaatggggagctctctattgctaaccttccccaagtccctgagataggtaagccacgggagaatgagcagccagttctgaaagggacttcaagatgggtaatgactttggggtagtgcttctcagcttttatcactttaaaacctaaacattggccaggctcagtggctcacgtgtgtaatcccaggactttgagaggccaacgtgggaggattgcttgaggccaggagttcaaaaccagcctggtcagcacagagtgaccttgtctctacaaatgaaaacaaaaattaaaaaaaattagccaggcatggtggtctgtgcctgtagttccagctactcaggtggctgaggcgggaggattgcgtgagcctgggagtttgatgctacagtgagccatggtctcaccacagcacttcagcctgggacagagcacgactctgtctcaaaaacaaagaaacaaacaaaaaccctgagcatggaaaataatatttgtgtggcacacaatatctggtaaaactagatgagctttgggactctacatgaggcttgattattaaaaaaatcattatgttaaaaaattttgttatgtatttcattatgtaaaaaaatttataagaaaataaaacagagcattaggaaattttaaaatgatgacccttttttaaaagttccaaatgtatttaaaatgttaaaggtggaacttgagcttgcttcccaacgtgttactttttaatatcaaactttttgcttgaaatagttgtactcaattcctgattttaaaaaatctttaatatgagctcttcaatttttgatcatttactaccaatgagtaactgttcatgcagaaatgtaaaagcatttttcccaaccattaaaaaatcaaaatatgaactaggcccctacctatctcaaaaatgtgatctcttaacatgttctcacacttttttttttttttttttaaattttcagagcaagatccttcaggctgcagtgcagtggtgctatcatagctcactgcaaccttgaactcctgggcttaagggatcctcccatgtcagcctcccgagtagttgggactataagcatgtgccaccatgcctggctaattgctttttaaaaaattttgtgtgtgtgtgtatgtagaagtgaggtctcgctatgttgcttaggctggccccaaactcctgggctcaagcagtgcccccagcctggcctctcaaagtgctaggattagaggcatgagtcactgcacctggccctcgcacaaatttttgtagtttcccaaggattatgcttttctttttttttttttttttttttttttgagactgagtctcgctctgtcacccgggctggagtgcagtggcaccacctcagctcactgcaacctccacctcccaagttcaagtgattctcctgcctcagcctcctgagtagctgggattacaggctcgcaccaccacgcccggctaatttgtatttttagtagagacaggggtttcaccatgttggtcaggctggtctcgaactcctgaccttgtgatccgcctgcctcggcctcccaaagtgctgggattacaggcataagccactgtgcccggctggattgtgctttttcactgtgcctttgtcagtgatactcctgcctggaatatttcaaaccagttgaaattatatcatctaaaaacttctcctttaattaaccaatataacttggaaaattttctaataatccaaacgatttttttttttttttgagttggagtctcgctctgtcacccaggctggagtgcggtggcacgatctctgctcactgcaagctctgtctcctgggtttacaccattctcctgcctcagcctcccaagtagctgggactacaggcgcccgccatcatgcccggctaattttttgtacatttagtagagatggggtttcaccttgttagccaggatggtctcgatctcctgacctcctgatccaccctcctcggcctcccaaagtgctgggattacaggcgtgagccactgcgcccagccccccaaatgattttttaatccagttgaactgtctcatatcaattatttcaaagtaatgaagatttaatttatatatgatgcatgtgttttttgtttgtttgtttttgagatggagtctctctctgttgcccaggctggagtgcagtggcacaatcttggctcaggctcgctgcaacctctgcctcccaggttcaagtgattctcctgcctcagcttcctaagtagccgggactacaggcgtgcgccaccacgtccagctaattttggtatttttagtagagacagggtttcaccatgttggccaggctggtctcacacttctgacctcaagtgatctggccacctcggcctcccaaagtgctgggattacaagcatgagccaccgctcccgacctctcatgcatgtgtgtttagggccgcacaacaagcttggctgctactgaaaggacatatcagttacggaggcatggaagtagcccatagtatgtgaagataaagatttgggactgcttcctagagccatgagccctgtcagtttgaagtagttgcacactggaatgaacactatgctctttgggcacctggaacagaaacttctccaggagctctctactgggtaatggtgcattctgtatctggcctctgaaggagaagaccacatgatatgtcacacacttggcaatggggagcagtgggtgcctgatggcatttgttgtggttgtcgctgtgcagaacaggaggcctgccatcggagcctgtcgtgccctggtccccctgtgggaagctctggaatagactgctttctggggcctgacttcatctggccacactgagagatgagagataagaggatcagtattttggggtacccctttaatccatccactttacaggctgagtatccctttttctttcttttttttttttttttttgagacggagtctcactctgttgcccaggctggagtgcagtggtgcgatctcggctcactgcaagctctgccttccgggttcacgccattctcctgcctcagcctccccagtagctgggactacaggcacccgccaccacacctgggtaattttttgcatttttagtagagatgaggtttcaccgtgttagccaggatggtctcgatcttctaacctcttgatctgcctgcctcggcctcccaaagtgctgggattacaggtgtgagccaccgcgcccagccttgagtatccctttttcaaaatacttggtaccagaagtattttggatttctaatttttttggattttgaaatctttgcatatacataatgagatatcttgggaaagggattcaagtctaaacacgaaactcatttatgtttcatataaaccctatagacatagcctgaaggtaattttatgtagtattttaaataatttgtagatgaaacaaagtttctctacatagaaccatcagaaagcaaaaatatcactatgtcagccacccatgaggacaagctggttgtttggcatcagcatcattcctgaccctaaattgataggaattgatattgataagcaatcatcttcttacatttattcacacggaagtacttaccagtaaaaaatatgaagtaccattcatgaagtgaaaaaataatgtgttcaaggtaatgaagcagcacagtggcatcaccagaatacctgtgtcagctgttagcaacagcaaacaccggactttcagtctctgcctgcaatgctgtgttttgattagaaggttactgtatactgtacaggttgagtgacccttatctgaaatgcctgggacctccaaatgttttggttttggagcattttggatttagcattttcagattagggatggttaacttgtattgcaatgtccagtgggtaaggattcctgagttagggtagtcctagatttcagttaaggcattaattattcctgatagatgataatttgaaaaaagagactcgatgatcaagtgactttgggaaatgctgtgttgaacaaagttaagtttcatgattgtagaacattccaaagactttaatatactaatacacactataaatgaccatatagaactacatataaatattatatataaaccataatattcagagttttccagacatttttgatcactgaagccttttattgagaagctctggctgggcgcagtggctcatgcctgtaatcccagcactttgggaggtcacgggaggtggatcacgaggtcaggagttcaagagaagcaccttgaggaatgagtgttaaacagaacacagtttagaaaatatattgataagaagttattaaaaattcatgccttgcaggctgtaaatgcactttaatcagagtgccatttgttttgttcaaatgttttaaattattggaatgcacactttttaaaatatgcaaataaagtttggaaactaaaaaataaagttagtgcctgttctttagagatggaaggataaaattataaattataagttttacctatttcaaaacaaaagtcagcattatacttattggtaaaagactagtgttctagattattaataataataattatatttttataaaatggattattatcactttatgcattaatgttgctttggtagtgctggccagtgccatgagtcatgacagagaaataagatacaataagaagataatacaaaaagtattattagaaaatataaaataatcaactgaaagattttaattaatacatttttcaggaaatatataatcaatagcaaaaattcaatttttacctcaaacacttgaaattacagggctcgaaaaaatatttcatcacaatatctacaaaacccataaaatactcaggcatcatcttcttggaggattgtgtgtgacttacatgacgaacctcaaaatatgtaatatttaatttagagatctataagggatatatatatctaaatatacacctcttagatgtgaaaactattctaaaatgttaattctcaatgtatagctgattgcaatagcaataaaactttcaatggtatttcatttggaatttctaaattgtatatggatttctgtatttcctttggaataataaattggtattgatgaacattcctaaaaagaggctaatagagtggcaataaataaaatgctatggtaatggcacaagactagaaatgcaaatcagaatagaattaacagaatggacaattgatagaattaatctcaatcacataaaagatgataatacacgataaagtgcaaggaatcaagcacctggtaaagtaggaaaagctaatctttcactttgaatcacatcaaaataaacttcagatgaattactcagtgtgttgtccagtgtcaaaaacaaaaaacaaagaacaaacaaacaaaccacagtaaatctatctgtaaattgttgaagaaaatagaattaagtatttgccagacctcgagaaaaagggtgatttttctttgtctctctcttgggcctttcaaaggataagtttctcaactttacagtatgagaagaaatctcaacagatgtgactacctaaaaataaaggataatgtacttttaaaatgaccttaaatttaaaaaccaaacatcagctttgtgcagtggcagtgtcgtaaccagagagattttcccaagatactgttatggctaataagaaccttgctagttcaactgtgttcaactcgttgaatttcagtgagataaggcaaatatacaaaggtgaattgggcaggattgttcaataaagaattgattattgattataataatgaaaaatcagaaactaaacatccacaattggagggttgattaaatacattttgataaagctctataatggaatatcaggcagtcactaaaaataataaggtaatgaatatttattgagaatgaaagatccaatttattgctgagtgagaaattagattagagaacaacattaaaagtagttaactctgggccgggcgcagaggctcacacctgtaatcccagcactttgggaggctgaggcagttggatcatttgaggtcaggagtttgagaccagtctgaccaatatggtgaaaccccgtctctactaaaaatacgaaagtgagcttggcggtagtggtgcacacctgtaatcccagctactccagagactgaggcaggaaaatctcttgagcctgggaggtggaggttgtggtgagtcgagatcatgccactgcactccagcctgggcgacatggcaagactccatctcaaaaaaaaaaaaaaaaaagacaaaaaaaaagaaaaaaagaaaagagtagttaactctgggtagaatttgaagtgattttaacttaaactttcatctgtgtctttttcctccagtaattgtgtatgattttgatcatcagaaaggaaatggagctgttttcattttagaaaaacaagttcaaacaactgacctggaaaattgtttgcagtaacttcgacatagggttaagtctttattattcaaacaggtcatgcaaattgtaaagaaataattgaagatcccagtagggttgagcagagaacatgaatagacaattcataacatagaaaacagagatggtaaacaaacatatggatcattattcagattcatttgtaatcaaagcagtgtaaatttaaataatgaggtaatatttatttgttgttaaattagcaaaagtttattgctgtgttataataaagaaaaaataatatcaataaattatggtgtattattttggtaccattaaaaatggaaggttgtgtaaattatgttgcaacctggaaaaatataacatttacgtgaagtaattaaggagttaagattttatactgtaagtactaacaggtgggatggggtggagtgaggtgaggtggggtggggtgtggggggagaagagcaggattgttcaaatgaggaagatctgagttcagtccagctctgccactcaataactctgtgatcttgggcaaggtgcttagcctctctgagctttggtttctttttttctctacggttgtaaaagtatatacagtacctgacgtagaacctggtgtatagtgtttattcagtacatatttgttgagtgagtgaatggtagttattcaatgccatatataaaagaatatgtatgaagaaagattggaagaaaatacagcaaaatgatgagtagttatgttagggggaagagaatttgactgattttaaaatttcctattttctactattgggtggtattatatttctaattgaaataattacctaaactcatgcctaatctctttctttctgggtgtcctactgtatttactgtttgatacattttgacacctttttcttttctttgagacaaggtctggttctgtcgccaggctggcgtgcagtagtgtgatcatggctcactgcagcctcgacctgctgacctcaagcaatcctcctgcctgggcctaccaaactgctataggcatgagctcccatgcttagcacaatttagagacttaattacattattgtcctttattctttcactcagccaaacaccttggagttggccttaacccttttctttctctctgcacctaacataaaatttatcagcaaatcttgttggctctgctctttagaatatatccagaatctgccgggcgcggtggctcacgcctgtaatcccagcactttgggaggctgaggcgggtggataatgaggttaggagatcgagaccatcctggccaacatggtgaaaccttgtctctactaaaaatacaaaaaattagctgggcatggtggtgtgcgcctgtagtcccagctactcaggaggcagaggcaagagaatcgcttgaacccgggaggtggaggttgcagtgagccgagatcaagccactgcactccaacctgggcaacagagagagactctgtctcaaaaaaaaaaaaaaaagaaagaaagaatatatccagaatgctgacatttctcaccaccttcactgctaccattctggcccacatctctcacctggagtattgcagaggcctcctgactggtctctctgcttccacccttttcataatagccaaagtgatcagcagaccgcatcactgtgctgcctggaaaaacccttcagcggcttctcatctcattcagagtaaaagccgaaatccttaaagtagcctacagggctttttttttttttttttttttttttgagatggagttttgttcttgttgcccaggctggagtgcaatggtgcaatggcgcaatctcggctcactgcaacctccgcctcccaggttcaagcaattctcctgcctcagcctcccaacttgctgggattacagttatgcgccaccatgcctggctaattttgtatttttagtagagacagggtttcaccctgttggccaggctggtctcaaactcctgacctcaggtgaaccaccctcctcggcctcccgaagtgctgggaatacaggtgtgagccaccgcacctagccaaggcctctttacaatcaccctcaaactcatacctttctgatcttatttcttactcttctgcacttactgttctctctgcctgaaaactctgcagttgttcataaggctggttccttcccctccttcaggtgtctgcccaagggtcgccttaccacagaggcaggcctctctaagaccaccgtatcaacccattctcccccacccacgcccagcactcctcgtgtccctaccctgtttattccttcctctatttctcacaccatttgccttactatgtattttatcgaatattacgagcttatatttctttcccaataaaagtagctctatggaggcaggaatttttttctattttgttccttgccataaccttagcacattgtaagtactaggtaactgtttactgaatatatatatgagtgtttcatatatgtaagtcatagtccaaaactagtttgaaagctttttgagtaaatgtcatgttggtttttatgcctttcttcccccaactccacaagcaaagaataaggcaaggtaggcagggaacactgttgataagcaaacagtatctgtttttattggtttcactgtgcctctcaggctacgactctacccaaaggacttgagatagagaggccgctgctggaaatattctgtcaccgtgattggagtggttgagtggttccatgagtatatgcgtatgtaaacacttaattaagctgtgtatttaagatcagtgcacctttaccatatgtatattttgcctcagaaaaaatgtttacaaatacagtgtatcctttgacatctccagaggaagttaaacatgctaaatgatacataaatataaggagagggttcttcatatgcttacttattaagattgctagtctggttattagaatttttgttttgaattcaaagctaaagtaaactaatttttatttactttgtcttttgcagagataatagtagcagaatttcacaaaaaaatcaaagaggcatttgaagtctttgaccatgagtcgaataatacagtggatgtgaggtgtggaaatatttttttttttgttacacttttaaattactgatacaagtcataagatacaagagagctattttctctttttacactgtaccttggatttattatgctcttttaagtatttattttccatgctccgtaaaaggtctttgctagctattgctttgataagtactgtttcttattcttcatactctggtagaaacaatatactgtattctcattgcctgttccaacctataattgtaaactctgtgactgagatgaactctattttagctttagtgcttggcacatagttggtactcaggaaatagtcgttgagtgaaggaacagcatttgctttgtaaaacacataaatatgtattataaggccacaaataggatattgcaaggaaacagtaatgcttatgcgatgacacactccccctgtaaaatagcaaaaagaacccaaacagaagaacataaaaaggcaagagaagacatgaatactggtaggtctgaaatggaggacacagcttgggactgaaacaaaacaaacaaaaaaccccttaagagaagagattagacgctaataagaattgtagggtttgtgccacacacatcaaagaaaagcaatgaagccaggcgtggtggctgacacctgtaatccaagtactttgggaggtcaaggtggacagatcacctaaggtcaggagttcaggaccagcctgaccaacatggtgaaactctgtctctactaaaaatacaaaaactagccgggcacgatggcaggcacctgtaatcccagctactttggaggctgaggcagaagaatcacttgtacccgggaggcagaggttgcagtgagctgagatcatgccactgcactccagcctgggcgacagagcgagactctgtctcaaaaaaaaaaaaaaaaaaaaaggcaatgaaaccatcctttcaggaggccgggctaaatgagggttatttgatgagattgcaatctcaagaccagaacctagtagagaggccagcaaagcagtgggaagtggtttgaaaatggttctggaaaggaactgtttgatgcttataaaccagtgccatcagagctgcagcaccatacagctccggtggctgtggtcacattgcattctgtgggaatgacattgtggaacaccaggccttcctgtgggtatcccagtaggaaatgagtgggcagggtgctggtggtggtggtagggttagggagggggtgcagcaggcagcccggcctgcaatttgaataactaactacatgaatgacaagtgccttgacctcagacctctccttgaagggttctcctcctgggggcgggggacagaggtattgttagagaagtcagggaaagtatggcattatgagagagagggaaaagagagaaaagaaaccagcatctgcttgaggcttgtcatctaacacactacgtgtagttgggtgccagaggcttcacgtggattacctcattttaatctttttatttatgggttaagggttggcatctccggtttccagagacaaggagaaggtaaatcgtttgctccatgtcacaccaggtttctctaacgccaagtctcttgctacactgtgggcatgccacactgcccacactcccactcctactctttagagacatcaggggcttctcttctgccttcaggcttcctgacagtagcagtgaaaagaaaatctcccgatcactgacagcaatgatgccaggccttttttggtaaaagggccaattcagtaaaagaaaacgtgtttatgggctgaatctttttttccattgaaagttaaaataactttaccgaggccctgagggaaagtggatgttcttacaacctaaagagtctgctttgttaattaaagatggttactaagaaaattgttattgtttttagcattaaaatattgctgctgagtatatttgaggaataacaacatggatgaatgtagctttataatttttcctgtgttaatttgtatatcactttaaagtttataatgaatgttctcatgctgctggtatcattaccatccactctttttaaaaaattcgtttaaagatagggtcttactctgtcctccaggctagattatagtggcttgatcataactcactgtatgtaaccttgaactcctgaagtgatcctcctgcctcagcctcccaagcagctaggactaccacgcccagctaattattatttcttgtagtgacaggggtgttgctatgttgcccaggctggtcttgaactcctggcctcaagtgatagaccctccttagcctcccaaagtgttggtattacaggtgtgagccactgcactcggccactctttataaattggaaattaagctttgggaggccaaggtgggtggctcacctgaggtcaggaattcaagaccagcctggccaacatggtgaaacctcatctctcctaaaaataaaaactaaaaactaaaaaataaaaataattagctgggcatggtggtgtgcacctgtagtcccagctgcttgggaggctgaggcattagaatctcttgaacccaggaggtggagattgcagtgagctgagattgcaccactgcactccagcctgggcgactaagtgaggctttgtctaaaaataaaaaagaaagaagtgtctttgaacggagggagagatatgtaatggctcagtgggggcaggacagagagagctgttcctggagacgccccccgcccccaggcactggctgttcctcccctaactgctttatccctcaggtggaggtttggtgttacttcctgtgtagggctgatctaggtcccctgagaggtctaggtcttagaattttgtggtggctactttccctttcccttatctctgctttgcacaaattgaaatatttgatttgaaattgtattgcattagataaagggaaagtctggtattccaaatgctgggcagccaccagcccactgtcaaaagcattatgagctgggctcctgctactgcccttccacctctgaggggcagtcctgaggtctggaatcagacttcctgggttcccatcccagctccgtgactgcgagtcactttgttattctctttgtgcctccatgtacctttgcctcctaggtttcatagtataagtaattagttctcagagtgcccccaagaccctttccggggtctgtgaagtcataactattttcataataaatttaagacagtatttgttcttttcattctcactgtttccacaagtatatactggagtttttctttctttttttttttttttttttttttttagacagggtctcgctctgtcacccaggctggagtgcaatggtgcaatctcagctcactgcaacctccgccttccgggttcaagcaattctcctgcatcagcctcccaagtagctgggattacaggtgcccgccaccacgcccggctaattttcgtatttttttttttttttagtagagacggggtttcaccatgttgtccaggctggtcatgaactcctggcctcaggtgatccacccaccttggcctcccaaagtgctgggattacaggcgtgagccaccacacccagccttatactggagtttttcaaaggctacatgacgtgcagttttacaacagattgaacgcagaactagatatgagaatgcagctgtcctctgtgaagccaggtgttacatatttacattgaacgtatgtaaaacaatgtaaaacaatgccattcttctaaatatactttttgttttggaaaatatagtttaaaaaattaacaactatttatgtaaacatttgggttgatttatgatttttaaatgaattaataaatacatatttttaaaatgtaagctttaatttctaatatgatagtaaatatagatgcatataactcacacaaacatagacgctttgagcgccttgataatttttgatagtttgtaaaaggagttatcagaccaaaaagtttgagaaccactattgtgagtggacatttttaaagctcttagaacaatattagcttgggatttaaagctaagaacagtattagctattataattattctactttatatatatatagtttttattattattattttgagatggcatctcactgtgtggctcaagctggattgtagtggcccaatctcggctcattgtaacctctgcctcctgagttcaagcaattctcctgcattggcctcccaagtagctgggattacaggtgcccaccaccacgcccatctaatttttgtatttttagtagagacagggtcttgctatgttgcccaggctgttctcaaactcctggcctcaagtcatccgcctgcctcagcctcccaaagtgctgggattacagacgtgagccactgtgcctggccccattttatgttcttaaagtaaataactcagacttgttttgcccctgtttaatctggatgagcaatgttatgctgtatgtaacaaaactctcataagaactttaaaatacatattttgttttagagacaagctctctttatgttgcccaggctgaccttgaaaccctgagctcaagcgatcctcctgtctcagcctcccgagctgggactataagcacgtaccacacctggctagaactttttacttatttccgtatgttccatatcgatctcttaagatctgaagcattttattttcctttttcatttccttgttaaatagttttcgaaagctagcgccttgaaaaacattgggcaggttttcaatatcactaattagggacattctgattttgcctcatataaaacacagactttttttttttttttccagacagtctcactctattgcccaggcaggagcgcagtggagtgatctcggctcactgcaacctccacctcctgggttcaagcgattctcctgcctcagcctcccaagtaccaggaatagtgagattacaggtgtgtgccaccacccccggctaatttttttttttttccatacttttagtagagacagggttttgccatgatagctaggctggtctcgaattcctggcctcaagtgacccgcccgcctcagcctcccaaagtactggaattacaggcatgagccaccgcacccagccacattttcatttatatatattttcctgctctgtgtttagaagttaagaagactgattgaaaattaaatttttgaatagatgatatatgtacatgggataaaattctaaaggtagaaataatatatagtgataaataaatctcttttttacctatccagttcccctttctaaaggcaaagtttgttacagttttctctaattcttccagagattctccatgcaaatatgtatgagtatgcatgtgcatgtgcgtgtgcgtgtgtgtgtgtgtgcatgtgtgtattttttactgtggtaaaatatagataacctaaaatttatcattttaagtacagaatgcagtggcattaacattactctacaaccatcaccgctatccattttaggctttttcatcttcccaaactgaaactctgtacccatttaacaataattccatatcccaccctctcgcagcctgtggcaaccaccgttctgctttctgtgtctatgagtttcattatcttaggtgcctcatatatcaatggaagagtacaatatttgtccttcctgtgcttgcttgggcagcacatatactaaaattggaacgctacagagattagcatggcccctgcacgaggatgacatgcaaatttgtgaagcattccatttttaaaatacaaacaaacaatatttgtcttgtgtctggtttatttcacgtagcgtaatgttctcagggttcatccatcttgttgcatgcgtcagaattttattccttttttgaataatattccattgtatttatatcccacattttgttcatccatctgtgtattgatggacatttgggttgttttcatcttctgactgttgtgaataatgctgctatgaatactggtgtatagatatctgttccagtctctgcttttaattcttttgggtgcatatccaggagtggaattgctggatcatgtggtagttctgtgtttgatatttgaggaaccactgtactgttttccacagcggctgcgccatgctgcattcccaccagcaatgcccagagattctgttttctccacatctttgccagcacttgtcatttctgttggttttttggaggggggtgttgttgttattgttgtttctctaataaccatcctactgggtgtgaaatggtatctcactggggctttgatttgcattttcctaatgattagtaatattgaacatcttttcatgtacttattggccatttgtacatcttctttggagaagtgtctagtctttgcccatttttaaaccaggttgttttattttgttggtttttgagttgtaggatatgtgtttatttttaacgtgaatggtatgatactatataaaccattctgcactctgctttttttacttatcaatatatcttgactatttattaatatataaaaattggctgggcgcagtggctcaaacctgtaatcccagcactttgggaggccgaggtgggcagatcacctgaggtcaggagttcaagaccaccctggccaacatggtgaaaccccgtctctactaaaaatacaaaaattagccatgcatgatggcgggtgcctgtaatcccagctacttgggaggctgagacaggagaatcgtttgaacccgggagacggtggttgcagtgagccgagattgtgccactgcactccagcctgtgcggctgagcgagactcttatctcaaaaaaaaaaaattatccttatttcattgtatggatgaatcataatatattgaattaatctccttactaatggacgtttaagttgtttccaggcttttgctataatagctcatgctgcagagaatatcttagcatgcatatcatctcacaaaagtgagaactttttctcggtaaattattggaaatatgtcaaagggcttgacaatttttggtagatgttgctatcttgatgatagagtctctcatcttgtgtgagagtaccagtttcttcagtccttctgaaacaagctttaattatcaagcattgggattttttcccaatctaatatgtgaaaaatagaaactcagtgttaattttctttttcttttcttttctttctcttttttttttttttgagacagagtctcgctctgttgcccaggctggagtgcagtggcacgatctcagctcactgcaacctctgcctcctgggttcatgccattctcctgtctcagcctcctgagaagctgggatcacaggcttgtgtccacctggctaatttttgtatttttagtagagatgggggttcaccatattggtcaggctggtctcgaacccctgacctcaggtgatccacccaccttggcctcccaaagtgctgggattacagacgtgagccaccatgtccagcctaattttcattttctaaattagaacatctttcatatctcttaaaactgtttgtatttccttttgtttgacctgacagtttatgatttttccccatttcttcccactgaattattgatctttttctatatgaaaggtctcagccttagtcatgatgtgtctgtcatctatcttttcactctacttttactttctggcatgcagatttttttttttaatttagtcaaattacacacctttggagtatggatttaatttttggaaacaaacgaatgtcatttcgagtagttttagtagaataaatttaggttcccctaaataaagctaatttggtggggacaaaatacacccacaaggagtgcctctaaggtaaagaagataatttttccatgtagctgataaatttaatttgaaaatgactctaatcttattcacaaacaaatccagtttttttgtaatctaatggaataaaagtacaccacaagtccgtagagacagttgctggctctatcatgcattttctatgtgtcaccctctttttatttcattttccttatctataaaattgaaataaaaatgccagcaccacttaagccacaagagtataagaatatcaaataaaaaatatcaacttactttttttaacactccattctaatcaatttcagaacaggttgatactcaagaatttggtgagctaaaatgagatggggcccaatcctggaataaaagtgccaatctttcccctttcccaagccacacccatctgtcctgttcctatgcttcaatgcctttacagtgcgaccttatttttagtattccagactattctgtgtgatatggtttcactgtgtccccacccagatctcatcttgaattgtcgctgccattatccccacatgttgtgggagggacccggtaagaggtaattgaatcataggggcaggtttttcccatgctgttcttgtggtagtgaatcagatgattttataaagggcagctcccctgcagacggtctctttcctgccgccatgtaagatgtgcctctgctcctccttcgccttccaccatgattgtgaggcctccccagccatgtggaactgtgaatccatgaagcctctttttctttataaattacccagtctcgggtatttcttcatagcagtattagtggtatgagaatggactagtacactgtgtttactttatacctgccctatctataggagattttccctaatattttcttaatctttagacaaattttgcagtccagcagcaccaagtatccacttgctaatacagtgagtctcttttttcattgcttccatcttcaactcagtataagtctctgaggctcttggtatccaatatttatttcttttactgatagggagacttcagcttcgttagcaattggcaggaaccttgagtgtactaggtcctgtctaaaattctgtaagaaatagtaacaataacttatttgtaatggattagaaataacttttcctaggagcactggaggtaccataaatattacttttacttcttcacatatagtgctgttttgaagagatattaaaataacatttcgcaattcatgtttatcaggtagtagaaagtgtgagcaatgtggagagattgcatggacagttcccccaagacagttattatctgagaaagctggaagctactcagagagctttataaaaactgttatcgatactgggtctgcatttgtgcaatggaaaaacatggaagaggaatgggaattgctgggtccacacacccctcaataagaaatgaattgtaaaaacaggtttattcatgcagtgattgttcacatgtatgaatgaagtgaatgatgaactaagactacatgtgtaacttggataaatctcaaaaaacaacgttgaatttaaaaaattacaaaaggacggaaacatagtaccatatatatacactttaaatacacaaaataatagtaaatattgtttatgaatacaaatatatgcatggaaatgataaggattatcctcagaatagtggtgtgattgcatctgaagatgaaaggagaagggatgaggagtggaatgttagctgtttctgcaatgctttcttgtcaggaaaaaaattctgaagaaaatgtggcaagatgttaacatctgttaaatcttggtattggctgtcgtattttctcctgtacttttctctgaaatactgtacaactacacataaaaataaatatttttaaaagagtgatttatatcttatctctttaccatctcactttgtagttgctttgttaaaaattggtttcttatcatggtccttttgatgaactgggattaaagaaaagagtcaaagagaattttttaaagtcattccaaattctacttcctgaaataataatttttaatgttagactactattattctagagctctttctatccctgtgtaataaaataagtggatagaagggtgggaaattaatgagaaaggaagaaggaggaaaggaaaggaaggaaaaagatattgaagaaaaaatctaggatataatcttcatgtgggaaggacttactttaattttacttgactgggacaaaagaaaaaaaattaagttgaagaaattgtggaatctcaaatgtttgttagccataagagacgatatttattttaagttcagaaaagattttgagaaaaacattaagagactgtagtccttgtgtgtttttttaaactatctatttcgaatataaaaagtgtcagttgattccttgctgtgaaagataaggacattagcacttccaaaattctgtctacgttttctctcccaacccccaatttatcttaggtatatttttatttttacactgacaaggtagaatgttcatactttgtttagtattcacacatattttagtagttttgtatatttgaatgaaattaccactaaccacattttctcatttttttctccatccttgaattctttgatttatttttgtgtgttgattctcttgtcagtttttttttttttttcaggaagtgctcatggatgtttttgagactgggtctccgtctgtcacccaggcaggaatgcagtggtgccatcacggctaactgcagcctcgacctcctgggctcacacgatcctcctgcctcagcctcctgagtagctgggaccacaggtacacgctaccacacccagctaaattttagtttttgtagagacagggtctccctatgttgcccaggctgggcttgaacttccgggctcaagcaatctgcctgctcagcctcccaaagtgttgggattagaggcgtcagccaccatgctgagcctcttttatcttttacatgttttttttgtgcttgaatactttttacttgaatgacatcttataaatttacacaatcatttctcatggctaagaagtgttccaatgtgtaactatactagaatttaacatatttcctaattttagaaatgtaggttgtttgtaatatgatgctgctgtaattgtgactgggctagaattattagtgtggaacttttcaaagatcttatttctctcctgcactgccaaaaaataaaccctggatgcccaatttattttatctttaccttttcttaaagaggaatattttttttcttgttgggagaagagatatgtcaatcattatagttacgttctgagagtgggatggtgtgcaggataaagaagaaacccactctgaccgagactggaagaggagtttgttaaagatgtgggggaagtaagatttgagagagaggagtggaacttgagcagttacagaatatgaaggagcaatcaggaaaggggattacagcttaaaagtttttgaatagataatatgttcacatgtttaaatccaaagagaataaaattcaaagaaaagtccctgtaactcttttccaccagtcacccagttccctctaaaatattggcaaccagaatactagtttctagggatcactccagattctagccatacacaaggaaatgcaggtatattattttcttataccctgtttttactgaaatggttacttactttcatactatggtatgattcccatggagtggggtcatatctgtgatgaagcttgcttttatggcttttctgtagcgttcggggatctggaatggaggtagctctccagttcaagcttaggctaagtggcataaatgccataagggttaatgtattggaggacatcacaaagggcatggggtcggtcctagatatcccagtaggctatgttccaggctttacagatgggagttaataggaatggcattgtgacaagaaaaataacatttggattcaggcttccctcttcagggcccattactggctgttttaataaagaaggccatttctgtatctttggaggccaactttggttgactgtggattacaggtatctgtctgtttttgtttttgagatggagcctcactctgtcacccaggctggagtgcagtggcctgatctcagctcactgcaacctccacctccccggttcaagcaattctcttgcctcagcctcccaagtagctgggattacaggcacccgccaccatgctcagctaatttttgtgtttttagtagagaaggggtttcactatgttggccaggctggtctggaactcctgacctcaggtcatctgcccatctcagccctcccaaagtgttgggattacaggtgtgagccactgtgcccagccctgtttttttttttggaaaaggaatctcgctctgtcacccggactggagtgcaatgatgtgacctcagctcactgcaaccttcatctcctgggttcaagtgattctcctgcctcagcctcccaagtagctggcattacaggcaggagccaccacgcctggccaatttttgtatttttagtagagatggggtttcaccatgttggccaggctggtctcgaactcctggcctcaagtgatccgcctgcctcagcctcccaaaatgctgggatcacaagcatgagccactgtgcccagcctattgttcttattggactgtcttgatcaagtgcaaattttgctgtatgatttcaaaagtggggagccagaggctgtctgaggattggtggtttcagagagtgtacttcctgaggcctctgggtgtgtaccctctgtggcttccagattcattcgtcctgcagcctcaacctattctccttaacagaggaaatctaatattagattcactcgaaaagtgtggaagacttaatgcaaatgcaccacaaagaacagctcatggtagtttctttattagctttgaaatatagaatggacacaagccagaaagtgttactgtgtattcctgtggccccacacttgtttggaaacggggctcctttttatcattctgttggtcatgctctgtcaggttggatgggaccaaatattctttaagttttctcagttcgagcaagtttcttgtaaggacgtatttggaaataagtataagtgatagaaggtgttataagtaatccagagaggatttaaagtatatggaaggatgtgcttaggttatatgcaaatactatgccatttaatacaaggaattcatttgtataaggaatagcaaaaagtcccctcagcagcattccagcctctcagtgtactggaaggacatttattgccattagggtaacacaggggctctcgtatttcaagtcactctggtgactccacatcacctggtaatctaacatgctggtgattctactcacctgcttttatttcttcttttccagattcttcctattttgctcccgactgatttgatcctgctgtgtgtctcctactcctttgcgtctacctcctcatgggttcagatgctttgtgattctgcacctgccttctctctctgtgccgttcctcttccatctctcttccatctgtatgtcttgctttaaaactcccaaggaaaaaagaagaaaagtcggctttggtcatttgtcaatattcagtagtgtgtgcctttgttgagcagagctcaactgcatcagcccctctcttgcacacctatagagggacgccttattttggttaagtagccatctctggttcaagtatctgtgcctagggaggcaggtccaatggtacaaagcatagcaacctatacattcagaaactctggggagggaagtgtggatttggcagagaccttactgctcatctgatatagttaccccaaatcctaatgaggttgtttgagcctagtgttaggccattccaacacagtttctaggccaacagttggaactctgtggtaaactcaccggtttattaccatccccctccctggtagtgctagtgattcatgtcatggtggtcggctgtggtggagattgcatagtctaattctgtttcctctcctcctgagcacatagctatactgtaattcccagattctcttgcagatagaggggagctgggaattatggtctagctagaccatgtgacctagtttttaccaatgaaatgtggatggaggtaatgggtgctacttctaggcccggtccatggaaacctcccacgtgggaggtgcttttccctttacagcttgatatatacagtatagtgacattggaagccatatgttgaaaattatggaaccacaagatggaaggagctgggtccctgaatgagttgtcggaggaaagccatccaccgatcaggaaaatccattttggattttatgtgagccgtctccatgactattgtgttaagccactggaggctggagtttgttacagcagtggctgttatcctcacatagtggcattattgattttgctccacagggacccaaggaaggctttgggctccttaggtatcttggtgagcactgtcccaggcggaagttggttaacaggatggcccccttcagggagggctgatggggtatgggagagcgaccatcgctttgctactcctgataagcatgacataaagaatgtctctctttaagccttcctccccgaatcccaagctgtggatatcaatacatttgtatagattcatgcgagagttccagagtattctgaaactgcctctgaatttatttgcagaaaggtaggggttagtaactagtgataccactttatgcacagagcaagtaaactccatctttaccatggccaactgtagcaatagagttcagtgttttctatatcacagatagaagaagtaacaaaacttcatccatttcatcttcatatatagtaaggcgaggtgtctgagaggcaggggtgagaaagacaagactggcatgcatggtattgaaatggctgtgaaagggagaagatttgcttatagtagcagggcccaggtagcatgggaattcattacttttatctttaaaggggttagaaacaagtgttcagaggtgccatgcagtaatgaaaccagtccaggagccaggctgtaagtgctgtaattcaagtaagcttttggttaatttaaagggatggtagttacaccagctcctaacccatcgccatcttctgtttcatgtttttgattactgagaagtgacactcaaatgtttattttttcttaaaactactgagtacattttgtaacagctccagtttctactgagagctcatttatgccatatttcctttgctcacataactctaagagtacttctgttttttactgaaagcttgtatttctgtctctgctaagttataaacttactgatgacaaaatgtatttattatttgagttctgtaacgcatacaacattgccttttctctatatacagtgtgataatattagctgggggtatgtaactagttgtgtggtgttattaggaaatgaatctgtaaaggtgggctggggccattcagtgaatgatcttgtctgttgctctaggatcctggatttcattgtgtaagcaatacaaatccataaatgctgagaagggataagatgagatttgggcttttagaaagaaaaccctagccaggtgtggtggtgcacgcctgctgtcccagctacccaggaggctgagacggaagattgcttgagcttgggagttcgagaccagcctgagcaacatttcaggattaaaaaaaaaaaaacaaaaacccaaaaaagaaagcaaactctagctttaggatggtagatccattggcgtgcggaccagagcagtagttcttaatcctgggtgagcttcagagcggcctcacagcacggctagtccggtactgcatgcgaaggagcagcacagagctggcacacggcgggctctccaacccaactggacctggtgacctttatgaacccgcagcccaaagccaggcagaatcaaggaggtctccacaggtgccggtgtgggtagcttatgggccttagccacaccctggcaagtaactatcccttttcataacaaagctttcctgggcacttaccctgccaactgtattctgccgagttctcctctcccggaggcagtgagcatggaatgcccttgtctacgttgggaaaaggatataaaggattatggatgaaataccttctcccacaaacgccttctatataaaacaaaactaaaaaatttccacccactaaaacccctggctaaggccctatgattatctttctctttacagctaagaatcttaaaaaagagtttgctctttattgagcactctgttccttcttcaacgtgcaatttgtaatttcacttctatctctccgtcccatcctgttcaaactgtttttcctgaggttgttgtctcttactttatttttcatatgattgtcttttgttttcttttcttttctctcttcctttcctttcctttctttctttcttttttcttttttttgacagagtctcacttgcccaggctggagtgcagtggcgcaatctcggctcactgtagcctctgcttcctgggttcaagtgattctcctgcctcagcctcccaagtagctggaattacaggcgtgcaccaccatgcccggctaattttttatttttagtagagatggggtttcaccatgttggccaggccggtcttgaattcctgacctcaaatgacccacctgcctcagcctcccaaagtgctgggattacaggcatgagccaccacagccggcatcttttgttttcatccaacacctctgactcttttttctcagcctctgctttgggacgattatctttctatctggactattaatgtctgctagagtttcatctccatccttcttttcatttacaccctttctgggaaatctcttccatacctaaatctgtatcttaacctggaaaacatttttaaagtctatataaaaaaagcccttcttagttcaaaggtaaaattttaggaaaattaaattgaaaacttataagaaaataacaataatggaaactagatttgaaaacagaaatgacaggatgggcgcagtggctcatgcctgtaatcccagcattttgggaggccaaggcaggcgaatcttttgaggtcaggagttcaagaccagcctggccaacatggcgaaaccctgtctctaataaaaataccaaaattagccaggcatggtggcatgcacctgtaatcccatctacttgggaggctgaggcaggagaattgcttgaacctaggaggcagaggttgcagtgagccatcattgtgccattccactccagcctgggtaacagaatgagactccatctcaaaaaaaaaaaaaaaaaaaaaaaaaaagaaaagaaaatggaaatgatgttagaatctatgagatacaaccaaattaagactcattaaatgcctatataaagaaaaatgaaagcatgaagaaaatgaacagaacatccaactcaaaaaagctagggaaaataggtaaactgaaagaaagcagaaaggagaaattaatgaagataaaaacagaattaatggggttgggaaacagtgtaacagtaggaaccaataaatgaaagttttttttttttttttgcaaaagtttaatagaaagataaatcactagcagtgtcttatttgggaaaggacaaatgcaagataacttgggagacagaatgattaaaacataggaaaatttcaaatctaatgagagtcatttgtacaactctatacaagtgaatttgaacacctagctaaaatggtcaactttctagtaaaatacaatttgccagaaccagtcctagtcatatgtatatagattggaagagttaatattgttatgattgcaatactccccaaattgattaacagattcattgcaatctctatcaaaatcctggttgcctttttttttttttaaacaaattgacagttaattctaaaattcatatagaaatgtaagggacctagaatagccaaaacaatcttgaaaaaggataacaaagttggactcccatttcccgatctcaaaatttactgaaaagctacagtaattaagactgtgatactggcatgatgatgtaaggctagacacatgcatcagtggaatagaattgagtctggaaataaacccttacacttatggtcaattgatcttcaataaaggcggcaagacaattcgatagaaaaaagaatagtctttacaacacatgatgctaggatgactgaatatccacatgcaaatgaatgaagttggaccctaccacacaccatatatgaaaattaactcaaaatggataaaagggctgggcacagtggctcacgcctgtaattccagcactttgggaggccaaggcaggcagatcacctgaggtcaggagttcaagaccagcctggccaacgtggtgaaaccccatttctactaaacatacaaaaattagctgggcacggtggtacacacctgtaatcccagctacttgggaggctgaggcaggagaatcgctggaacctggaaggcgggggttgcagtgagccgagatcacaccactgcactccagtctgggcaacagagcgagactctgtctcaaaaaaaaaaaaaaagaagaagaagaagaagataaaagatctcaataaagagctaaaatcgtaagacccttagaagaaaacattgatgtgaatgtttgtgactttggattaggcagtggtttcttagctatgatacctaaaacaagcaacccaagacaaaaatagataaattgaatttcaccaaaattaaaaactttgtgcttcaaaggacactgtcaggaagataaagagacaagccacagagtgggagaaaatatttgcaaatcatatatctgataaggggtctagtacctgtaatatataaaaaactgacaacaataaaaagacaacccaattaaaatgtggacaaagtatttgaatagacatttctccaaggaagattatttaatggccaaaacatcacatgaaaatatgctaagcatcattagtcatcagggaaatgcaaatcaaaaccatagtgaaatactactttagatccactaggatggctgtaattttaaaaatgaaagatagcaaatgttggtggaaatataaaatggtgcagccactttagaaaacagtttagtagttcttgggaaagttaaatgtagagttaccatatgacccagcaaattcattcctaggcgtatactgacgagaaatgaaaaaatatgtccatacaaaaacctgtggatgaatgatcatagtagcattatttatactagccaaaaaatagaaacaactcatgtcaatcaggtgatgaatggataaatgaaacgtgatgtatttataaaatagaatattgttcagctataaaaggaatgaagtactgatgtgtgttacaacgcggatgaacctaggaaacattctgctaagtgaaagaagctggacacagaaggccacatgtgtatgacatttatatgaaatgtctagagcaggcaaatctgtagacacacagatcagtggttgtgaggaggtaaggggagggagggatggacgtagctgctaacaggtatggggattctttatggggtgattaaaatgttctgggattagatggtggtgatggtagctcaaccttgtgaatatactaaagccactggattacacacttaaaaaatcaattgatgaaaaagcaaaacaaactgatctcacaaagatagaaactctaaacacaccaatttacatagaatcattaggcaagttttcagagttctctcaccaaaaggcttcaatccagatagtttcacaggataattctatcaaagaagaacattttagctctagtgctacttcatctctttcagagaatacaaagtaagtataatgttgacaccaaaaacttaaaaaagactgcattaaaaaatcttacaaaacaatcttatgaatatctgtacaaaaattgtagataaaatgttagcaacaaaattcagtggcacacataagcaaatggagtttattccagaaatgtaaaaatagttctgtgttgggaagtttattaatgtaattcatcatataaacagatctgtgaagaaaaatcataggatcatctctatagaggcatttgacagaattcacacattcataattttgaagactcgataaagtagaaattaaggacatgatttcttagcataaaatatgtgtgtttcagcccaaaatctagtttcttacttaataaagaaggcacaaacagcattttcattaatgtcaggaataagataaagatatccgcatttgctgttattatttagtattgactagaggtattaagcaatataattatataggtgataacagacacgtaagtatttgacgttaaatggtagaaggtagaaaagatagaagaaagaactatctttattcacagatatatgattaaatatctggaaacctcaagaaaataaatggaaaaactacaaagaaaaataatatttgctaaagtatagtagggaataaaattaatacatagaaatcaagagcgttcacctatacaaacaatgcccagttggatgatataatggaaaataagactcatttacaatagcaacaaaaaagctaaaatttatagacaaaaatataacaaaaaccatataaatgctacataattcagataacttgaaatatataaaaatagatgaacaaatagacataccatgttgttggataagaggacttgaaattataaagatgccaaataattctaaattaacttattaagttaacacagtctcaattaaaatatcaccagatcttttctggacctagataagtgaattttaattttcatatgagaaataagttagcaagaataggcaagaaaactctgataaagagtaaggtggcccagcgtggtggctcacacctgtaatcccagcactttgggaggccgaggcaagcagatcacgaggtcaggagatcgagaccaccctggctaacatggtgaaaccttgtctctacgaaaaatacaaaaaattagctgggcatggtggcaggcgcctgtagtcccagctactcaggaggctgaggcaggagaaaggcatgaacctgggaggcggagcttgcagtgagctgagaccgtgccactgcactccagcctgggtgacagagtgagactccgtctcaaaaaaaaaagtagggtggtgagtttagctttgtttgatattaaaacatactacaaatcctctattgttaaaacagtatggcataatggatcaatgaaatagaaaatccagaaattgttccaagtgcatatggaaagttaatataggatataaatagcatctctgatgtgtgaggaaaacatagatttaactggatagctatttagaaaaatataaaattgggtctgtacttcatgctgtatagtaagataaagtttgtgtgcaacaagtatctaggtttaaaacaaaaccttgttaagtatttaaaaatatgaatgaattccattataaacttggagtaggaaaaataactcaaaacaaaagccagaagtagaaagattttaaaatttaataaaattttacataataaaatttcaagccaaaaaagaattataaaatcaagagataaataacaccttgagaaaaatcttacattgtaaatggctaatatccctgatattgtgtaaaagtggtaactcttttaaaaatatttgattaaccagaaatttccatttcttgaccacagagaaaaaaggaatctagtatgccattattttgaaatttaatcttttcagtgcacccccttatttactgcattattcacaatagccaatatagggaattaacctaagtgtccaaacgaatgaatggataaggaaaatgtgatatgtttacacagtgaaatactatccagtattttaaaaaacattttattttgaaataattttagagttatataaatgcaaaaacatagtacccaggatgggcaacataatgaaaccttgtctctacaaaaaaaaaaaaaaaaaaaaaaaaaaaaaaaaagccaagtgtggtggcacagtgcttccagctgctcaggaggttgaggtggttggattgcttgaacccaggagctcgaggctgcagtgagctatgatggcatcactgcacttcagagtgcaacagagtgagacgctgcctcttaaaaaaaaaaaaaaagagtttgtgtatccttcaccccattcacatcttacataactacactacaatgatcaaaaccaataaattaacgttggttcagtaccatcaactgaactagagatgtactggagtttcaccaatttcccacgaattccctcctctctcccaggatccgtgcagaacgctgtcctgcgctgttgtcttgtctctttagccctccagtctgtgacagttcctctttcatcaccttgatacttttgaaaaatcctgctgaattcttttttagaatgtccctcagtttgggtttgccagatattttcctgtgattagattgagccagtatatttttggcgagaatactacacacaagtgagtttgtgcccttctcagagcatcatgtcagggaatacatgatgttgctctgctttagtactgatgatgttaaccttaattgcttgcttaagatagtgtctgccaggtttccccacagcaaagttatgaattttccttttgtatttggtaaataccttggaggagatactttaagactgtgcaaatattgattcccctcaaactctggcccacaagtagcatccgttggtcaatcttgcctgtgaatgttattactgtggtttttgccaagcggcgttttggtgttatttttaaaaaggaaattccaggacagtgggcttgttctcattttgttgggcagtcggcagccattgggcaatgtggaatttagaattacttaggcctttcccaacacagaaaaatgccatagtctattaattcagtaaacatttatggaacccttgttatgaccaaggcctcttggtgaaatatgcagacagcataggatctggtctgcacctgagtctttttctctgccactacttttcaccttgaatcacactcgccatcaagatttgttctaagatgttattgcaaaaagtgctgagagacaagtccaggagtcagaggataggaccaatttccaattttgccccagactagctacgttactagcagggcgagtcagatatcgtctcaaagttctagtctccttatttttaaaatagggaatataatatagattgacattagaattaaatgagtggatatatatgaaagtactgtttaagtgaaaggcatttttcaagctataaagtgttctacaaattaattattgtctgggcacggtggctcatgcctgtaatcccagcactttgggaggttgaggcgggaggatcgattgagcccatgagttcaggaccagcctggccaacatagtgaggccctgtctataaaaaacaaacacacaaacatgaattactcaacaaatatttgatttcttattaagtgtgagctttttctaggtgttagaatatagcaatgaaagccaaagcctctgccctccaggaacttatattttagaggaaaaaggtggataatagaaaagtaaacaagtaataaatacaatttcaaatagtaataaatgctacactgtaaataaaacaggatgatgtaacaaaatgtgctataaagaaaataaagtaggataatacattagagaattggggtgtgtttaggtgggatggaatagtttagacgttctggtcagggagtgcgtctctggaagtaattttcgagataagaactttaagattaggagtcagctgtgtgaagcaggggagagcaaatataaaggccctttgaaggggaaaggattaggatgctggagaaaagcaaagaggatagtgtacctgtgaggtcgctagagagtggtgtaagatcaagccaaaaacgttggcagggccaaatgacgtagagcattacatgctgtgaaaaagaagtttctcggtgcagttgatcaggaagaagttgaccagaaagccattgaagggttttaagcagggcattacatgttatgattttcattttaaaaagattgttctggctgctgtgagaatggattgagatggccatcaagagcagaagcagaatgacagcctgtggtctattgcagtggtgcaggcaagagggaatggtggccaggcaagcttggtggtggcagtaagttgtaagatgtcattattgttattgttatgggctgaattacgtcccctccaaattcgtgttttaaagtcttaacctccagtatacctcagaatgaaaccttagttggagataaggtctttaaagaggtgattaagttaaaaagcccaaacaaaagggaggtgattaagttaaaatgaggccattggggtgggccctaatccaatctgacttgtgtcctcctaagaagaggaagtttggacacccagagagacagtgggatgctcgcgcacagaggggtgaccaggtgagggcacagggagaaaaagtggcgcctacaaattgaggaaggccccagaagcagccgacctgctgacacctttatctgggacctctggcctccggaaccgagaaaatcaatttctgtggtttaagtcacacagtctatggtaatttgttatggcagccctagcaaactgatagagctatgacaatcatgggtatggtgctgatctcttcattgtatttatcactacctaaaattcgcttagatttatttatgtttactctttcactcccttgattgtaagttccattacagcagggattttgtctaattcatagtaatcgcaatgctgcggagtgcctgcgccatggcacatgaaaagtgaccgtgtggttaaattgtttctcagtcactctgtaatatccagtattttgtagagcttttgtttttaatgatatacaggagatccagagttttttagggggctacaaactctagcacataggactatataagaaataacactgcagcaagttagaaccaggtgttcaggaagcatatcttagcagtggagacacgatctcttgattagagggaccttggataaaagaggccttttttgaacagaatagctctgctgaagaaagagatttcgtcattattttaccttcatttcatggcttttccaaaataaggtacatgtgtgaaaaatgccctccgtaagggcgaggtctttattttgttctctgctgttctgtaaacgataccagcacatcatagggttcaaatatttgttaaatgaatgaaaacattttcagatcctgctttgtccttagacatttttggattgctttaaatgttctcttatccttagcataatattagctatttaatagagcaggtaaaatgttttgcctatttttttttgtctcttataattgtgtgaaatattctgaatctggtcttcactttggtgtttttgaccttaggctgcccttaaactgaagtcacagcctagctcaatggcactggctcccccttgtgtcaggaacttgatactacacccactaaatgccagcctgccaagaaccaagcttccccgggtcaaacattttaagtggtccaaatgctatacataattaaatgatgacaccacgattgggccaccttattggggctcatttgctccaaatagtcttactcctatgcccactactatatatatagcacaggtacagaaaaacatttttaatacttgtaaccataaaggcttttggagttagtttgtacttcttatcaatataagacatctacgttgacaaaagaaatcgaatgttgactgagtgcggtggctcacgcctgcaataccagcactttgggagacctaggcgggcggatcacttgaagtcaggagtttgagatcagcctggccagcatggtgaaactctgtctctactaaaaacacaaaaaattagctgggcatggtggtgggcacctgtaatcccagctacttgggaggctgaggcaggagaattgcttgaacctgggaagcggaggttgcagtgagccgagattatgccactgcactccagcctgggcgacagagcgagactctgtctcaaaggaaaaaaaaaaagaaagaaagaaaaagaaatcaaatgtctcagcatattttaaatactttatatggaacagttgattttcactttctttcaaaagcctaccaaaattgaggagttagcgtttttttaatcccatgaaatcgatttaaaaggaagaaaattatttttcaaagggacaacattttattttcaagagtagtatttgatttctgttttgtgtacatggtagaatactgagtgagttgctcctggccactctcgctgttgaggagatgaacccgtgcagggacggccccaggaaggcctctttagctgtctgaatgaagtgattttgactctcagcgtcagtggtgtgctggagccagaccgtgccgacttatcccagctcacaagagctaatggctaaatttcaggagttctgcaaactattgttaaagctagtttatattagaaataaattatatagacaattcagttatattaaaaaacaagggtgctttcttcagcagcacttatctaagatcagaacaacatcgagaagatgagcgtggcacctacacaggctggcacacacatttgtgaagcgttccatattttttcaggttattctgtattaaatgcaaaataaatgcttttattaacaatgacaaaaagaaaggtaattgtaataaatacaatttaccacttcgtaattactttattatattttactcatactttgaggttatttgtgtctagtgtatgtgtggtggatgtaccatataatggtatgctattgtcatttcttccagactccacctttagtgatttcatgtttgtaattggcagcttgaaatcgatcttggaacaatggaaataaaaccacaatggaaataaaaaaggatccaaatcaggactttttgcctatgaggagccagtgataaccagcccattactatatgcaaaacgagtttatatgttttttctctactccaaaaacttaacaaaagaaggaattattaaactttaaaaaacgattttaattttattttactacattggtttcagttttttattttattttatcatttatttatttatttttgagacggagtctcactctgtcgcccaggctggatttatttatttatttatttatttatttatttatttactttttttgagacggagtctcgttctgttgcccaggctggagtgcagtggcaccatctcggctctacctcccgggttcaagggattctcctgcctcagcctccttagtaggtgggattacaggcgcctgccaccacgcctggctatttgtgtgtgtgtgtttgtgtatttttagtagagatggcatttcaccatgttggtcaggctggtcttgaactcctgacctcaagtgatccacctacctcggtaccccctcccccgacccagccccaacaaagtgctgggattacaggtgtgagccaccatggctggcttggtttcagttttttaaatagttttttgaaaagataacttcaataatttaaattctttaataattttaataatgttaaaaatggttttaaaaggttgctttaatttaattgaatttatttatgttgagacagagtcttgttctgtcacccaggctgccgtgtgatggcagcatcacagagctcactgcagcttcaacctcacctgctcaagtcatcctcccatctcagcctccagggtagctggaactacagccacacaccaccatgcctggctaattttacatttttttgtagaaacaggttcttactgtattgctcagggtggtcttgaactcctggacacaggtggtcctcccgcctcagccttccacagtgctgggatcacaggtgtgagccaccttgccttgtcactggtcgagggttgtgactgcaagttgtccaggttcttggcattttgaacaaagaattggacaaaatgcccagcaaagcaaagcaaagtatgaagcaacaaaagaacaaaagcagggattcattgaaaatgaaagtacactccacagtgtgggagtgggccagagcagcagctccagggtccagatgcagaatcttcttgggtccaaatacccgctagcagttttccattggccacttcacgtccatctcatgtaaatgaagtgctagcccacagtcagtctgaatggttgcagaaagcagccaaccagaggctgaagtgaagttacaaaggtcacacccctgtgcaaacaggagttggttttcgcagccaatcagaggctagggtgaagttacaaagttatacctctgtgcaaacagacttggcaggccattagtctgactggttgtggacagcagccatcggtctgactggttgtggacagcaaccattcagaggccggagtgaacaaagatgcaaacgaagactcaacccgcagtcagtctggtttgttgcagacagccaatttcccatctgcctaccagaaaaggtagtgagtttgcaaagggagtagcctctggtccttttgttacttaggctggaaagttagggttttcctttcaatttagttctaggaagtcagtgtgaaatagccttaggatccctgcctccagaccctattgccctgcctcagcctggcctaaaagctttacttgaatcttcaatcaattcacttaattcaaagtttcatttagtagaaataggttaaccaaccttaatattatatatgattttatcaattatgttatatttttgtttcattttctagttcctgtctaatgtcttgttttcttatttctaaacttctttcttttattttcatcattaagctatgaatttttttcctatctcctgtaactttcttttcacttatttcagtgtttttacatttttctcttcagctgtctccctttgcagacagacctcgatctctttctcagaattaatggcctcatattttcctgacctgtgctccttctcgctgtctcttttattcttagctcacctttaggatcctcactactcctgaggctgaactgttagcaatacggtttcctccactgtggccaggatcccagctccatccggataccatctggacatgtgcagggctcacctggccccttctgctgttttcccatgtctttggcaccagaaatacgatgcgaggatagtgcataggatcattcggtcatttttgcctctagccccgtatttcagaacatgggaggacaagagaagctctgagtcgtttttgcttctgctgtaatttgtttttattctcatctcaaggaatttggaagtccttttgaaataaatgcatctcatttcattatcatttgaggaaagagacatttgagaggaaagggcgattaatatttaaacaccacctcccttcccctacctcatttgcccttgtatttttttcttctcactcgctctcttatattgcctttactgggcaactatgtcaacaaattgccactgaaaggcacctgactggtgagctgccttgagctgaggtcagtgtgatccttcagctgggagccgctgctccgttttagagggcgagccattgctaccgctgatgagctgagcctggggctcaacgagtccatctgaaaagccatctctcttccagcagcagggagccactcgcagtgctgctttcatcagccttcgtgaaggatgaaaagggcttcgtcttttccacacacacttgactccagcagcgtgggggtttggagcactgatctcccctaccgttgaaaacccacgtgtaacttttgactctcccaaaacacaactaacagcctgctgtggactgaaaaccttactgataacataaatgtcaattaacacatattttatatgttatatggattatctactgtattcttacactaaagtaaactaatgttactttaataagagagaacattaggccaggcgcagtggctcacgcctgtaatcctagcactttgggaggctaaggcaggtggatcacttgaggccaagagttcaagaccagcctggccaacatggtaaaaccccatctccactaaaaatacaaaacttagccaggcgtggtggcgggcgcctgtaattccagctacttaggaggctgaggcaggagaatcgcttgaacctgggaggtggaggttgtagagagctgagatggtgccacggcactccagcctggtcgagagagctagactccatctccaaaaaaaaaaaaaaacgaaaaagaaaatgttattaagaaaatcataaggggctggtgcagtggctcatgcctgcaatcccagcactggcactttggaaggccaaagcaggtggatcacttgaggtcaggagtttgagactagcttggccaacatggtgaaacctcgtctctactaaaaataaaaaaataaacttagtggaacatggtgacacgtacctgtaatctcttatttgagaggctgcggcaggggaatcgcttgaaccccagaggcggaggttgcagtgagctgagatggtgccactgcactccagcctgggtgagagagctggactctgtctcaaaaaaaaaaaaaaaaaaaggaagagaaaatatatttactcctccttaagaggaggtggatcatcataaaggtcttgattatcatcttcacatggaggaggctgaggaggaggaggaggaggaagaggggttggtcttgtttcgagtggcagaggcaggagaaaatccacatctaagtgggcttgtgttgttcacaccatgttgttgaagggtccactgtgcctttcttttacctgcaaggaatggtaggctgatacacagcctcatctcaacttttacttcaggaaacaatattttaggtctatccagggtctccaagtttctgaagtactgagtgaaaatgttgtaactaatatattttgttatgaaactgaggattaagacatccttcataaccagcttctgaagccaaagtgatacagatagtataacaccagagtaaattgttgtataagtagtttatgtatatgaggcagggtttctgttatcctttgttattactgtggttttgatggatgagagtgaaatgtgcttatcttgttttttttttaaataaaatctttttatttaaaaaatttcaaacttctaaacggtaagagtgttgccctgaactcctgcacacttttacttagattcgccaatccctcatgatctgccacatttgtttttgcctcctctttctccttctccctctctcccccgtttctctctatatatgcacaaacacacatacctatttatacattttattattattgttattttcatcatcaccattttgctagactatttgagagtaaactgtaaacattgtaacctttccctgaaatgcttcactgtggatcttctttctttctttctttctttttggagaaaggtgtcttgctatattgtccaggtgggaaatggacatgaactcctgggctcaagtggtcctcccaccccagtttcccaagtagctgggactataggtgtgcaccgctggggtcttcctttctttctttttcttttctttttttttttttttttgagacagagtcccactccatcacccagatgggagtgcagtagctcgatctcgactcacgcaacctccacctcccaggttcaagtgattctcatgcctcagcctctcgagtagctggacttacaggtgtgtaccactacagctggctaatttttgtatttctagtagagacaaagttttgccatgtgggccaggctggtctccaactcctggcctcaagtgatccacccacctcggcctcccagagtgctgggattacaggcatgagccaccgtgcccagcctcagtgtaggtcttctaagacaagaacattctcttacataagccacagtgtctgtgtgtgctcttaaaaataaccttagagtcagatcacttgggttaaggtgtcatttggctcattcctctgcttcttgcaggtgcatttctaaacagtacaaaactgatattttctgggagtgatagaccgaaattcttatgggggccagcctgtgatataaaagtgagaatctgacagagttcatactgtactcatgacatgtatgtatgccccacctaaacaaataaacacgccaatcctagactaaaaaaaaactgtaataagaaaaaatcatcaacaacaacaacaacaaaaatacccgatggccaaatttgtcacttgggtcaacaatttgcggccctggatctacggtcaaagctcccgtggggtggaatatccacagctttctttggaagcactgtggtatagttcagaagttctcctttaagtccaagtgcttgactgagatttgtgagaggcagcagtcgcagtggcaggtagcatgagagctaggctgtgtgtgtgaatcccgtttccaccatttgctaccggtgtgatcttgggaaaatgtcttaacctttctgtggttcacttttcctcatctgtaaaatagtacctttcacacaaagctgtcatgaggaagaagtgaggaagaatatttaaagcaccttacaccagagtctggcacgcgtaataagtcactgtagaactggattctgcgaagacgaacctgatggctagaggccatcacatccatgcagatcatgatcctggtataaggggagagggatgtgaggactgttcctcctggaagacctagagaagatgttcattcttgagccagaaagctacttaatctacttttctcccattgggagtgactttcttttgttcttatccccgttgtcttttttttcttttttcttttccctttttttattagacggattttcgctcttgttagtagagatggggtttcaccatgctggccaggctggtctcgaactcctgacctcaggtgatctgcccaccttggcttcccaaactcctgggataacaggcgtgacccaccgcgcccagccctcatccccgttttctactcatccttcttgtcagacttctccccagctctctcctatatttccctagtgctgagggggtcactgcttgaatattaactctacgtgatccctgacaagttatttaatgtctttgagctttagttttctatctgtaaagtggggacaataatagtacctacctcctagttgttgtgagggttcagtgagttaatgtagggattactgtgtcaggacagtccctggcacacagtaagtgctgtggaactctcagctattgggtaggatgtgcatcattctctttaatagccatattcctccacggtgtactctatacttgtgatctcaattttctttttgctggctcttttttggagttttttcttcctctttttctcctctgcaagtgctcttattgaggtcagtcctcttctttttgtccagatctaagattctgcttattctcttagccttctgaaatattttatttttttactttgagacagggtttcactctgttgcctaggctggagtgcagtgccacgatctcggttcactgcagcctcaacctcctgggctcaagcaatcctcccccaagtagctgggactacaggcatgcgccaccataccccaataatttttaaaaaatttttggtagagatggggacttgccatgttgtccaggccaccttctgtaatactttaaactgtagcaacctggccaggctcatgcctgtaatcccactactttgggaggctgaggtaggaggattgcttgatcccaggagttcaagaccagcctgggcaacatagcaagactctgtctctattaagaaaaaaaaaaaatcagctgggcatgatggtgtgtacttgtagtctcagttgctcggaaggctgaagcaggagaatcgcttgagcccaggagtttgagtatgtagtgagtgtgatcgtgccacttctccagcctgggtaacagagcagaccccatctcctcaatcccccccacccaaaaggaagacaaaaccatcgatattattttgcagccagaagcttgggggtaggggacagtaaggaggttattggagaaagggaagtggagatgaggagggaagggagggagtgggagggagacactggctgattggctgagcagtggagagctaccgatggcaggattctgcagcgcggtgaggcatggggtggatgttgcgaaatgaagctggcggttacaagataagccatttagaagaagtgttgtgattagtgaaaggaagccgggaaatagaatagagtggcgaagcacctatcaagttttttcaagataaggaagatacctgaatattttaaggcaaaagaggaaacagctaataaagaaaataatgaagatgctgagagggagaggtaattgtgtgaagaacaagagctgagtgtggaaacgaaaaactaagagggagatttgcttctttgaggaggagcactttttatttctccaaggctacgagcacgaggcaagagctataggacattcctctaaagtggtacaaagtcagcgactgtaaaggtgacgtgaggattaataatagcacccagtgatcgtgcagttcacatctgttgagtgcagtgggtgataaggacgttttctgagatgaagggagggaagtgggtgataaggacgttttctgagatgaagggagggagtactttggagcttgaggcaagagatgctgcagaatagctgttttgagggagtttgccaggaagtcaacagacgactgagcggattgttaggcaacacccaggacagatttgatgttggatgggggtgaatttgtcataggccacgcttttttattttattatttattgcagcagtgctttgcaggaacaaagaaagtgaaaattgagatgttcaggattatggactaacagcaggcaggatggagggtgaagggcccagagttcagggtggtgacagtggccattttgagtggctgagtgtagaggactgagcagccgtgtgtagattaactgccaagcacagctgcgtgagtgagcctaggccaagctagcggaggaaccacgcagccaacccgcaggatggcggaaaagaataagccgtggttgattccatcactctgtggcgggcagcttgttacacagcagtagaagatgcatgccatgccttgtgttgactgcgcacagcagggagcctgaggcaagggagcctggcacagaagcagaggtcagtcggctggagaagctgggcaggtggagaagaatagagggggcctctggggagcacccagaaatacccagcagctctggagaagtgcaggttttagaatgtgagagtgagaaggaggcttgccatcttgagagatacacacctggtggcaagttgtggtgacggtaagtgctggagggagcgcagccacagctcagactgtctcttttcttccgtgccattcactctcagcagaggaccttgccttgtactacacagaggacagagaagtctttttatgtgagtttcttcatcatcccatttccaaagacaaactagggatacagatatgaattgtatgataaaacttgagataacagataagtcacattacttttctaagtctgattaaatcttgtgcccctacttgtcaagaccaataaaaagttagtagttttcgtggcttctttttggctcttatattgtacagtaagtcttctcttaacctttcaatcagttgttggaaactgcgactttaaatgaaatgatgtacagcaagtctttgaataatgttgttacaaagttgatgagaaaaaaaaatggttttgttatatgtccttttgcttacggttgtagtttccaagaacccatcaatgatactcagagaagacttgctgttctgggactccaaggcttagtgcagtctctgggggaaactggagagaggaaaagcattgtgctcatgagctgtctaggcctgagacagggacagcatccgtgtcgtctgcaccaggctcagccacagggagccttagcacagcttccagggccccagagctcaatggagagattagctttccataagaggaaggaacctcatccagtgcagtagaggaaaagagaagaacataggtgagatataggtgggctagtggagcagtttgtaggtgtacagggagagttcttgaggaagccgtggtattgttcttcaggccactgtggcctcatcagcaaaagaatctttgcctttttttcttatatcatcaggcctttgtgattcgagactagagagaaagaagttgcttaatgcctgcaagatgtcaatcacgtgggctttgttttctggggtctacccgggcaggtgagaccatagcagattcgctcagcagagaagaggatggtgatgggttcctcaaggggatgtgaaagagggagagggaaatttcctatgatagggaagaacttgccattctctcacatgtagcaccttgcaggcggcaggacctaggatgggggtggctggaagaacactgagcgctaagtgcctggccaaggccctcccaccctctcaggaaacccacccacccagtgaacaacgcccgcatcagccttctttgcacgggctctttcccagtagcattaaaatatgctcacatcattcaggtcttcagtatcaaaaaagaaaaaacatcctctttaacaccatgttcctctccagacaccccttccctcccctttacttctgtttgttttttggggtttttgtttgtttgttttttgatgtgggggtctgtgtatgttgcccacgctggagtgccaagtcagtgtctgttcacatcacgatctctgctcactgcaaccttcgcccccacttcctctgggctcaagtgatcctcacgcctcagcctcatgagtagctgggactaccggcatctgtcaccatgcctgacttctccctttcacttcttagatcctccttgacccactgcaatctaatttctcctccaccttcaacggagagtgcccttgtcaaaatcatagctgatctccttttttactaactccagtggctgtttctcagaatttacctccctcgacctctcagcagcatcggaaagccaaggatgactttccattttttttctccttagcctccacgccccggccctctcctggatgttcacttccctctctggctgctctgctccatctctcatgcgggttcctctttcttggatcgttccttgaatgtgggtactcctcagacctcttccttctctttcccagccaatacattctacgtagaggagctcttctgctcctgtggcttcatgaccggatccacgtctccagccagatccttctcctgcacttcgcactcttatgagtatcaagtctgtggtttgattttaccccacttgtaagctagcaagttagcttgttactgtctcatggatgttggcacaagacttgagactcctgagtcagtgacaaaggacttcattcctcttggcacagcaggcaacatgagcatcagcttgtgggtgacagttactcctgccctcaccttttcctggtgatgggcccagctggatgcctgcacaggaaatgggtggcatcacagaaagggaacagagctttcagaacagagaatttcagggaacagaacaggggatatctactgcttttatagcaagcaggaagcaagcctgctctttggcctggagggagacattatgtcatctctcgaggctgctcactgcggcatagccctgagagatggtcagggttttcatggcataaccagcaagaacaagcatgttggaaattcaacatgtcccagattgaactcttcatttcccttcacctaaacttttttacttcctttttaaaaatttatttttatttattttgcacatttattggtatttcttttagagacacgatctcactctgtcacccaggctggagtacaattgcaggatcatagtccactgcagccttgaactcctcggctcaaccgatcctgccatctctgtctcctgagtagctgggactacaggcacgtgccaccacactcgactaatttttaaaattttttgtagacatggcagtcttgctgtgttgcccaggctggtcttgaaatcctggcctcaagtgatcctcccacccacagcctcccagagtgctgggattacagatgtgagccaccgcgcctggcctgtttctccttctattttctgaactcagtgattgatgcagtcctcgatatttgtaactcattaccaactgataagaaattcttaactcttttgactttcctctccctcatgaagtctgatgactccttcgaactctctcttaggtttatttgctcttcttgccgctcgctgcctatccctgggtcagactgtgcttctcttatgtgtttaagacaattacagccttttatcatccagctagaatattcattttatgaagttgtaagttgttttattacgaaatgtttttagagacagggtcttgctgtgctgcccaggtggagtgcagtggccatttacaggtgtgtaatagctcactgcagccttgaacccctggcctccagccgtcctcctgccccagccttcctagtagctgagactaagttacttaatttaaaatgtatgtattcatttgtttgtaattcaaaagattcaaaaggtagatgctgaaaagacttcctccagcctttgcccctgccacctgctctcctccaaggcattctccaccctccagttaatgttaccagctcctcctgtatcctgttaatactgtacccaaggtagacattttatactcaggttactcaagtaccgtatgtgagattgtgacacaaatttccataccttacatttgcttaatacttttttttttgagacagattctcactctgttgcccaggctggagagcagtggtgccatctcagctcactgcaacctccgcctcctgcgttcaagcgattctcctgcctcagcctcctgagtagctgggagtgtcccagagaggaacatggaggcttctgttgctgacacagcacagtggaattctcactttctccttatctgctctcttctcagtctgactccagatggaagctcttccctagaaaagccctgtccagaaggagtttgcatagtctatcattttccattttctgttagccacattttttcaagtaaaaaagaaacaggtgttggaagaaaaactttagacaaggccgggtgtggtggctcacgcctgtaatcccagcactttgggaggctgaggtgggtggatcacgaggtcaagaaatcaagaccatcctggccaacatggtgagaccccatctctactaaaaatacaaaaaattagctgggcgtggcggcccatgcctgtagtcccagctactcaggaggctgaggcaggagaattgcttgaacccgggagatggaggttgcagtgagccgagattgtgccactgcactccagcctggagatagagcaagactccatctcaaaaaaaaaaagaaaaaggaaaactttagacaaattgaatttaacagaatttaattgagcaaagaaccatctgagaatcagctcacccttccaaaaaaagggaagtgatgtacggaaaatggaagtgaggtgcagaaacagctggtgtagttacagctcgaagttggcctcctttgaacaaggtttgaaccgttggctgtgattggccgaaactctgtgattggggcatgagtaggttatgtctgttgtaacatccggttaggttgcagttcactatatatgcggaaacctctaggtcaagcttaaaacatgtaaggaggcagctttaggcgaaacttatataggttggtgcaaaagtaattgcagtttttgcccttttaatggcaaaacccacaattttgcacgagcctaataatttaacacaagtaaaattaattttaacaacgtatcttatttaacccaatgtgtctaaagtgttatcatttcaacatgtaaccaatattaaaaattattaatgagctattttgcattttctttttcatactaagcttttggaatcagtgtgtattttacactgacagtacatttccatttgcagtagtcacatttcaaatgcataatagccagatgtagttggtggctgctgtttggtctagcacgggcctagaatttgtcttttcccaatcttgtctccttcaaaaatctttttttttttttggtaattaaaaagtcgatatatcatggttgtacatatttatgaggtccgtgggctattttgatacctgcatacaatgtgtaatgatcaagtcagggcaattgggatatccatcacctcaaacgtttatctttgtgttgggaacattataattcttctcttcttgctattttgaaaatagaataaattgttcactctaattttcctactgtactatcaaatactggaacttactccttctatctaactaatatatttgttcctattaacccaatatctctttgtcctccttctcctcttcccttcccagcctctggtaaccatcattctactctctacctccctgagaccaacttatttagctccagtaagtgtgagaatgtgcgatttgtgttgccctccttcaaaactcttgcctgcaataagagtgagaatgtgcgattagccgtgcatggtggtgcacatctgtagtcccagctacttgggaggctgaggtgggaggatcacctgagttttgggaagtcaaggctgcagtgagctgagattgcatcactgcactccagcctggacaacaaaagcaagaccctttctaaaaataataataataataataatatctttgctatatgaaagaaaaaaaacaagaaaatgggaaaaaaggaaatatacttgacatgaggatagtacatgttttgttggcccttcatttattaagaaggaagatgagtaagtgaaaagaatcctatattccacagttactgactttaggtttcacttttaagttgatacttattctgcaacctctttcagtgaagaaatttaaaattcttatttaaaacgttttctttgtaaatagggagtaaatataataccactaaaattatccagagtggtaaagaaattaactactctagttaagtgaatatttgcgaaattaaattaacattcaaacattacaactttaattttgataattttgaatggaagtatttcgtaatcaattacacatccctgtcttaatattcagagagtattgaatagcatttatacttttcttaggttatttgtggaattgaactacgttatgatgggggcagggagaggtgaataactcatatttattgagtcgctgctctgccaggagatgtgctttgtattatgatagctcttcttatttaacccttagtgtatcccccttcctggttcttagtgtttgaaggaagtcactgtgttttacctaccaggtaggcttatgcacacattgattaggtaggtgatctctccaatctagtaagtcacagagctgggatttgaaccctagtggtttggcgctagaggccatgcttttaacactctgatactaatgtcaacttcaccacaaaactctgcggtagacattatcatccccattttacaggtgtggaaactgaggctcaaaagagttaagtaacacttaacgtcagttggtacatggccaatgtttctttttctttctagaacttttttatattggcccaggcaaggcatttgccagtcaatgaaaccatttctttcatctttctttggttcacttatcctcctttttctttccccagaaaacatcttttataatcatgaggcaatatcggagtgatttggtttcctacattacaaaatatgctctgagataatttggagaaacctggccttttcggagtttatattctaaaaccattgaaaacttttttttttccagagagattggaacaattatcaggtcattaggatgctgtcctacggaaggagagctgcatgatctgattgcagaggtgagtacggcgaaaaggtttcattcagccagctctctgtgtgagagctactccttgtaattaaaaacaatccttaccggaaactaaaaaaaagtgccccaaactactgaatgtgctcagtggaaatattaggataactattcatattagccaaccaacaaaatctgaaagaattgagcagatcttgaagaaatgactatgaacaagtaacacaactgatcaaataaagaacccactgtagaaatgatcctctctgtaaaattagttgaaaagaggccagtagatgcaaggggctgaccgtatgcagaaaggctattgacagagacagtaaggaatttttatttatttggggaaataaaactaacttttagaacaagtagtaaacagaataaaatatcaagaatgaactttacattgaccagagagtctaagaagtttaaaaacgagtcatgtgtaatagtggaggtgaatgatcccataaggcagtggatgagcagcccacgatgagagtgcttcatgctctgtttgactttccagaaaggtctctgatctcatttcaaatgcagcattcggttcaacaacagagactttaagggaaaaaagctacctggccaggagaagaatcttttcagaattgcttatctaggcacaaagattttagtggagtctggggatggcaaaggggataacaggagacaggtgaggaggtggaattttatctctttattttgcacctagcgcagtacctgcttgttcaacattaagttggagagaaggaattgtgaccgtggtgagtcacttaacccctgttgagtgtcagtttctccataataataactacttcaaagtttgcttcaaagataaatgaaagaaggtacaagaatgcatgttttgaatcctaaagcattatgtaaagttaaggaagggaagattagaaagatgagtctgctgcacagatattagcaccttggtgaccaaaaagcagtagcaattttttgaagcatttggaaatattcagtaaaggaatctaagttgtaagaacacattgtttttaccttttgggattcaataaagctatttttaccaagagtaagaggaaaagcttgtttttcctgaattgatgctcacattaaaaaaagatactgattactgccttaaagtgtttctgcacaaagctggaattagtgttagggaaaagcaagctggaagtgtggaagaggtaagaactagaggacgaatttacagcgaaatcatcatcatcacatgctcaggatagtaagtgaagcaataatgaaaaatacctccgaaggtcagaaaaggaggatctctagagtctagtccctttatggtttgtttgtatgttttaatctctatcaggagttagcaaatcatggcccctggccaaatcctgcccaccgcctgtgcatgtaaataaagtttcactgaaacacagctaaactcatttatttgtatattatctatggttgtttcctgactacaagggcagagttcagtagttgccacagagacctacagcttggaaagcttaagatatttaccatctggcctttgcagaaaaaggttgccaactcctgatctatgggcttctgtgccaaagtagaacaaataccacatctagtactagaagatctgagttcaaactccacagctaccacttatagccatgtggccttcaatgagccacttaatccttcaaagcttcgtttcacatctgcaaaaggagtataataacatgaaaatgtttttatgaggattaaatttaataaccgaggaatcaactgttacttggtgggcatgcagtacatacttgagtttgcttgcactgctggtggctctctaggataataatccccactggtttgggcagttagccacagtgggtgcttaggtcctaaagttttattttatttttacccttttttagggacatgacacaacctttgaaaattacagatatttagaatacttatgtaccagtaggggtcactgagctattaagctctgtaaatatttttctatatttgtatacgaacacaatttactctaattaaattctactgataaacagctttgggtataactaccttttaagaacttttccaaataaatgggtgggaaaaaagcacataaaaaaagcacaaatttgaattgataaatacaagtatgtatttgtacatatttaaatacatttaatagtgaatacatgtaaacacatttagaaaatcaaagccccgtaaaagtcaacatctaggggtaaatgtcatattgctaaatgttctataatagtttcagagatcaaactatttaaatgtatgtgtgtatatgctttaaaattgctctataaggctgggcacagcagctcacgcctgcaatcccagcacttggggaggctgaagcaggtggatcactcgaggtcaggagtttgagaccagcctggccaacatggtgaagtcctgtctctactaaaaatagaaaaaatagctgggtgtggtggtacacacttgtaatcccagctagttgggaggctgagggaggaggatcacttgaacctgggaggcagaggttgcaatgagctgaggtcataccactacactccagcctgcgtgacagagcaagactctgtctcaaaaaaacgaacaaacaaaaaatagtcctataaaaagttgaaacctttgtaaaattctctggttgtcatgtacttgaactttagtgtagacacattcttttctctttaatttttataactttcagccctttgcttcctgaagatcaatttcaaatatggtgtttctcttgaaatagatcattttaaaaatcatttaactttgatccatgcagtttatattctataaatagcaacttcctgcaaatactttctgccttttggaatatcacaaaaactggcaactgtgagaaggattagtgaaaaatcttaccgacatataggctaccaaataatccttcttttaatattaagttagcgccttctaggatcttcagggtatgggagctgggaggagataatggcattttcatacaaatggaaaggttatttagaggtctatgtcttctgaagttccaacctaagtggaattatggagaacttcaactaattacaaaggaaaactaaaagatgatttaaaagtaagacctatgtttgtcagattattgactcaggcttaggcactaagcacggattatgactttttattggggtgaccatctgcatcctccccttccccatccttgcccttttttggttgtagatgttaggcagcacctttgttggctccacatctgttttgctcctaagcgtgctatgttctattaaccatctccacctttccccgtgactccctcttcaatctgtctgctcattatatgaggcctcttaacttctgtgctcaaacaactctgcttggcctctgttacctgggtgtaggagagctggctagcaaatcattacatggatttaacaaacccaggtctacaattacctaatctagtcaaccctggcttgcagaagacaccatcacagaacttagtgacaccagtgcctttctcaccagcctgatacccttggtgagcagtgcatctgagccctcccatggaacagaatcctccagtgagtcttctgactcattagatgcccattctgccctcccacttccgtcagcttggtttgccacttcactcagggtttggtgtcgcttgttccaggtctccacttcactcagggtttggtgtcacttgttccaggtctcaccctcgcagcaagggtgccccatctcctagggtccttgccagagtgttaagtctgtgtcctgagaaagtgcctgaagtcgatgaattcttgcttatccagttttatattccagacctcttggtcaagcactctcatccaatctcaggggtactcccctagctcctagttcaggagccaattcctatctaattccttttgcgattttagtgtatagtctttttctttccttattaggcccagcacttcctcagccagattatgctgggatttaacacttcattattgcctggagcagcccattggatggatggccttggctcaaatatgatggctaggatcatcattcaattacatttcctgcaactgtagatttaagaggtgcatttcattgggaggctgaggtgagaggattgcttgagctcaggaatgaggcacaatggtggcccactgctctgcagcctgggtaacagagccagatctcaactcttttttttgagatggagtctgactctgtcgcccgggctggagtgcagtggcacaatctcggctcactgcaacctctgcctcctggcttcaggtgattctcctgcctcagcctcccgagtagctgggggttacaggcacgcaccaccacacccggctaatttttatatttttagtagagacggggtttcaccatgtcggccaggctggtctcgaactcctgacctcaggtgatccgccctcctcggcctcccaaagtgctgggattacaggcgtgaccaaccacgcccggcccagatctcaacttttttttaaaaaaagagaaagaaaattgaattttcatggctgccatagttgtcgtctggaagagctgtaatgcgaatcaggtgttaagtgtccagtagaatatgaccaaaaggagttggctgctctatatattttatttctaaactcactagggcctacccctggctttcaggattagatcaaagcataaaactacttaggaatgaaatgaaggtcctcatcagatccaaggagtggggcaagagtgagcagaaacttgaccagcacatagtaaagataggtcagtgataagaactgggccaggcttatcctggaattctgttcttggatcaaaagaggataccatggcagggagaccatggtaatgatagttcttaacaaaactgtccctttacatatgatggttgacctcgacatctgtgcacagccatcattctgggatctttgtgatatttctgggagtcactgttttccttctgggttggacttctttctatcccaagttttcctctttctagttcctctagcattttaacatattatttgataacttcttgggaaagagtgccttgggggtaaaatttttgagatttgtatgtttgaaagtgattatgctaatctttggctggaaatagaattctacattcaatggatttttcttcattaaatggatttggatttttcaggtcttcagtaagagttctgaaggcactgctcatcttcatgttcctggtaatgctattgagatagtgcaaatccattctggttcccaatcctttgtatataaacattaattttttttttcctgaaactctggacagttttttttccccagagtttgaaatttcacaaagatttacgttggtgtaaacacatatctaatgtgttaggtacctggtgggccttttcaaactagtgacttgtattttttggttccaggaagttttcttgcaattattttgttttcttttttctgttttttggaactcctattattcatttttgtgtttctggactggactagtctttaacattcttcttttttttttttttttttttttttgtatttttagtagagacagggtttttaccatgtttgccaggctggtcttgaacacctgacctcaaatgatctacctgccttggcctcccaaattacaggcgcatgccatcacgcccggctaatttttgtattttcagtagagatggcatttcaccatgttggccaggctggtcttgaacgcctgacctcaagtgatctgcccgcctcggcctcccaaagtgctcggattataggtatgagccaccgcgcccagcctaatattcttatttttcacttattttccatctctgtctctgtgttctctctggtagatttcttgaactttgtcttccaatatttttattgagtttctcatttctgttgtgttttaaatttccagtagcttgtttttgttctttgaatgttcttttttaaatagcatcctgttcttgtttcagatctctgaagataatagtgttactttatttgaagttttcttctctttgcataatctgttttctccaagttgatacctgtgtctgttctggtctttgtttttgttagtagctttcctcagtgtctgataaaccttggctgtcagttcctaacaaacacatgcatggaacttgtcaactttaaacttcatcactgggtaatctgggaatcacccgcatcggagtgttggggatttttctgtcgtgcaggcttgattctttggaatagagtgttcagtcttctgcttgggaggcaaaagcgtctagctgccagttcggacaccttctgtttacactctttagaaggtaaatctcgaaactcctgcagggatggagggcaggcagtcacttagtggggaaaactgagagggaatttacagcttttcaaacatattttaccctagttcccctaattttagttcctggtccctcatcctcatttccagaagcaaccaatgctttttgaggattctttactcactactgtcttgggttcagttttctagatctactagattattgccactcatccatctacttctcagcttccaaaattttattcccattatattttttcctattcttcctaagtaggtgtatgattattttaacaaatgtttctttactgcaattttaataaggtttgagagagagtaaagttagatgcagatatacagtttgcctccttaacacagaagtttcattgatatttgattagtcagaaaatagcaacagtactcctgagaaaagtattaataatgtaaatctagatgagacattgtaatagtctttagaaagagagcattagtaaatgttgggactaaagcactgataattatagcatataagatgtaatacattggagtgaattaagtatgcatgtgtaaatattaagtgtaactacaaaagagtataaagtgaatgcataacttccaaactgatatagaggataaaagaattagagggcattctgtcagtccaaaaagacagaaaagaagcatagaataatcagagtatctagaaaacataagataatggtacttataatcataataggccaggcatggtggctcacacctgtaatcccagcactttgggaggccgaggtgggcggatcataaggtcaggagactgagaccatcctggctaacatggtgaaaccccatctctactaaaagtagaaaaaattagccgggcttggtggcgggcacctgtagtcccagctactcgggaggctgaggcaggagaatggcgtgaacccgggaggcggagcttgcagtgagccgagattgcgccagtgcactccagcctgggtgacagagtgagactccatctcaaaaagaaaaaaaaatcataataaatgcaactggattaaactcaccagtgacaagaaattgaaattggacttctggaaaaatccgatattataatacatcaacacatttctgccatctctaccttcacattataaatttaactttctcatcatttccacatccatcaccttagtccaagccttgtcatttctccatgaatgactgcaatggcatttatttacttatttacttatttttcagacagagtctcactttgtcgcccaggttggagtgcagtggcatgatctcggctcactgcaacctccacctcccaggttcaagtgattctcttgcctcagccacctgagtagctgggattacaggtgccggccaacatgaccacgcctggcccaatacatgcatttttaaatatttgagatggtattcagtccctactcatttcgctaagtgaggaaacccataaacaaatgttacagttttttttatatctgtggtcagtggtttaatgttacatttatagtgttgagacaactatgatgtcaaagtgtgataaatactccccagtaaccagttaaaataatgtaatgacactagtgaatcatttcctacacttttcatcttggatggaaagtatcatactactccaggcataccacaagccccggaggtcccaaatctccatctttcattattcttaattggttaagtatccttggattttttttctttgaaacttcggaattggcttttgagttagtagaacaagatccacgtaatctacaccctggtgaagtgggaatttctatcagcctgtgcctggactctatcattgagcttctggaagagccctgggactttacatcgtttggaatttgactgtatcaagtttctcagagaatgagaaagggtgggagtaattatgttcttattttgaagtagttggtgatatgaaatgttttatctgttattgttcctacacatcctgcctttgggagatgggggagaatggaattgatctgctctaatttttatttatgttagatgctggaatttaattatagagctgatggtactttgcagattagttagtaatggctaccatccagccattacttcgagtagcatcaggtaaatttggggcaatgaggagaatatattgtaaaaagcatatactgagagtattgcttatttgtaattggtaggaaaacatttaacgatgccaaagccatgatcagcagcgggaaaacgtgacccagggaaatcttcaaaagtggttttttctttattagataaataaaacgtgtttttatatagaacagaaacaatcacggcaatagactaataaatacggttttattccagatttcttattgtataggtaatatccagattacaaaaaattttaaataaataggaacttcctttccaacaatgccatcaccttaatataatcattgttaatattttggtacacttccttacatattatttttctgtgtaggtttttaactggactgtaattttttttgttgctatcgtattcttttttttagagactgggtctcactctgttacccaggctggagtactatggcaagatcatagctcactgcagcctggaactcctggactaaagtggtcctctcatctcagccttccaaatagctggtactacaggtatatgccaccactcccagctaattttttttttttttttagagacggggccttgaaatgttgactaggctggtcttgaactcctggcctcaagtgatcctcccacctcagcctcccaaagtgcagggattacaggtgtgagcatgtgagccaccatacctggcagaactataatcttatagtataattcagtaggtaaaattctgaatcttgcttttttccacctaattatatcacaaattatatctccatgttattacaaagctttcattataaaaatgcatgctgattaaattgcacaagaaaaaaaaggaagggaatgatctctcttctgtgcatcactcagacacaaccagaatattttacctttttcactcactattacatcaaaatgatttttcccttctgttatctagtttttagaaaccaacgctttaagaaagaaatcctgttctactataacatggatgaaacttaaggatattatgctaagcaaaacaagctacagttgacccttaaacaacatgggggttcaaggcaccgacccccgtgcagttgaaaatccaagtataattttgcctcccccaaaacttaaactaatagtctaccattgactggaagccatatcaataacatacacaatcaattaacaaagattttgtatgttatatgtattatttactgaattcttacaataaagtaagccagagtaaagaaaatactattaagaaaatcataaggaagcaaaaatatagttactatccaacaagtggaagtgggtcatcataaaggtctcgtcctcattgtcttcacactgagtaggctggggaggacgaggagaggaggggtttggtcttgctgttccagggtaacagaggcagaagaaaatccatggagaagtggacccatggatttcaaacccatgtttgagggtcacctgtagttataagtattaatgcacaaatactgcatgtgaggtatccaaaatagcccaactcctagaaacagaaaatagagcagtagtggccggggaatggcggaggggaaaggggagctgctgttcaatgagtacagaatttcagttttgcaagatgaagacgttctagagagctgttacacaacaatgtacatgtagttaacactgctgtactgtacacttaaaaatggtgaagatgggctgggcatgggggtgcaccccaatagtttcagctactcgggaggctgaggcttgaggattgcttgaagccaggagttcgggaccagcctgggcaacattgtgagaccctgtctctacaaaaaaatttttaaaaattagccaggcttggtggtgtgtgcctatagtcccagctacttgggaagctgagacaggagggtcacttttgcccaggagttcaaggctgtagtgagctatcgtggcaccaccacactccagcctgggcaacagagtaagaccctgtctctaaataaaaaataaaccaataaagtatacagaaggatgtgcataggttatatgcaaataatgtgccattttatatgaggaagttgagtatttgcagattttggtatccatgaggagtccgggaaccaatccaccatggatacagagggacacctatactaatatcattaatattttccatgccaatattctactataataggagtgcaatcgcttcctaatatttaattatatggcaatgaccatattaataaatagaaacataatattccattaaatgaatattccatattacatatccattcatctattggtaaaggttgctaacaatttttaatatcatggatcctgcatgataaacattatttgaataaagtataggcccttttcagatgccagagggccttgtgaagcaagccaaggcagtgatgggttactgaagggttttaaatgagaataacatgatgagatttgcattttattttattttaattcgtatttgtttttattgaaggaggttgtactttagacaaaccagtctgatggtagtaagcagttagattggaataatttatagtcatcctttccctgggtcatatctgacagcttggagccctttgtacattttgggtaattttttcctaaatggttttatttatctcttttattcagtaaaacttaattgccatgtttctatgatgctgtggtcagaatgtatgtgccccttcaaaattcatatgttggagcttaaaccccaatgagatagtattaagaggtggagtcttcagggggcaattaagtcgagagagtagatccctcacgaacgggattagcaatgttataaaagggctggagagaattagctagtttttgcccttgcatccctctgccatgttaggacacagtgctcatcccctctgggggccacagcattcaaggccccatcttggaagcagagaccaggccttcaccagacaccaaggctgctggtaccctgatctgggacttcccaacctccataactgcaagctgttaggtatgctgtttatacattacccagtctaaggtacttcgtcatagcagcacaattggactaagaccgaaattgatcttcgtgggactatttctataacaaatacctgacaatgtggaagtggctttggaactgggggtcaaggctggaagactttgaggtgtatgctagaaaagcctggattgctgtgaacagagcactaatggtgattctgatgagggctcagagaagagatctgtagagagagcctcaatcttcttagagattatctaagtagacaagaacagaatgttggtagaaatatggatggcaaaggcaattctgttgaggtcacagacataaatgagggatgaggtattggaatccggaagaaaggacgtcgttgctataacatggcaaggaacttgtctgaattgtgtccgtgtccatgctttatggaaggcagaacttagaaataatgaaccttggatattgaaattggcaaagagtttctaaaagtggtaagttcctggcattgacacttttgcacattgctaatagcagtagaaaatggtggtattcatactcccttcctggacggcattttagcaatacttatcaataagctaaaaaaaatatacaagctcattgatcagtttctggaggagatactgtatggagaacaaacagaaagattttacttcaaagatgttagtcacacggttgtttgtaacaacaactggaaacaacctgagtgtccattaacacaaaaatggttcaacaaatcttggtctgtctgtggaatggaatgctgtgcagtcattacaagtatgtcgtgaaagactgatgccaccacacacctatgagagtggataaaatccaaagcaccgacaacaacaaatgctgacaagaaagtggagcagcaggaactctccttcaccattggtgaggacagtgcagcactctcttagaaaacgaaacatcctcttaccacataacccagcactcttctccttttatttatgcaaaggaattgaaaatttatggccacacagaaacctgcacacagatgcttatagcagcttcattcataattggcaaaacttggaagcaaccaagatgtcctttagtgggtgaatggataaataaatgtggtacatccagacaatggaatattattcagcactaaaatgagttatcaagccatgaaaattcattgaagaaaccttttttcttttttcttttttttgagacagggtctcactctgtcacccaggctggagtgccagttctcccacctcagcttcccaagcagctggggttacaggcacatgccatgcccagctaatttttaaaaatttttgtagagatgaggtttcgccatgttgcccaagctgagctcaaactcctggcctcaagtgatccacccaccttgccctcccaaagtgtgggattacaggcatgagccaccacgcctggcctcagaggagtttgagggcagtgaaactactctgtgtgatactatcatggtgaagacttgttgttatgcatttgtccacacccattgaatgtacaacaccaaaagcgatatagtttgaatatttgtccccgcccaaatctcatgttaaaatgtaatcctcggtgtcagagatgggacctggtgggaggcgtttgaatcatgggggaagatccctcaggcatggctcgggccgtcccttggtgataaatgacttcacacaagctctgagttcacacaagctctggtcatttaaaactgcgtggctcctccctccgcactctctcttgctcctgttctggccatgtgatgtgcctgttgcctcttcaccttccaccatgattggaagctccctgaggcctcccaagaaaccaagcagatgtcagcaccatgcttcctgtacagcctgcagaactgtgagccaattcaacctcttttctttataaattacccagtctcaagtgtttatagcaatacaagaacagcctaatacaaagaattaaacctaatgaaaactatgaactttgggtaataaagaggtatcaatgtagctctattaattttttttgtttgtttgtttttgagacagagtctcactctgttgcccaggctggagtgcagtggcatgatcttggttcactgtaacctctgcctcccaggttcaagtgtttcttctgcctcagcctcccgagtagctgggactacaggcatgcaccaccacacccagctaatttttgtagttttagtagaggtgtggtttcaccatgttggccaggctggtctcaaactcctggcctcaggtgatctggccacctcggcctcccaaagtgctgggattacaggcatgagctactgcgcccggccagcttcattaatttttaacacatataccactctcgtggggatgctgattgtaggggaggctgaggatggggagagcaatccaggggacggggcgtggcatatgggaactgtctggacattccacttaattttgctgtgacataaaactactcttaacaaactcaaatttattaattaaaaaaagactaatggcttgataagatgttcacagtgttaagtaaataaaaaaagacgctagaattctatttcttgctaaaatatatatatacatgtatatataatacatacacaaatataatatgtggatatagcattgtattaatgaatataaaactaaaacaaagctctccagcactgtatatacagaagtgatctgtagatgacaggatcgaatccctgcgtgatttgtattctttgtgctcgtctctatttttcactgttccacaaagaacatgtattatctctgtaacaagaaaaagaagaaaagaaaactgcattatatcattcaaaaagttgtctagtggtcacaaagacactattgaagatgcatgttgaaagtttgaataaagttggtttttaaaatgcaaaaataaagagcaatatttttaaattaacgtcgttacatacatgatctgaaacatagctgtggacgtagtaaagtttatatatttaacttgaccaaaactcctttaggggattttcttattagggaaaggagggtcactttttgttcatcagtatattcagatatttattgtgttaaccactgctcctttgcttaatcacaaccaagaataaagcttttcctccaatcatattgcaacacaactttaaatcattgtttttggtctgagtggggttgaagagtatcttagtgagatgattgctgcaacacttgctgcaatcaccatctctatcaaatacaataaaactacttggcgtgggagcggcactcacccttaagtagagaaactggaactggagaggatgaaacaattagtgtagctggtgctcctgaagccccaccctcagaggattaaaacagggaaattaatggtctgacaggcactgctgcagcctttcccccatctcttcaaattggagaaactctcggttggaagtgatcttactaagtaccggatttagccacctgttgattcttagactctctggtgattcatctgtttttaacacttgcacttaaataggaaaggaatttataacccagaagactcgtgcagcctcgtggttgcacagcagcctctggaatctttagaataaataatttttctaaagtaagtggctttaaaatttttgtttttaaagacaacatttttggtagatgccaattaattattgtgattttgttctattcaaggtagagaaatattttctaaattgtgtttatgttttggttttgaaacatagtttatgtcaaaatttgtatctatactatttagagcctaatgtgaactatctcatggtttttatattttttactacaaacagtttttaaacattcacatgtgtatctgatttggtgacctggaactagctgaaatgcagatgctttataaaccatcttaactactgacattatcttgttttttgtgaagcatgaaatggttcagtttattgactgattgttatgtcactggggagaaaggaattttcacggtgtgttttattgtgcctatttagtgggttcagcattaaaataaataatgcttttatgagaaaagagatggcctgatgatttctcgatgcaagtggaagttaagaactccaggctgtgatcccgtcaaaacacctgccggaccctgacgccctcagataggcacttaacctctctgtgcctgtatttcctcaaatccaaaatggattaagaaaattgatttagaccaaagtagagtgagaagcacagtatttgccacatgctttgaggctgagataaatgttgatattattaaaaagtcccacagtatttattgagatggctccatattggggaagaggaggagagagactgtggagtgccggaaggcactgtgttagcctccagaatttgggcccctttgtgtggcaatgaaggcagtatattttcttcaggtcacctactccaccttaattctttgcaggaggagaagccaggcgtatcagggccttggttttccaggtgagcatctgctggcacactgttaagatgaattccctgcgaatggtacttttagcaggctacactcgagggatcttctggcaaagacgtttttcctgtacattcacaaacgctgcccggcttacttttaaattattactccacgttagcccttcccatagaagaaacaaactagacttaacttactttgcctcattcatgtttgcagtaacaagatgtatttgttttgtgagttgcttctgtcttttgaagggagggatgtggagtttggtggatatttgttactctcgcctttttttcagtccaaagaggccatgtggggaaacagcagaggtggaggcatcaccgctaacccacatagcctgccctctagacatggggcgaggcaacaagcggggagggagaaggtgttgaatgcgcctagcaattccgtgcgctatcttatttaattgccacattccacgtggcattttacggataggcggcagaggcaaacttctgtataaacaggtgggtctacactgtgggtcggggaggatgtgcctgaaatttcagcaccagcgattgagtcttttaggaaaaagtgccattgcatgtcatagaaccagaagtgtgtacactgctggtacaaatcatcatcatcatcgtcatgattgactctcagagttcacaaagcaccttcatatctcatggaaccttcacaaccatcctttaggttactggtccccctgttagacatgagcatgctgaagctagaggatgaattttaataacattcttaactattattggtctaacatggggaatatattgtgatttttctctgtaagaaaggtaatgtcttttttatttacttttcatacctagtactgtagaacatctgttttttaaaaaagactctgaccaatacagaaagaagtcaagtggattttcccaacacgactttgctttaagtgaagaaatgcaatgactttgtagtcttttcaaacatgtctgatataatatatggaatctttcttgaattcatttcagtataattgagttttctcctggagaaaataggtcccaattgcaccattttttctgcatttctgcatcaactctgtgaaatacatttttttttttggtttgtttgtgtttttttggagacagaatcttgctctggagtgtagtggtgcgatcttggttcactgcaccctccatctcctgggttcaagagatcctcctgcctcagcctcccgagtagctgggactacaggtgcacaccaccatgtccagctaatttttgtatttttagtagagatggggtttcgccgtgttggccaggatggtctcgatctcctgacctcgtgatccgcccaccttagcctcccaaagtgctgggattacaggcgtgaaatacagttctgaattctgaatatctgctctgcttgatgatagtgattcaaacttgatcagacttctgcttgatgatagtgattcaaagtctttggctaaaaatatgtcatatacacttagaatatatgttagttataatgtttgctagagccgctttgatagtgcaccacacagagtggcttaaacaatagaaatttattgtctcacagttctaaaggctgaaagtttaagatcaaggtatcagcatgattaaacatctaccctattcttcttgttcttttttatgacattggaatataccatatttgaaaaatgcattttagaaaaactaatggaatccaaataaagtttggaatttagtgactaataatatattaatattgattcattagttatgacaagtgtaccataataatgtaagagttaacaatagaggaattgtatcacaaatgaaattacaaattatgttacaaagcaaaagtaatcaaaacagtgtggtactggcacaaaaacagtcatatagactattggaacagaatagaaagcctataaatgaagccatgcataaatggccagctaatcctcagcaagagtgccaagaatacacgatagggaaaggatagtgtcttcaatgaatgatgatgggaaaactgttatttacatggagaagaatgaaattggatccgtatctcacaccatacacagaaatcaactcaagctggattaaagatttaaatgtgagacttggagccataaaactagaagaaaacatagggaaaatgctctttgacattggtctgggcaatgattttttggatatgatactaagagcacaggcaacaaaagcaaaaataaacaagtggcactacatcaaactaaaaagtttctgcatgcaaaagaaacaaggagcaacctatggaatgggagaaaatgttgcaaaccatacatttgacaagggattaatattccaatacatataaggaactcagacaactcaattgcaaaaacaaaaacgacctaattaaaaaaaacggaaaaaaggacctgacattttttcaaaggtgatgtacaaatgtccaacaggtatatgaacatcattgttcatcaaggaaatgcaaaccaaaaccacaatgggatgtcacctcacccctattgtaatggctactatcaaaaagacaaaagtgttggtgagggtgtggagaaaaaggaacctgttggtgggagtgtaaattggcacagccactacggaaaacagtacgggggtttctcaagaaactaaaaatagaattaccatatcatccaacaatcccacttatgggtataagtcccaaaagaaataaaatcagaatctctaagagctatctgtattgccatgtttattgcagcattattcacagtagctaagatatggaaacaacgtgtctataaacaaatgagtggatagtatatgtacacacacacacacgtatgtaatggaatattattcagccttaaaaaaggaggtcctgctatttgcaacaacatggatgaacttggaggacattatgctaagtgaaataagccagacacacagaaagacaaatactgcatgatctctgttacattttcaaaagtcaaactcatggaaacagagagtagatgggtagttaaccgggggtgggggtagaggaaatgggaaaatgttggtcaaagagtacaaacttttagtgataagaaaaacaatttctgatgtacagtgtggtaactatggttaataattattctatacttgaaatttactaagagagtagttctcaagtattctcaccacacatacaaaaaaggtaactagtgagtcggtggataagttaattagcctgtgtggtaatcattccacaaggtatatgtatatcaaaacatcgtgtggcacaccttaaatatatgcaatttttatttgtccatcatacctcagtaagactggaaaaaaatagaggaaactgagtgagagaggtatatgggaactctgtattatatttggaacttttctgtatatctaaaactattctaaaatccaaaggttattcaaatataaaatccttttataatataaaatagtgtctatattaaacattccatgaattctgtacttagaattattgtataattttattgtttttaatgccattgcttatacatgtttttgtactcaagaacaaattggatacggcctctagaggacagtgttgggtcatagaaagattttacaatttctgcccaagttgaagatggtcataatcatttttcttcttcttttctaaccacaagtcctgtttattcgttgtccctctgtaaaaacaacaataacaaagaacacttatgacccctctgctgttctgactagttggctgttttgttttaacttattttcgtataattttggttccacaaacatctattaggcaagaaagatctgcggagttggcaccataatgttcacatccctgagggtttgtgaaagttgtgagggaacccggggaagcgatatgaggcgtatattatgtgtcatttgtgagttcttccacgatggagacggaattatagagttgaacttcctttggaaaaacaaaccacggttcgtagcttgatcagggtgcatgtaagctaaagaggggttttggtcttttaaaggttgagactgcctgctctacagtggtttgttggtggtgggaggaaaggaaaaaaaccattgctcttgcttctggagcaaatttctggagtaatcagaatagcaactcaacattttaattttaaaattcctcctccggagataacctcgtaggattgccattgtatttgcccggggctcctgaggtggggagttgcagagtgctgctcaagtgcgtcagagccatatgaacattcacctgcaaaatgctcgccttggacttagaggcagctgaagacaattgttcatgaatggatgggctcagaaattctgaaacacacaattctgtcattgaatgcgctgaattttctgccgagagtggagtctgagggttctaccttgctaggtgtgaatctagtataaacattaaaaaataggagtcatttggatgatggtgtgttccacttagcagcaacctatagtttttcgtttgtttgtttttgctcgaagaataaatctgtccaaagctcatctgctgaattgggatctttgagccttttaataggagtcttgagagggagtggaaaatgtacagctccttatagatagcccgacatgaaagttaaggtcaatggtgttttgttcagccactccatccaagtcgaacccacgggcagggatctgttttgttctcatttactagtgctaagtgccaaacattctctttctcaggtatagtcttctaatttagtggtggtgtgacaaagttctatttaccatataggtacttaatacgtattatgatgatttaagatgtagttggtccttgagatcgtgattggtcccctcagctggtccctcactcaggattccttatctcagggaaaagcatcaccttatcccagtggtataagtcagaatcttgggagtcatccttgaatcctctgttttttccatccttactcataatgaatgcaggaccaggtcctaccaatttcacttcttaaatattttttgaagccatccatttctctctccatggccgccactccaatctaagcccttgtcatatctgcttagactactgaagaagctgcctcaccctcaagcagtgtgctcttccaaaacatgcatctatgagaccgtcactgatttcccattgttctcaggctagcaaccttatcactgtcatggacaagaaggccctgccgtcgggcccctgtctctctttctagcctcatcttgaagccttctccctgctccttgtactccagcctcctagccgccaatgtgtcagcagagagtcttcgcgtattcagtttcctctaggtgactgtctctcccctgctgtctctgtctcattaccttctactcatactctctaaatcagctggagtgttatttcctcatggatgacttccctggtctcctggtctaagaagtgttctttatttttttatttttattttattttattattttatttattttttatttttttatttatctatatatatatattttttgagacggagtctcgctctgtcacgcaggctggaatgcagtggcctgatctcggctcactgcaagctctgcctcctgggttcacgtgattctcctgcctcagcctcctgagtagctgggactacaggcgcccaccaccatgcctggctaattttttgtagttttagtagagacagggtttcaccgtgttagccaggatggtctccatctgctgacctcgtgatccacccacctcggcctcccaaagttctgggattacaggcgtgagccatcgcacccggcaatttttttattttttatttttttattgagatggagtctcgctctgttgcccatactggagtacagtggtgcgatctcggctcactgcaacctccatctcccgggttcaagtggttctcctgcttcagcctcccgtgtagcttggattacaggtgtgcgccactacgcccatataatttttgtatttttagtagagacggggtttcaccatgttggccaagctgatcttgaactcctgacctcaagtaatctgcctgccttggcctcctcaagtgctgggattacaggcgtgagccaccacgcccggccgagtgttctttattggctgttcttacagacccatgctccttcccctcactgtacttacatcagttcacagtgtctttggttgctgtttcttgattaatgtctgtctccctgatcagagtatcagctgtgctccagttgaatgatgaaggtaaatcttaaaaagataaagtaaaggaccatctctgtgagcaggggtcacgcccaagtgtgctcaccatccagagtctctagcacttggcacagtgcttggaacaactagttgctgaatacatttgttgaatgactaaatggctatttacttattgaatgtttaggtagaggaagaagaacccactggatacattcgattcgaaaaatttcttccggtgatgacagaaatactactagaaagaaagtaagtaagtaaatgcaattgttaaggcaaagtaatggtcagaattatgaatccattcatttcaggacgcttggctttttcactttgtgtgttatactcaagcagtgtgtcctaaggtggcctccctctaacctttcaagctacttctgaactggcagttggtacctgcttagaaatatcaaccacactagtgttatcctaagcaaagcataattagagggtaaataagctataaagatcgtaaatcaacattcttagtatcttctgttttgaattatcaatgataaataagaatcctaatatttttctagcaaaaatatagcattagcttaccatagttggttcatcatagaagtcttgtgcccagataaattgatgtccaaaaagctaatagataacctcaaacatgtcagtgattttgcactaaatatttcctgtggggctgaggtattttcaactttcatatccagaaatccaaaaagatttcaatgaggcaagtattatcatcccagtatgttagcagcttttattttattttattttattttattttatttttgagatggactttcgcttttgtcacccaggctggaatgcagtggcaccatcttggctcactgcaacctccacctcctgggttcaagcaattctcctgcctcagcctcccgagtagctgggattacaggcacgtgcatgccaccatgcctggctaatttttgtatttttagtagagacagagtttcactatgttggccaggctggtctcgaactcctgacctcagatgatctgcccacctcagcctcccaaagtgctgggattacaggcatgagccaccatacccagccctattttgttttatgtggtcatttattacggggatccccaaccaccaggccaggtactggtgccagtccctggcctgttaggacccctgggccacacagcaggaggtgagcagcaagagagtgagcattactgcccgaactccgcctcctgtctgagaagcattggcattagattatcataggaatgcgaaccctattgtgaactgtgcgtgttagggatctaagttgcatgctccttatgagaatctaatgcctgatgatctgaggtggagcagtttcatccccaaaccatccctcccctcccctggtctgtggaagaattgtcttccatgaaactggtccctggtgccaaaagggttggagactgctgatttattatgtaaagactgcggtaaataccacggcatttactcattttattgcataattatagatacagaccaattccagaagatgtccttcttcgagcttttgaggtatgtaaactccagcttatatgcatatacatatatataaatacatttatttacatacacacatatatgaaaaatttatcatgtagaacttattcaccaaatgaaaaatataatatctatcttttcttttcccctaggttttagattcagctaaacgtgggtttcttactaaggacgagctgatcaagtatatgactgaagaaggtaagtgtgatttattacttatcacaatgacttatgtgaggaattaataatttgttaacagttatgcgaaagttataggggatactttaaaatcagtcattctggtgaaagttatttactgttcctgctattttggcttggggatggtttctgttctgtgggggttaagaggacaaagagtagggaaaggggagatgggttgttgtctcgtagaattttgtgaagcacagtgattacttctataatttcaggcattgcattcagagcatttccagaataaaagatatgccatctggaaaacatgaactatcgatcactgtaaatgaaggcctcttcctagattgaagatttgaataaagaatataaaaattccgccccccccccggcgccccggcttttttttttttgagacggatccggtcttgctctgtcacccaggctggagtgcagtggcgcgatcttagctcactgcaacctccgcctcctgggttcaagtgattctcctgcctcagcctcccgagtagctgggattacaggcacaggccactgcgcccagctaattttttgtatttttagtagagatgggtttcaccatgttggccaggctggtctcgaacttctgacctcaggtgatccacccatcttggcttcccacagtgctggtaaaaattcccttttaaagagcttttctgtcagtgaagttacagataatgtagcctcaattgaatactgaggtcatttttaacactaaaaatgtccttttttaatgttaattgaaccatatatatttgttttgaacatggcccatcatacatatatgcatacacacacataaaacctgcacacttatatatatatgccaacatatttcctttaggaattctctctgctaggctgatgtgtaaatttgtttacactgaaggtcagtagcctgatggacagtctcctgaaaccatcctcatattggtccccttgccttctcccatacaaagctagagctctctggttcacagactgggtcctgaatgactcagagttgctaatcacttgaggcagaatgaaaagcgcaagtgattttgagtagggaagactaagactgcatctacacgcacaactggtttgaccattccagcttcatccaccttaaggcggaatacagagagtgagggtcagaatggcaaggccgtcacagctgccacccaagaactctgacgccattgttaaaattaccttcgggattaattctgatggggatgttacgactttcaaagcatcagcttcttcatcctgaggattagtctaaagaaagtaaatcctaggttatatatcaggcaacatgaatttagtcaaaatggcccaaacagttagattttcctactgttgtgtgcctactatatgtttaatatttagtaagtgtagtaaggtataatgatacttaaatctacttcctctctcaaggatattacaatcttatttgggaaataaaactaacataaaataattcacaatacaagacaatagaaagctaaatatcagaagatcaactagggctggcccagcctggaaaacttggtttgggaagacttaaagagaaaataggttttttgagatggtagaatgtatatggttaaattgttgagggcaaaggtaaactcttgtgcattataattctgtcacacatggtagatatcaacaaatgtttgttgaatgaatgagtgaatgagtagatgatgaagaccaggtgaaggggctaatgagagggagacattatcgatgtgtaaaacagtctgaacaaaaatggggaggtaggaatgaacatgctatttcagagagaaaataagcctagctggcccagagggtaatgttggcaaacagcaggaaattaacttcagtagacttactgggactaaattgtggagtcccaggctcaggagtttggaattcatcctgtgggcgatggagaagtattacaggcttttgagcagatgactcacatggtgtgtgagtgattgtgagaaggtttttctggtgctggtcggtttgttagatgcataagaaagaggttggactagggaggccacttagaaggttatttcagcattttgagggcacccaaataagggcctgacctggcagtgggaatggcaatgggaagaagggattggtacaataggactgtctgtggcaggatccatgggtcatgatgagtaacagagtgtaggcgacaaagctgagagctgaatccaaagtaccaccaaggctttgccctcgatggcgagtatgatggtaatgagactgactcaaacagaaaggtcagaacagaccgcagtgtatacagagacagtgcgaccacgtggtttacttggaggtgctgtgtgataatttcgaaaatggtatgtttacagagagttcatggtacttaaagatcaactattgagtatctcagcggactaagcataggacaggtatggtcaaataagaatacatatgttttcaattattcactcagcaagtattattacaaaccttccacatatatgaaccaatatgtttggaagtaatatgtaagatgtaaatctatacaaatctaagttacgatttaatataacagacccatcagctaagtgtaatagcagttgactagtttggtaaaataggagcttaagaattgctgctttgagagtctcagaattctacaaattgtttttaagtacatttatgctatataacaatatggattcaagctacttgcacattcatcctaatatccacaaagtatcaaacacactagtttgagaatatgcattcctacagccctggatgtcatatgataaaataaatcacactgaatcaagttcctacaagatagaagtccctaagtgtccaggaatgtgtattgcatcagacagtgtttagcagccgggaagatctcagaacaattttttaaacaaacacttgcatgttgctgcttctatgccaggtactgttctaagtcccattcaaatcataacacgtttcattctcatgacaaccctatgtgacaggtggtgtcgttatcacccccattctagagacaggtaagctaaggtggggagctgtgaagtgacttgctcaagatctcagagctcgtgagaggcagccagcatgtggatccaaacttgtgctttaaccactcagttatcttccttccatctttcatcaaatactggggcttcaagttaatcctctggtaatttcaaaagttttaatctaaataaataaccttgttcatgatgtctgtatgtcttcctactgttttgcctgaaatgacgtgttctagaggttgcttgatctatgacatctgcaggctaaaagaagtccagaatctaccagggtgtacaatagccttgtctttgaacctctggactgtcgtgatgtcctggctctacagctccagggagcgtaactagtggcactgtgggagcttgtggggctccatggctattaagctggctagtggaaagagaaaaaaatcagatgatcctaaatgataaattttcctttttgtctctctgaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataaattactatttatttaaaaactattcttaaaacattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaatttattttttt

SEQ ID NO: 2227 - DNA, 117979 bp, Homo sapiens
cgggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggtgtgtgcgcgcgcgtgctgtccccaaatggatgagaaataagggaaaggaggggttggggaccgtgtgatgaagcaacatgctaggcccgggacaagtccggctccggcctcgggtctggagggacaaggccgggggccgggtggcagacggggcctctggtcttcccccagcgcgagggtcgtggcgcgaaacggggacagggcgcgcgctcggagcctcctccccgccccgccccgcccaagggtcttcctcccccgggattcagagcggcccctcctccaggccaggctcgccgcggggcgctgagcaggccgggacaccgcggccgaggttatcgttaggcatctcccaggcgaccggctccgcagcaagatggcggacgagaaggacagggaaggtaaggtaggggagccggggagccgctgccctcgccgcccgccgcgaccccgggctgcacggggaagcgccgggtggggtgggccctcgtccatctggagttcccacccgcagggaaagggcggcctgaggagggggccacccggcagcagcagtcgccctgcccccgtccccgtagcccgcccggcccgccgctccgccccgccccgccccgcctctctcccccgccccgccccgcctctctcccctcttccctccctcttctctctcccctcctcccgccttcttctttctcctcccgccctcttcaccctcttcccctcctcccgccccgtcctccttccccctccctcggaggccgggccttgcatcctgcgcgggctgcgccggaggcgccggcagggggtgctgataatggcgtcgttgttcacggtcgcggggaagccgccgccgcctccacactctcgcctggggtctcggtgccgcaggcgccacgcccgtagctgtccaggctgtgggccccggggggtggcctgggtgaggaggagttctggccgcctgaatctgacgggatcctctgtttgcgccgaaaccccgcgctggcgcagcctgatggcgttcgcggccaccattttgcctccttaatgaggacgcaggaggacggtctggaggtcacagccgctgcctccgagcttcccggtcctccgaaatgcctgccccgccgccggctagcgccgcgcaattggcctagtgtcttgtcttaaaaaaaaaaaaagacacacacccaaacagcaattttaataacgacgaaaaaccaaaacctggttgagatcttggaaccgctgtgcgccggccgggcctctcccaggggaccacccagccccgcgcggtggccgcctgcagaggcgggactgcgcttcgaggcttaaggtcgccagttcggaggcatcgatgtgttgtctgtgcggagaagccaaaaagtgattacgtttatttgcaagaccgttcatgttgttttcagttcatggtatgattaaaacccgatcctttgttaccatgcccttaggtactaaaaaataattgtgtttgatagttggcagtcacccaaaaatatccaaaaagccatgaaacagtaaaggtaaacaagtaggaagtgaaaataatattcgtcctttgttttctttctggagtgctcaaaacaccctctcaaaccatttttctcagcatagaaccaagtgtggtcaggttaacagctaatatttacaagggaagaaacgaaccctgagatatttagtcacttgttccggtgatcacagaaaatcggcgaagaaacacatgaaactgccaacgatctctctattgataacaaggataccgtgatttttatgtaatattaatctgagaagccaggattattttgtaggtattagctttacgaagatgcccttacatacaaagaaaaggataattttaaaactttcccagaaaaatggatggcttatttttgttctttaccaaaaaaaaaaaaaaaaaagccattaggagataaactagcaaggtaattatggatatttattttcttaaaaaagacttggttaggtcagcatgagaaaaaacgcactggagtatggtacaaatacagtatttctcgttttttaaaaactgagagctttcctgatttttcagcttttgaacaatttttttccatttaaagtaaattcagagaaacaattttgtcgataactcatagaagtaatgactgttaaaagctggatgccattcattcagaatacatatattcaatgccattatgtagataaggcattctacttagaactttgaaagatacgaaaatgaaagacattgtctttgcttccaaggaaggtgagatgagtaagggagatgagaaatttacaaatgggaggaaatagttaactgggctgagtagtctgggtgccaaccactgtgctaggtgtgtatccttgtagtccgtggacagcagcctggacatcactggctgccaccgacctaataatgaatcagtcttcattttaacatgtttgtaggtgatttgtatgtacattaactttcgagaaggccgggcgcggtggctcacgcctgcaatcccagcactttgggaggctgaggcgggcggatcacgaggtcaagagatcgagaccatcctggccaacatggtgaaccccgtctctactaaaaatacaaaaattagctgggcgtggtggcacgccctgtagtcccagctactcaggaggctgagacaggagaattgcttgaaccggggaggcggaggctgcagtgagccaagatcacaccactgcactccagcctggcgacagagtaagactccgtctcaaaaaaaaaaaaaaacaaaaacaaaaaacaaagttcgagaagcactcatgtgctgtatctcatttattgttaacagttttatggattaactaattgcagtttgtgaagggtattatgaaataaaggcattttgttagaggataaactaagtagagactcattttggtggtaagatctttttatggaaatagtctattactatatttgattgtcagctactgtattttgaattttcagaaattacgtctaaccaattaatcagaattgattaagttttgaggattcactcaactaaactcataaaagactgatgtgcaaacctgaatgatttattaatttaaataagggtatatacattgacttgaaggctgattttgccaatatactaatataataattttggcaatatactaatataataatatactgttttatgggtactaagcttcgggtagtgtgaatttgtatttcagaagtcatttgatgaccgtggaatcacacaaaagaaaggataattttgaaggatgtgttcagtaccctctaagttccaaaagatctgggaccatttctgatctgttaatactgagtgttgtgcagagtgcttggaacgtggtaggtaatcaataaatatttgttgaattcagaacatttgaattaatcaaagacagcttatgagattttaaccaaagcattcctagctattttccccaaacttattctatacctaaaagtacacaaaactcgttttaggtctcttttcccctctgctttaccggtaagatacattcttctattccatctggctcaacaaaacgttttatttcacagtgccacggtattcactagcatgtctttaaaaaacaactacaaaaaacctcattgtagaaatacacatatgttttaaatagttcatccttaatattgagatttctaaaagttctaaagggggaataagtttcagggtacctatcctatccactcttcttcaatatttagagattaactttgatagaagtattgagaatattgataagaaaaattacctaaattagaaggggctattgtgctcataaaatttttttctaagattatgtacgttgaagttgttatacttatttgtagcattttttgctttcatacagtataatttattttttcatagattaaaaattatacagaattatattagctaaaagtttaacctttagaaccaaattatttttaaaaccacttttttaactgaaagaagaatgtttgaaacgggatgagaaaaaatatttttgaaggtttattatttttccaaagtttcctcagccagaacattttttgttttgttctttcttttccttctgttttgtctgtttaaatggagagtcaatgcaattgttgattctttggctccttaaatcttattgtttctgtctcttagagaattttatataggactggaaggatcttctgtttgtaattagactcacgtctaggaaacaaactgcttagttataaaatttgaacttttggcagccagtgagctttggaaagtaagaactttttagtaagctgcagatattaaaagctcactctaggatttactatttttgtttctattaaaatattctttgttactttgcgtgctttgataacattgcttgataaagtgcctctaattcaattatcacctcctaaatggaagaggttttacaaggtttgttgttttgtttctgatttccttcattgtgccactcttttgaaaacccaacatttggaaatataaagtaaaaaacagaaatttcaggtgcctattactttataaaaagggttcccttaaataacgtctttgttttttttttcttcttttattttgagacagggtcttgctctgctgcccaggctggaatgtggtggtgcaacctctgttgcctaagctggaatgtagtggtgccatcacggctcactacagcctcgacctcctgggctcaagcgattcccccgacctcagcctcccaagtagctgggactacaggcgcaagccaccatgcccgactaatttttttaatttgtagagacagggtttcactgtgttggctacgctggtctcaaactctttattttttttatttttattttttttttgagatggagtctcgctctgtcgcccaggctggagtgcagtggcacgatcttggctcactgcaagctctgcctcccaggttcacaccattctcctgcctcagcctcccgagtagctgggactacaggtgcctgccaccacgcccggctaattttttgtatttttagtagtgatggggtttcaccgtattagccaggatggtctcgatctcctgaccttgtgatccgcccacctcggcctcccaaagtgctgggattacaggcgtgagccaccacgcctggctcgaactcttgagctcaagtgatctgcctgccttggcctcccaaagtgctgagattacaggcatgagccaccctgcctggcctcatagtaactgtcgatagtatagagtgtagcctgtgggacagtacaaaggttgagctttgaagtaagacttgaatttgaattccgtcttccccaagctctaattatctgatcttagccgagatgctaaacataagtagcttcaagttcctcagatgtaaagtggggataattatacccccaatatttcataatgttgtaatggggacaatgttttcttattcatttttacatccccagcacctgccacagtgcctggcatcaaaggaatgctgaggccggctcacgcctgtaatcctagcactttgagaggcccaggcaggtggatcacttgaggtcaggagttcaaaaccagcctggccaacatggtgaaaccctgtctctactaaaaatacaaaaaattagctgagtgtggtggcgcgtgcctgtaatcccaactactcaggaggctgaggcaggagaatcgcttgaacccaggaggtggaggttgcagtgagctgagatcacactactgcactccagcctgagtaacagggtgagactctgtctcaaaataaataaataaataaataaaaaatacaataaaggaatgctgaataaatgggaaagaaagtgtttggtacgtatctagtgaattagtaagtattagtatctgcttaacataaaacataagagttggccaggcgtggtggctcctgcttgtaattccagcactttgggaggccgaggtggggagatcacctgaggtcaggagttcgagaccagcctgaccaacatggtgaaacgctctctctacgaaaaatacaaaaattagttgggtgtggtggtggttgcctgttatcccagctactctagaggttgaggcaggagaattgcttgaacctgggggatggaggttgcagtgagcctagatcgcagcattgcactccagcccaggcaacagagcaagactccatctcaaaacaaaaaaacaaataaaacataagagttaagaaaacttttaagtcttaccaattgggatcatgcataatgcattcctgcatatttctggggtaatttaataagttttcttcctgttttagaccaatataaatatccggttaagactaagcaaacaagaagactagctttttgaagcctaatttgtttcctcttattcagaataaaaaaaaatttgaagaaaaactggactgaaatttgtttttgctctgatatataaaatttacagaaatgtctcaagaatagtcataattttaaagatcaaatggacagtgagatactacctcacgcctgttaggaaggctattatcaccagaagtcccccaaataataagtattggtgaggatgtggagaaactggaaccctcgtggactgttggtggcaatgagaaatggtgcagctactatggaaagtggtatggcggttcctcagaaagttaaaagttgagttaccatgtgacccagcagttccacgtgtgggtatatatccacagtaattgaaagcaaggcctcgaagagatatttgcacaaccatgttcatagcacattgttcacagtaggtaaaaggtggaagcaagccaagtgtccatcagcggatgaatgaacaaaccaaatgtggtatatacgtgtagtgaaatattattcagccttcaaaggaggaaattctgacacatgctaccgcttgaatgaacctgaaagacatcatgctaagtgaaataagccagtcaaaaagacaaatactctgtgattccacttacatgaggtacctagagaagtcaaattcatggagacagaaagtagattgctggttgccaggggctgtggggagaggagaatgggaagttgtttaaggagtgtagagttccagttctgcaagatgaaggaagttctggagattggttgcccagcagtgtgaaggtacttaacactattgaactatatggttaaaagtggttaatacagtaagttttacattatgtgtattttaccacattttagtaaatagaaaatgttgagtacattcagaatgaaagaaatggtacattgtttttcaaaggcaatttggaaatttgtattgaagaataaatgatgatggctaggcaaggtggctcacatctgtaaactcagcactttgggaggctgaggtaggaggattacttgagaccaggagttcgagaccagcctgggcaacatgctgagacctcatctttgctaaaaataaaataaataataataaagaagtcgggggttccctctgttggctttggagcccccatccctctgtctctgtacagggaagcttcttccttctcctttcttgctccttcttgcctgttaaactctctatttcttaaaaccaaaaaaataaaaaataataataaaaagtgatgtccacatgctttgagctttaatatacttctggatatttatccttagaaatatattctgaaaagaataaaaaatgctctaagcacaaaaatgatcaacataaagttatctataaatttgaaaatatagataacatttgcatgtccaactaatggggcatacaaaataaatggttgtatgtccacttgttgggttgcagccaaatatataaaaattatatgtgtaaatgggtaaggacacgtgggggagcccaggagatgatgatgatagcagggtgattagacttttaggggcacttatttttaaaatctcattttaatgtcagttctacaaaactttaaaaacccacttaaatatgctaattaaaaattattcttacccacttgtgaaagtgtgtttaccagatcctgtacttgacaatcctttgtaaacctctagtatggattttatagatattaagactgtaaaaaagtaattttagtttttatttttattttttaagagatgagatctaggccgggcgcagtggctcacgcctgtaatctcagcactttgggaggctgaggctggcggatcgcctgaggttggaaattcaagaccagcctggccaacacgggaaaaccccgtctctattaaaaatacaaaattagctgggcatggtggcgcatgcctgttatcccagctactcgggaggctgaggtaggagaatcacttgaacccgggaggcggaggttgtgatgagctgagagcaccattttactccagcctaggcaacaagagcggaactccgtctcaaaaaaaaaaaaaaaagagacgaggtctcactctgtcaccctggctggggtgcagtggcttgatcacagctcactgtagcctctactttctgggctcaagtgatcttcccactttggcctcccaagtagctgggactgcaggggcgtgccactgtgcccaactaacatttttatttttggtagagataagatcttgctctgttgcccaggctagtctcaaactcctggcctcaggcaatcctaccaccttggcctcccaaagtgctgggattacaggcttgagccaccacctctggcccataattttatttttttaaatgcactagtaaaattgggagtttaaaaacctggactagaatttggacattgcctttttttttattctttttaagattttgcttgttagtgtcaatttatctgacctttggtttgaagaatttccatctaaagaggaagataggcagctaaggagacaatgatacaataatgtgataagtgctatgatagttgcacatgtatgatgattgggtgcctggggagagtcacctgattcacacacaccctctttaaattatagcccctttttattccctctcatagctatttgtttttttcctctttcatactatattttgtaattgcctgtagatgtgttgtttgatgtctgcttctcctagactcttaacttccaaaaggataggggtcatgctcatgcatatacccagagcatggcatatagctcagtatttgctgaatgttgaatcaaagttggctttctgaaggagataaccgaagcttatcttttttttttttttttttttttttttttttgagacgtagtcttgctcttgtcgcccaggttggaatgcagtggcgtgatctcggctcactgcaacctctgcctcctgggttcaagcgattcttatgtctcagcctcccaagtagctgggattacagacatgtgccaccatgctgggctcatttttttatatttttagtagacggggtttcaccatactggccagtctggtctcgaactcctgacctcaaatgatccgcctgccttggcctcccaaagtactaggattacaggtgtgagccactgcgcctggcctaatttttgtatttttagtagagacggggtttcaccatgttggccaggctggtctggaactcctgacctcatgtgatccgcccaccttggcctcccaaagtgttggtattacaggtgtgagccacgactcccagccccaggcttatcttgaaggtgtaatagcacagagaacaagtaggggatggatatttcaggaagagaagaaataacatacttgaaattgtgaagactcaatatggccgaaatttaggatgggttaggagatgtgggaatttttattcttaaagcattggtgagtgattaaaagtttttaacaaggccgggtgcagtggctcacgcctgtaatcccagcactttgggaggccgaggcaggtggatcacgaggtcaggagatcaagaccattctggctaacacggtgaaaccccgtctctactaaaaaaaaaaaaaaaaaaaaaaaaaaaaattagctgggcgtggtggcaggtgcctgtagtcccaggtacttgggaggctgaggcaggacaatggcgtggacccaggaggtggaggttgcagtgagccgagatcacgccactgcactccagcaagggcaacacagcgagactccgtctcaaaaaaaaaaaaaaaaaagtttttaacaagatgggaggctgaggcaggataatcacttgaacccgggaggtggaggttgcagtgagccaggattgcaccactgaactccagcgtggctgacagaatgagactctgtctaaaaaataaaaatgaaaaaataaaaaataaagttttttttagcaagagacaatcatatttgttgtctagaaaaatcacttgggcaagtgtgctcagtggattagatggactccaggtttgggactccaggtttgtcccagtatagtagtccagaaagataaaaccctgaaccaaagtaatggaagtcaggaatgaaacaaggagataggctagaggaaatggatagattttgtaataggacagatatgaatattgagtcaggtcagggacacggtttctgattgggtaacaaagaataaagaggaatagtagagttatgtaaataatagttctagtcttgcacatgttgagtttgggtgcctgtgaggcattcaggttgagatataacataggcagcactgtgtgcttggtacctaaatatctgttgaatgaaaaatgagaatgatgtgtgttggatcgcttgaatgtattcctctgtaagtggttgtagtcttgggaatggttgagaatgtccagaaaaaatggatacaattttgttgactgaggccgggcgtggtggttcacgcctgtaatcccagcaccttgggaggcccaggcgggtggattacctgaggtaggcagttcgagaccagcctgaccaacatggcaaaaccccctctctacccaaaacacaaaaattagccaggtgtggtggcaggcgtctgtaatcccagctacttgagaggctgaggcaggagaatcgcttgaacctggggaggcagaggttgcagtgagccgagatcacgccattgcactccagcctggatgacagagtgagactctctgtccccaccccaccaccccaccgccaaaaaaaaatgttgactgaaaggagaagtgactaggatcagaactctgggtaaaaatcagtaattgaacagagaaaaataacttgtgaataagattgaaagcacaattgcaaaatcatgggaaaatgagcaaatagtgtcacaaaagccaagtaggaagaatttcatgaaggaagcacttaaaaatgttgggaaaaactccccaatggttaacatttatagagcacttactctgaagtaggcactgggctgaatgttttacgtgtattatgtcctttaatccttacaataaatctatgtggtaggtgcctctgttacccgctttccacaagtaaggaaatggaggcttagataggtaaagcagccttccagtttcagctcaaaaggtaagcgcttggaagtcatcactccggttgctcctggagccataaactgcaagaaatatttgttaattttgacaaattggtggaggctgcgtgtggactgtcatgagagtgagaaactcctggaggcctgcagtcttaggcggtccctcacacttcctccggttttactcctaggaaccccacggggttattctggtgaagagccaagcaaggttggtttaacaggggaaggggaaagcaacgcttttgaaatatgctagtgcattcttcataaaaaggccaatttcagtggccgctagtctggtcttatctcaacggatggaaaaagctgaaaaacacttgtgaaggtcacagcccattgacacaggtccactaaaagactgagatttcatcgtaagttgatagaattctcctcacccatccctcaccaccacatcaacaggaatacaactcagaccaactgacagcggcttgcagctggaagacctacaaggtggagactctatttaaggacaagttcttagggaagcctgaagaggaatctggcacctacagctacagcaaacattaaacacagccctactcctagccagattggggtaaagcctcacactagtagctgattactatcatgtctggcttccaacaaaaaatgacaagacatgctaataggcaagaaaaacagcccgaagagacaaagcaagcatcagaaccagacttagatatatgataatgggtgttttgtaattatcaaggaatttaaagaactgtgattaatatgttaaaggttcaggccgggcttggtgacgcatgcctgtaatcccagcactttgggaggccaaggagggtgggtcacttgaggttaggagtgtgagaccagcctagccaacatggcaaaaccccatctctacaaaaagacaaaaattagccaggcgtggtggcgtgtgcctgtagtcccagctacttgtgaggctgaggcaggagaatcactcggaccctggagtccatagactcaatgtggctgaggaaagaatcattgagcttgaaggtatgtcactagaaactttccaaactgaattgcaaagagagaaaagaatgaaaaaacaacacccaagaaccatgggataatttaaaaggtgtgaaataacatgtaattgaatgccagaaggaaaagaaagaatagagcagaagaaatatttgaaaaaatgggctgagcgggcccagcactttgggaggctgaggcgggtggatcacctgaggtcaggagatcgagaccagcctggccaacatggtgaaaccctgtctgtactaaaaataaaaatacaaaaaattagccaggtgtggtggtgggtgcctgtaatcttagctacttgggagcctgaggcagaagaatttcttgaatccaggaggcagaggttgcaatgagctgatatcgcgccattgcaagagggtgagactccaatctcctagggaaaaaaaaagaagaaaatcatctggaaagcttgttaaaacatagattgttgggtctcaccctcagtaatctggagtgagggggtctggaaatttgcatttctaacaagttaccacaggatgagcatgctgttaagaaacattgatctaaaatttaaagtgaattttgccatttcagtgtatttccttctaggttttgtctaggcagatttgtattttgttttgttttacaaacttgagatgatattgaatatggttttatgtccagcttttttcacttactattagaaacattttttcatgtcacaagtatttcttaaagacatataaaggagttgcattcattatattaggttggtgcaaaagtaattgtggtttttgctattaaaagtaatcgggcctggcgtggtagctcacacctgtaattccagcactttgggaggctgaggtgggcggaccacttgaggtcaggagtttgagaccagcctggccatcatggtgaaaccctgtctctactaaaaatacaaaaattagccagttgtggtggcgcatgcttgtaatcccagctactcgggaggccgaggcaggagaatcacttgtactcaggaggcggaggttgcagtgagccaaggtcatgccattgtactccagcctgggcagtagagcaagactctgtctcaaaaaaaaaaaaaaaaaaaagtaaccggaaataccgcaattacttttgcaccaacttaacctaacattaatacttatggtcactatgatttacttaaggtttgtctaactgttagatatttaaattgtttaaaaatgttctgttgtaaatgttcttatacaaggattttttttttgacccagctttgatcctcatcctctacccactttggaaaaatttcttttttttctggagagacagggtttctctctgtcatccaggctggagtgcagtggcccaatcttagctcactgcagcctcaaactcctgtgctcaagcggtcctcccacctcagactcctgagtagctgggactacaggtgtatgccaccgtacctggctaatttttttggggggggggaataattttgttgaatcccatctctggtgggtcttcctagttacagaggataacccaatttcccaattctgtgagtaccttgtgatccttttgtattaattacattatttctctccaattttaaagaaatcaatcatagacccacatattgccattcagagcttatgatcaggataaaatacagatttgcttattgtctctctatcctgttacagtggaaatgataggaaactagatattttgtttcttttgttactaaatccctggatttagaaaatgtgtaggatatagtaatcactgtaaatatttgttgcaagaatgcaggaaccaggagtagcacattgatggcaccttgcatcttcttattaagagtaaatgtatttttctgtgaatccttttaaaatactgaaaataggctatgtgtggtggctcacacctgtaatcccagcactttgggaaattgaggcaggtggatcacctgaggtcaggagttcgagaccagcctggccaacacagagaaaccctgtctctactaaaagtataaaaatgagccaggtgtggtggcacacgcctgtagtcccagctactcgggaggctgaggcaggagaatcgcttgaacctgggaggtggaggttgcggtgagccgagatcatgccactacactccagcctgggcgacagagcaagactctgtcaaaaaacacccccccttcaaaaaaaaaaaaaaactccctcaatttcctgacacatacgtgtttatctgtacttactggctccttacaaaaacctcttacctggtttacttgttttcatttattatgctgtaaatctggttattggttaatgaattctctacctaaaatccttaatgtcttcccattacccttaggatagtctgaattctaacaaaacagacaaggatgtcttctgtctccagggttttttttttttttttttttttctgattacatgtgtggtatcaccattcacgcattctacacttcattatacgcttcatcatagagagcaatttctttgttgttcctgtaatgaaagtgctagcctgcgcacatattgtttccttatcccagacttcatttagtaaatagcattgcttagtggttaagaacatgaagtctgtagttaatccttatgggctcaaattctggctttgccactttagagctggataactttaggcaaggtacttaggtgttctaatttcttcacatgtcaaatgaggagcatagcagagcctgtcccatgtggtggtaaaggatgttgtggagaacttcacatgccgtaagagctctagaaatgttatgagtccttacttaccgtgttaggcctggtgctagatgttggggaataaaacagatttgggccctgtcctcttagatattgctgtagaggagagaaccattaaagagttacataattattgggccaggtgtggtggcacacacctgtaatcccaatactttgggaggccaaggtgggcagatcactcgaggccaggagttcaagaccagcctggctaatgtggtgaaacccccgtctctactaaaatacaaaaattagccaggcatggtggcacacacctgtaatctgagctacttgggaggcggaggcatgagaattgcttgaacccgggaggcagaggttgcagtgagccgagatcgtgccactgaactccagcctgggcaacagagggagactccatctcaaaaaaaaaaaaaatacataattgttataagcagttcaaaaaagttcagggttccacaaaagggacatctgatttaaatttttcttttttctttcttttatttttttttcagacagagtttcactcttgttgcccaggctgaagtacagtggcatgatctcagctcaccacaacctccacctcccaggttcaagtgattcttatgcctcagcctcccgagtagctgggattacaggcgtgtgccaccatgcctggctaattttatatttttagtagagacggggtttctccatgttggtcaggctggtcttgaactcctgacctcaggtgacccgcccacctcggcctcccaaagtgctgggattacaggcatgagccaccatgcctggtctgatttaaatttttcttacttcagtggctttgaatgtgacatttcctctaccaaaaactactactagtaacagatggaactgcgaatttacaagcctgaagtaagaaaggagcatagcttattagaggagttgcacgaggctccattgtggctggaatggagacatgaaggtgggaagaatggtgtgaaatgaagtttgaaagtaggcagaggccaggtctttgtgaagaccaggtcagggaggctgacttctatacaagagcaagagggagccattggagctttttaaacagggaaatgatacaattcattatgtttttaagaggtcacttggccagatgtgatggcacgagcctggagtcccagctacttgggaggctgaggtgggaggattgcttgagcctagaagttcgaggatgcagtgagctatgatcacacctgtgaatagccactgcactccagcctgggtaacatagtgagaccctgtctcaaaaaaaaaaaaaaaaaagatcacttgcttgcactgtggaagggtggagcacggcaagagcagataatgatggtggtgtcttggattagacagcagcggaggaaatggcagagaaggtttgagagtcaagagagtctaaacgtttttgtgactggatgtggggactggaggagacagggatgaatgaacacctttcagtccaacttctgactcttgcttctcatctttatctaaggtccatcctcaagtctgaggtgggtgccactcttgtgcctccgtagggctgtctgtgtatgtcactaagttttagcactgatctgttgtgatttactatagctggtctgttttccttttaagttagaatgtatttatagtagatggtagctgatcaacaaacatttcataaatgaaagcacagattaacataaaagtagatgatgattgagtacagtatttctttctttttttttttttgagatggagtcttgctctgtcgctctggctggagtgcaatggcgcgttctcagctcactacaacctccacctcccgggttcaagcaattctcattcctccgccttccgagtagctgagattacaggcgtgcatcaccacacctggctaatttttttttgtatttttagtagacatggggtttcaccatgttggccaggctggtttcgaactcctgacctcaagtgatccgcccacctcagcctgccaaagtgctgggattacaggtgtgagccacagctacggtatttcattttaagcctagtgttttggtggtatattgtctttggatcaagttgtttatgaaaaaagaattctcaaagaactattcctaccacctctctcccctgacccccccagccaaaggccaagaattggattcttgatttttttttttttgacagcatatgtctggaatatgtattggtattaattgggtcaaatagaacaataacattatctgtactttcagttaattaaccttgagggcatttctttaccttcttttttgtatgctttaaacagttcccatggtaagtattcctcttggggcttattattttatcttaatttctgtaggtgggattttgagtatctaattagatatttaaatatgtaaacagacatctccatgttagaaaaaactcagctgcactatttgtttaaaaaacttctcttatatccttaggtgatttgacttgtgttttgttatgactgctcctttgtatttattatcattaatttgttctttcgaaattaagtttaactttttttgttgtttttctcctatggtttagattttaacttagtgcaatatgtagttttttagtctttgcagcatttccattgatggaaaacaaatacagtgtgaaattgttggctttcatatacccaatatggaattaaagtgaaaagggaactatttaatttattatttttttaaatgagatcgggtcccactatgttgcctaggctggccttgaactcttgggctcaagcgatcctcccgccttagcctcctgggtagctagagaattattatataatggtataacttgcctcaactgggatttttatcaattaagtggcattttgttattatattgacatactaatttagttatatttattttataataagcaacactgctgtttatattttgtggcctattagagtaggaacaactaaaaataaggtaaataatatatttttaaaggagcatgaaataaaaaattttatttaatatttaggaaagatgatatgcgtatccaacccattgcaaaaattatagtaattgctagttccaaaatattgttagtgaaatgtcatcagattcctataaggcttatatcttcatgaaaagtaatgctaataacactgagtgtgacattagacctttgcctgttttctctctttccatatatgcttcctgtgaatgactaatagaaaacttattttctctcaaccaaatctgtgtaacttactttcctgagatactaggcaacttccctacgttacaaaaaattagtaatgataatgggtaactttgattgaatattcctatagttcaggtggtaaccctcaaaacaaccttgtcagctagatactcgatattgtgcttttcacagatgagaaaaactgaatatttgagcagttatttatcctaaagattacagagctatgtacgtatgaatatgtaagaatatgatctttaaaccaggtggtctggttctagagtctgtgatcttaaccatgacactgtattgcaacctagaaatggtggcaaaatttgttcaaagtacaatgttaataaagtaattttgatttatttagttattatttatttattttttgtagagacaaggacccactttgttgtccaggctggtcttgaattcctgggcacaagcgattctcccaccttggcctcccgaagtgttgggattacaggcatgagtcaccacaccaggccaataaagtaattttaaaaattaactaaagtccatactttactcagattttcttaatttttacctaatgtccttttctgctccggagtcccatcaaggacaccaggttaccatttagttgctatggctccttcggctcctcttggctgtgatcgtttctcaggttttccttgtctttaatgacctccttgacagttttcagaatgggtcagaatgcccctctattagaatttgatgtttgtgtcctgattagactggtggaatgggattttaggagggagaccacagagttaaagtaccattttcatcacatgacatcaaggttatgtactattaatatcaatacaattgatcactgttgatgttagcctcgatcgcctggctgaggtagtgtttgtctggtttctccactgtggtaactctgtctccccattccgtagtctttggaaggaagtcatatgtgcagcccacactcaaggagtatggagttatgcttccctccttgagggcagagaatctacatgaattatttgaaattcttctgaacagaagatttgtatcttttctcctatatatttatttacagtttcctctattcatggtttggctttccgtggttttagttaactaaggtcaaccaagatctgaaaatattaaatggaaaattccagaaataaaccattcattttaaattgcatgctattttgagtatcatgacgaaatctctctctgtcctaccaggatgtgaatcatcgctttgtccagtttatccacattgtatatgctacctgtctttaatcattgacatcttctgcttctgacatttaaccatgaacattgtcatggctcgggatgacccgggatctcccaaggcaggtgctcttccttttggtgtatcatcaggtcaacagtagcctgacactgcatcatggtgctctgtgtcattcacctcacttcatctcatcacgtgggcattttatcgtctcacatatgacaagacgcatgagtacagtacaataagatattttgagagaggccattcatatagcttccattacagtatgttgttatgattattctattttattattggttactgttgttaatttcttaatgtgcttaatttatcacaggcatgtatgaataggggaaaacatagtatatatagggcttggtgttatctgaggttttaggcacccactgcaggtcttgggacttatccctcgtggataaggggagactactgcacttgatcattcattcctgtcagtatggacacattggatgtttattttatactttgggttatgagccagtactactttattcattttgttgctcaaattgtttcagctttggccattggaagctcttttcgctggctcctatgtcactatgacatagccccatcaaggtgtggtgtttttggggggttttattgagacagtgtcttgctctgttgcccaggctggaatctcgatttactgcaacctccgcctcccaggctcaagcagtcttcccacctcagccttcctagcagctgggactacaggcatgagccactgcgcctggcctaatgtgggtggtgtttttttttttgtacttctactactactactactactgctaggatctagttctactcagtacttctggcaccaaatgtgtgggttttccacaccaaacaattctccagttccctgtggacaccaactgggagtcctacaattcaactcaatttaataccaactacccagagttactacagatcccacaggttaaggatttggtcccacaagaccattccctaggaaagtaggctaactgctgattaaaggtagtggatccttaagttactcacacttcagttagatgtggctacaaattgggggtttccataacccccttcttagttccataatttgctataaaggttcacagaactcaaggaaacactttgtttaacatttactggtttatcataaaggatgcaaatgaagaaacagatggagtgacataaagggtgcggtgagctctgccaggtaccccagctgaggagcttctgttctgtggagttgggtgcactattctcccggcatgtggatgtgcttgccattccagagctcttggaacccctttgtttagggtttttgtgggggttccattatgtaggcatggttggttcgatcactggccattcgagattcgctcaatccccagcctcttccctctctggaggtcacagggtggggtcaggtttggggaatgagtcagaatttttggcagataatttctattttgtattagctttctggattattctgattccattattgtaacttgtttactatggtccagctttatgccctttgtatacattatgacttttaatcctcgtaacagccctgtgaggtagagaaatagagcagtaggagtcagggcctgtttggtcagcattttgctattaccacctttttaaacttttataggagtggctctgaatctctagaaagtcatgtaaagatcttgatatttatttaaaatcataaacaaatattcacaaggaaactttttttcttgacattcagtatgttttaagtaattttcatgtggttcgagccttgtaaaggtttttctggttttcatagtgtagaaagtaaagaaagctgttacaattgactgtctggactgatttattcaagagaaaatcacttggtttatagaaggcctttaacattttgtgagtatgtgttttaaaccaaaacccatagataggaagagccgacagggagctggaaactgcaataagctttcttctaactagcaaacgcagttgacagacatctttttatagacgtatctgtgattgcacgctgtttttaggcttgataattttttcaacaaggaaaaacttttcttcaatttgaaaaagctgtttacagtaaaatggcaaagtatgagaagacagaaagccatcctgctcattctaaagctaaattgggccacatttcccttaaagtatagacaacagcagcagtggaacacagttaagtgtgtgtttagtgaaggaaagttttttgaatactgccgccacaataatttttcaaaccttgaattctttattgagaaagtgacaaatcagtgagagagggaaagggaaaagaaaattaattgaatttgcaaaatttcttaaacaactaggattacagaagtaaaagaatgaatttgaaggctgggcgcagtggctcactcctataatcccagcattttgggaggctcaggcgggcagattacaggaggccaggagtttgagaccagcttggccaacatgctgaaaccctgtctctactaaaaatacaaaaaattagctaggcatggtggtacccatctgtaatcccagctactctggaggctgaggctggagaatcacttgaacctgggaggcgaaggttgcagtgagccgagattgtgccactgcaccgcagcctgggcaacagagtgagactgtgtctcaaaaaaagcccccaaaaaaacaaaaaacaaaaagaatgaatttgacgtagtgcctgtgtcagttagctattgctctgtaaccaattactcccaaatctagcagctaaaacccacaaatatttattatctctcataatttctggctgtagctttactgggtgattgtgcctaagggtctctcatagtctggggctcactcacatgacttttggcaggaagccttggttccttattggttgttggctggaggcctcagtttcttgacacatgagactctctataggccacttgactgtacatgcaacattgcatctggtatcccatagagtgagtcattcaagagacagaaagagatgacacagaagccacaatatcttttataacataatctcagaagtaaccaaacattacttttgctctattctattggtgacataaactaaccctatataatatcagtggtgactgcgcagtggtataaatagcaagaggtgagggtcatcgggaaccatctcagaggctggctaccacagtctgccttctggcctccagtgattcacgtttctcgcacatgtagaatgcactcactctctccaaaggcccactagaatgggccttccgtcccattacagccattacagcatcagctcaaagtccagaatatcatatctaaatcaagcccaggtggtaatgaggttccttggctgtagctacttatgtatgacttcttgagtggtttctcttgatctatagacctgtgaactagagagatgttacttgccccttaccactcaacatacaatgggaaaaggtaacatccacagacacttctatcaaaaaagaggatgtcttcgtgtatttgtgctgctgtaacaggataccacagactaggtaacttatgaagaacataaatttatttctcacatttctggaggctggaaagtccgagattgagggtctgcatctggtgagggccttcttgctgcatcataacatggtagaaggcatcatatggggatggggaaggaggctgaactcattcttgttaaggaacccactcctgctataacatacgtgctcctaagataacagcattaatccattcatgagggcagagccctcgtggcctaatcacctcttaagcttccacctcccaaaacttgcatgggggtttcagtttccaacacacgaactttggggatacattttttttttggtatactttttggtattcctccatagtaaggaggaaatgggaggaacacaggagtcgtggttcataaaactgagcctggcaagtattggacatttattgattaggactcagtcttactgtccagaagtgattctaggtggcctttagctctgtcccctgagctcttggttagactctttgtcatcttttcttttacgagaagtagtacatgtttacagctaagcagttttctaagcctgattcctgtcaatagaagttttgggagtccaaagaacgtttttccttttgtaatctctttgtcatttttagttcaggcttaaggtgtttctgcaaatagcttccttttaaaatttttcataggtctcccacgaatcttattgtccattagacaaaagccatatacacaaatttgtttgagataagctgttctctgtctttggctcctactaagatagctaagagacattaaacttctttttttattttttttcttagatggagtcttgctctgttacccaggctggagtgcagtggcacaatctcggctcattgtaacctccgcctcctgggctcaagtgagtctcctgcctcagcctcccaagtagctgggtctataggtgcatgccaccatgcctggctaatttttgtatttttagtagtgatggggtttcaccatattggccaggctggtctcaaactcctgacctcgtgatctgccggcctcagcctcccaaagtgctgggattacaggtgtgagcccctgcgcctgggacattaaacttctttttaaaccctgttgtttgagtgaaaggatctgtaagactcaccctcaaactttctagagattctttgctagtctgaatgttgccttgatgcaccacatttggtaattctgaagtcttaagaaaggactgtagaaccatatactgtattatgttttcctggcagtgccctaaatttgatctttaagaagccacttcttagtgttttcttgccatctggagatctagggaattttcacaactagcaattcctggctccttgttgtttaacaggctttcctttaggttatctctcctcttgtattttattttttgtttgtttgtttaaaagagacaggttctcggccgggcgcggtggctcacacctgtcatccccacactttgggaggccaaggcgggcagatcatgaaatcaggagatccagaccatcctggccaacatggcgaaaccccgtctctactaaaaatacaaaaattagccgggcgtggtggcaggcgcctgtaaccccagctacttgggaggctaagtcaggagaatcgcttgaatccgggaggtggaggttgcagtgagccgagattgtgccactgcactccagcctgagtgacaagagcaagactccatctcaaaaaaaaaaaagagggacaggttctcactctatcccccaggctggattgcagtggtgcgatcatagctcactgtaaccttgaactccttgggctcaagcgattttcccacctcaccttcccgagtagcaagaactacaggtatgtgccactgtgcctcactatttttaaatttttttgtagagatgaggtctctctgtgttgctcaggctggccttaagtgattgtgatcctaccacctcagtctcccaaagtgtggatgacaggcatgagacaccgagcccacccatctcttgtattttattatgcgcaactggaaggaaccaggaagcaccttcagtgcttttcctggaaatccccttatctagattacccagtttattttctactttccatgttgatacaggtgacaatgttgcaaaatttctgctattgcataaaaaggatctctctttgcagtttccaatgtgattttcctcactttcccttaagctctaacctagagcctacggaagggccagtactgcttggctgcaaagcctctcccacatttttaggcatgtgttacgccagctccccgttttcccgtaccatacctctagatgttatctagtactattacctattagtcatctattttgtggtaacaaattacccccaaaacttagtggcttaagacaataaacatttattttttcacacagtttcttagggtcaggaatctagaagttgtttaattgggtggttctggctccgagtctctcatgaggttgtagtcaagatgttggctggggctgccgtaatctgatggattggttgggcagagactctgctttcctggggtttcccataggctgcttgagtgctgcttgagtggggttacccataggcagctggtttcccgcaggactcgtgataagaggggtgtgggggggccaacatgaaaatctagtatgaaagtgatgtgctgttacttctgccatattctgttggtcccatgggtcagccctggtgtattgtgaaaggggactgcacgaatgtgtgaaagccaggaggcgggaatcactggaagccatatggacgttaccaggaggcaggaatcactggaagctatctggacgttgtcttctacaaccctgtcttgaagaatttcgtagcctactgggcacgagtgcctacatgttctaagcattgtgttagactgtcacatgttgttgatttggcatttacaatccagaaaggaactgctacccccagttgaagtttaaagagatcaagtaacttgttcacgacagattcgaatctagcctgggaataaacgcttggagcctaggccttaggtaaaggagtggataaatattctatagcatcattgcctttgtatttaaatatgaattttcttcattatacttatgtttagcagcagccatttaatgtctattttatatgtggacacctctgctcaactgttttttcttgtattcccttctccatgcagtcaccccttggcatgtggcggggataggctccaggacctcctgtggataccaaaatccacggatgctgaagtcccttacataaaatggcagaatatttgcatataacctatgcacatcttcttgtatacttcaaatcatctctagatcagttataatacctaatacaatgtaaatgctgtataaatagtttttatactgtattgtttagggaataatgataaggaaaaaagactgtacatgttcagtacagatgcagttttttccccaaatattttcaatatacagttgaatccatgggtgtacagagggctgattgtgtagctctgacctttttattttttttaacctatcctatctcgttcttctactgactttccttccaacactttccatagagtcctttggagcgtcagacttactctaacgtgaataaacttctttacaaatactctttttatagactacccctctcatctctgtcttaactaaatcctggctttcctgctagaatgccactcttcggggaccatcttgaatgaaagctgttcattcttccataccattttgtcttcaagccagtaagctgaatcagtctacttccaattccaaatcattgttctttcaccctcatgtaaaaattcttcttcctttgaaattcgtgccatctttttttttttttttttggtttatttttattttttgagacggagtttcgctcttgttgcccaggctggagtgcaatggtgtgatctcggctcaccacaacctctgcctcctgggttcaagcaattctcctgcctcagcctcctgactagctgggattacaggcgccctccacgacacccagctaattttttgtatttttagtagaaacgaggtttcaccatgttggccaggctgattttgacttcttgacctcaggtgatccgcccacctcggcctcccaaagtgctggggttacaggtgtgagccactgtgtctggccctgaaattcgtgtcatcttaatcattttctgtcattctttgtcactgtcatttattagtctgcctgtagcttatcccttgtttatcaaagactttggcactcttttctcagttttctgtccatctcttccactatcattctgggtggcttcagtagccaggtggactaccatgcaacatgctagtttcatcatccttgttcttttcaactccagtgaccttcacttccacttctttccaacattttactatcatgacttttagactgtaagacactctgaaatcttgactccttcattctattgactgaccaccatctcctaatttccagaggtactctgctcccttacatatatatttattttatttttcttttttcttttgagaccaggtcttgctttgttctccaggctggagtacagtgatgcgatcacagctcactgcagcctcgaatggctgggctcaagcaatcatcccacctcagcctcctgagtagctgggactataggtgtgcaccactgcatttggctaattttaaaattttatttttagtagagatgaggtcttgctatgttgcccgggctggtcttgaactgagctcaagcaatccttccaccttggcctcctgaagtgctgggattccaggcgtgagccactgcgcccagctcccttacatatataataccggtgttggatcttaccaagatgtctaggctgacccccttcccccaattggcttatcagtcaaacaaatggctaatatcaaacgattctggctaatgaagtagaaaaggaatttattagaagatagtaggtagctcacaaaatcaacagggaagctggagaaccagcttggaaaatgggcaggaagcaaagaggcccagcagcatataccccagctaatgccatggcactaggacagtggttaatgtgctgttgctcctacattcttgctgttatttcttctgccattcccataaataattttaatactgtctctccatttttatattacctgcttaggattcaaaatcttgcacaagaacatctgattggctgagtataggtcacatgcctattcctttgctaccagggagctgggagaggaaagatctgccttctttggcttacttagtgagaaggtagacacttttctgccaatattatacataataggattccctcaaaagacaacgaatgtttggatcctgggtcaaaaaaaaaaaaaaaaaaaaaaaagaaagaaaaggagaggaaggggaggggaagaatagaaggaggagaaaaaggaggaagtggaggaggaggcagcaatattgacaaatgtctactttagcccactactggcttgggaatggggagaagtctgcctttaagcctcctgaaaaaaaaaaaaagcctcctgatccaactttaacctccaaattctcactagatgatcttgcttcttatttcaaaaataggagccattaggcctggaatcccttcacttgttgcctctgtctttaaatgtacctaatcaacattgtcttttcctgtttccctttagctatcttagtagaagagctcttccttctcttgttcaaggctaatttttccatttatattcatgatgtcatccacacttgtcttctccaggacccctcatcattaattaagccttccttcttagttaagattatttattaatattccttttttgtcagacattgctgaatacaggagatataaagatgaatttgatatagctttgaagtatttattatttagtgggaaaaagacagacacaaataattgctgtgcaataatttaatcatgattgtaattatagtagttccttactttatccatggggaatactacaccaagacccccagtggatgcctgaaacaatggatagtactgaaccctatatataccatggtttttcctatacatacatacccatgataaagtttttttgtttttttgttttgtttgttttttgaggcggagtcttgctgtgtcacccaggctggagtgcagtggtgcaatcttggatctccgcccactgcaacctctgcctcccgggttcaagcaattctcctccctcagcctcctgagtagctgggactacaggcatgtgccaccacactcagctaatttttgtatttttagtagacatggggtttcaccatgttggccaggctggtcttgaactcttgacctcaggtgatccacctgcctcagcctcccagggtgctgggattacaggcgtgagccaccacacccggccaataaagtttaatttttaaatgaggcacagcaagagctgaatactaataactaatgataaaatagattagttttaacaatatactgtaataaaagttatgtgactggtctctctctcaaaatatcttattgtactgtactcacccttcttgtgatgaagaagggatggagtggaatgacgtgagatttcatcatactgctcaactgcgtgcaacttaaaacttaagaattgtttatttctggaattttccatttaatatatttggaccacggttgagtgtgctaactgaaactgtggaaagtgaaactgtggacaaagggagactgctgcatttgtgtaatttgtttgatacatgattttctattagaatgtgtcttcagtggccaggcacggtggttcaagcctgtaatcccagcactttgggagccaaggcaggcagatcatgaggtcaggagattgaaactatcccagctaacacggtgaaaccccgtctctactaaaaatacaaaaaaattagctgggcatggttgcaggtgtctatagtcccagctactctggaggctgaggcaggagaatggcgtgaaccctggaggcggagcttgctgtgaccacagattgtgccactgcattctagtctgggcaacagagcgagactccatctcaaaaaaaaaaaaaaatgtgtcttcagtgtctaatacctaagaggtgctcaataaatattattgaatgaatgaagaggggtaagcacagggtactgtggaatcatagaggataggtacttggccctcccctaggagggaaggaagattgggcttatgtcagtggaggcttggtggaggagactgcagcagccagcaggggaaaaaaaatcaggggaaagtaccaggcagagagaggggcatgaacaaaagttgagaatggtgaggaggtggagatggtttgaacagttaggtgttaaatagagttattaacagttaacatctattgagtttacatacatacatagtatatgtttatgtatacttgttaagtactttacatatattttctcatttaatacttacagtattctttgattaaggtattattcccattttagaatagaaaaatctctgcaatacgtagggaaaatagttaacttgcccaagaccatttagcctataaaggatcaaggagggatttgttttggggtctttctggatgcaaaacctggtgctctttataaatgccatgttatactaatacagtgtggttcccaaacttggtggctcatcagagtcccctgaggacctttgtaaaaatacaaattcctggccataccccagacctgttgagtcagagtttccaggggcagagcttatagatctatatttttgggtggttcacatgtaactggcctgggactggttctctcaccctggggagttattgcaggtggtgtcaagagcaaggcaggaatagctgactagccagggaggttttcctgtgtcttgctcctgatccttgactttaccccgtagatggtggggcactgaagctgagaagtgtcatcagatacacatattgtgcccaccactttagcaacagtgtgaaggatgaagttgaaggcacaggttacaggcaataagaacttacatctttagactgctgtcttgactgagttcgtcctttttcctcacattctcaagttttctaaattttttttctcttggttctgccaacccttcagttctcttttccctagctaatttcttgaaagaaatagttatactcaatgttaggtttcagtcagttcaagaaatgttccttactgacttactcttctttgaggtcatcttccatcaataaatgtttattgaatgttatttgaaagcatggtcctttctcagattttgctttgaagtgaaaataccagggatgatttattttttcatcacgtaatcactcatatgacaatttttattgatcaccaagtactcttcatgtgtctcctttatgctagggcctgggatacaacagtgatgagataaggcctcggactttactgatcgaacatctaatggaaggtggaagaagagaccatcacacaatgacggtgttatggggaacacagggtacagtgcattcatacctcctccccatcactgtgtcaatcgcttaaccatctctctgcctccagccttgcttccttccagttaagttatcctcattgattatacatctagccagatactccctactctataaatcttcatttgatagctattgtccttaaaataaaatccaaactccttcaatgtgtcttactaaaaaaacttgagcctatccccaccttgcgtactctcattctgtttcattatagggaagttaaggagcaagaatttgaacttttccttatgtttctttagtttcttttctttctttccaacatgttcttgttctgttgcccgagctgaagtacagtggtgtgatctcggctcactttgacttcccaggctcaagccatcctcctgcctcagtttcctgagtagctgggactacaggtgcacaccagcacgcccagctaatttttgtgtttttttgtagagatagggttttgccatgttgctcaggccttagtttcttttctggaagatttttttttttttttagtattttgaattatttttaagtaagagaaaaaaaaatcaaccttgttaatataaagggtaatcacttaaaaagcacacctaagaattagtatctcaaattgttgtgtagccgccaccaccatccaacttcagaacctttttgtcaccccaaactaaagctctgtgcccattaatcaataacttcacatctccccctcctggaaactaccgttctgctttctgccttaatgagtttgagcactctaggtacttcagataagtggagtcatacaataatttgtcttgtgtctgacttatttcacttagtataatgtcttcaaggttcatctaccctataagaatgtgtcagaatttccttccttttcaaggctaagtaatataccattgtatgtgtatgccgcattttgtttatccatctgttgatggacatttgggctgtttccaccttctgtctattgtgaataatgctactgtgaacactggtgtgtaagtatctgttcgagttcccacttacaatacttttagttatttactcagaagtggaattgctagatcatatggtaatttgatgtgtaactttatgaggaactacgatactggtttccaaagaagatactattattatcaccatgtggcaagtggggagacttgggcacagagaggttaagtaacttgcccaaggtctcacagctagtacatggtaaagccaatggtggctggctccaggtcagtgctcttaaccagcaatatatacatacttactggcctcttttgtaatctctgttataattatgttttcctatttggggaagattgacatcatttggaggttttttttgagatggggttttgctctgttgagcaggctagggtgcagtggtggaattatggcttactgcagccttgacctcctgggctcaagtgatccttccacctcagcctcccaagtggctgggactacaggcatgtgccaccatgcccagctaaatttaaattttagaattttaacttttttgtagagacaggatctcactatgttgcccaggctagtcttgaactcctggcctcaagcaatcctcccccctcagcctcccaaaatgctgggattacaggtgtgaactaccgcctgttttgttttgtttttagaggcagggtctccctatgttgtcaggctagacttgaactcctgggcccaagctattagcttgctgagtagctgggacaataggcatgtgccaccttcgagttttgagaattggactaaatcaaacaatattttactcgtagagtatttccttcttggattgatttttttgtttgtttgtttctgagatggggtcttactgtgtggccctggctagtctcaaactcctgggcttaagtgatcctcctgccttagcctctggagcagctgggactataggtgtgagccatggtacccagctttggattgattttttttttacatgacaaaattgttatagttctcactcttaaatattttttagaatagttctagatgagtatacaggaaactctttaggaatttgtattctacaaaacaaaatgaaaaacaaaagtatactgacacagtgtatcagtaacaaatagcctgactctcaaagtactctcattacaaaacttagaatgatactttttttttttttttaaaggtggtatgttacccagtctcaaactcctgggctcaagtgatcttcccacctcagcctcctgagtagcggggactataggcatgtaccaccacactcagtgaattatatgttttaaaaggatattttgtatattggccatttctctaacatttcccaaaactgcatgcttttggcatctgtgctataaacttagaccaaagtagcttcagaaatacagtagaagctccccttaacgtgtgtgccagattaacataaaacagacatttcctttctaagacatgcttattctaagggcacgcagaataccttttgccattcattaagtatgatgttagttgtgagtttttcataaataccttttatcctgatgaggaagttcacttctattcctagttttcttttaaacaataaccttaagaagtattttttaattgacacataataattgtacatatttatggagcacagtgtgacattttgatatgtacacataatgtgctatgatcaaatcactattcctagttttccgagtgtttttataatgaaaagatgttatgtattgtcaaatacttgttctgtgtctattgagatgacatggtttttttgctcctcttcgttctattaatgtggtgtattatggtgattggttttcatatgttcattctcgggagaaatcccatttggtcatagtggataatcccccataaagtggctggattatgttttcaagtgttttgttgaggattttgcatttatatttataatggatgttggtttgtagttttcttcttatgtctcagttttgttttttttttaaatcatgttaatactggccttatagaatgagttgggcagtgcttccgtctcttcaatttttgggaagattttgtgaaggattggtagattggtattaatttttttttttttagacggagcctcactctgtcacccaggctggagtgtggtggtgtgatctcggctcactgtaacctctgcctcccaggttcaagtttttctcatgcctcagcctcctgagtagctgggattacaggcgcacaccaccacacctggctaatttttgttagagacgggatttcaacgtgttggtcaggctggccttgaactcctggccttgagtgatctgcctgcctcggcctcccaaagtgctgggattacaggcgtgagccactggcacccggccttattgagtttttagtaggtttacaggtactatcagagttattctcaaggtgtttacagtatggaaagtgagacaaataagtaaactgctaattataatatggtttgatagactattatgatagagatagcatgtatgctacatgattacataggagggtacttaacaaaaaagagaagggaagccttcaaaaggtcagttactcttaaacgtgagtgacgaatgggagatagccaggaaggaggagagcaatattccaggcaggagtgtccgtcacaaaggcggagggcaatattccaggcaggagtgtccatcacaaaggcactgggaaaaagcattatcactgggacactacagagacttcctgcctagtgcatctgtgtggaaaagtgtgaagagatcacatttttgagataggtaggagcctaagttcataaagggctttgtgcgcctggttaaggagtctgaatgttagtttgaaaggccttgcgaaccattggaggattttaaaccagacggtcaaattactaaatttgcattttagatcatcctagcaaaatgtggattatggtttgatgggtggaatgggaagtgagagaaaggagactaaaggcaaaaaggcaggaagtgactacattaatttagctggaagtgatgagtgtttatttatttatttatttatttttgagacagagtctcgctctgcctcccagcctggagtgcaatggtgcgatctccacttactgcaacctccacctcccatgttcaagtgatcctcctgcctcagcctgtgattacaggcgcatgccaccacacccagctaatttttttttgtatttttagtagaggtggggttttatcatgttggccaggctggtttcaaactcctgatgtcaagtgatccacccacctaggcctcccaaagtgctgggattgtagtctaatcgtaagcaatgacaatggaaatggaagggaaagaacagagttcagaagggtttataagtagatggccgggtgcactggctcacgcctgtaatcccagcactttgggaggctgagatgtgtggattgcttgagctcagaagtttgagaccagcctgggcagcatggcaaaaacctgtctctactaaaaacacaaaaattagctgggcatggtggcacaggcctgcagtcctagctacttggggagctaaggtgggaggatcgcttgaacccaggaggtggaggttgcagtgatctgggattgcgccagtgaattccagcctgggcaacagagcaagactctgtctcaaaaacaaacaaacaacaacaacaacaacaacaacaaaaaaccccagaaaggttgaaaggtgttgatgatcaaatagaattaggaagatgaatttgttagaatgagaaatttggaggactgtgatcagggaatcagtagaagatagcagtgagaaggaatagtagattatgtgtcctcaagtgatgaaccttaatagagtagtagtttttaatatgaagttgaaacaaggatgctcccagacaagtccaggttgtgggccattctgtatgatgctataaagcctggtctcttcaacaagctaatttcatgtgtgtggggaggggtggggaaggatggaggactgttttagtttcaaagagaacaaaataatatgtaacagccaaatgcagtacataatctttgattggattttagtatgaaaaaaatacctatgagacatttagggacagatggagacatttgaatatggaatagatattagatgatcttagtgaatttttgttaatttttaaagatgtcataatagcattgggattatgcaggagaatgtctttatttttaggagatatgctgaagtatttagggatgaattattctgatgtctgcaattgacttagagacagacagacatggaaagaggaatcaaaaaatggcaaaatattaacaatagtttaggcggtgggtatagagttgcttgtaacactaagctttcaacttttctgtgtgtttgaaaatttccttcattagagaagctggcaaaaaatatggcagattaggagtatggggctatgagtagcaatggggagctctctattgctaaccttccccaagtccctgagataggtaagccacgggagaatgagcagccagttctgaaagggacttcaagatgggtaatgactttggggtagtgcttctcagcttttatcactttaaaacctaaacattggccaggctcagtggctcacgtgtgtaatcccaggactttgagaggccaacgtgggaggattgcttgaggccaggagttcaaaaccagcctggtcagcacagagtgaccttgtctctacaaatgaaaacaaaaattaaaaaaaattagccaggcatggtggtctgtgcctgtagttccagctactcaggtggctgaggcgggaggattgcgtgagcctgggagtttgatgctacagtgagccatggtctcaccacagcacttcagcctgggacagagcacgactctgtctcaaaaacaaagaaacaaacaaaaaccctgagcatggaaaataatatttgtgtggcacacaatatctggtaaaactagatgagctttgggactctacatgaggcttgattattaaaaaaatcattatgttaaaaaattttgttatgtatttcattatgtaaaaaaatttataagaaaataaaacagagcattaggaaattttaaaatgatgacccttttttaaaagttccaaatgtatttaaaatgttaaaggtggaacttgagcttgcttcccaacgtgttactttttaatatcaaactttttgcttgaaatagttgtactcaattcctgattttaaaaaatctttaatatgagctcttcaatttttgatcatttactaccaatgagtaactgttcatgcagaaatgtaaaagcatttttcccaaccattaaaaaatcaaaatatgaactaggcccctacctatctcaaaaatgtgatctcttaacatgttctcacacttttttttttttttttttaaattttcagagcaagatccttcaggctgcagtgcagtggtgctatcatagctcactgcaaccttgaactcctgggcttaagggatcctcccatgtcagcctcccgagtagttgggactataagcatgtgccaccatgcctggctaattgctttttaaaaaattttgtgtgtgtgtgtatgtagaagtgaggtctcgctatgttgcttaggctggccccaaactcctgggctcaagcagtgcccccagcctggcctctcaaagtgctaggattagaggcatgagtcactgcacctggccctcgcacaaatttttgtagtttcccaaggattatgcttttctttttttttttttttttttttttttgagactgagtctcgctctgtcacccgggctggagtgcagtggcaccacctcagctcactgcaacctccacctcccaagttcaagtgattctcctgcctcagcctcctgagtagctgggattacaggctcgcaccaccacgcccggctaatttgtatttttagtagagacaggggtttcaccatgttggtcaggctggtctcgaactcctgaccttgtgatccgcctgcctcggcctcccaaagtgctgggattacaggcataagccactgtgcccggctggattgtgctttttcactgtgcctttgtcagtgatactcctgcctggaatatttcaaaccagttgaaattatatcatctaaaaacttctcctttaattaaccaatataacttggaaaattttctaataatccaaacgatttttttttttttttgagttggagtctcgctctgtcacccaggctggagtgcggtggcacgatctctgctcactgcaagctctgtctcctgggtttacaccattctcctgcctcagcctcccaagtagctgggactacaggcgcccgccatcatgcccggctaattttttgtacatttagtagagatggggtttcaccttgttagccaggatggtctcgatctcctgacctcctgatccaccctcctcggcctcccaaagtgctgggattacaggcgtgagccactgcgcccagccccccaaatgattttttaatccagttgaactgtctcatatcaattatttcaaagtaatgaagatttaatttatatatgatgcatgtgttttttgtttgtttgtttttgagatggagtctctctctgttgcccaggctggagtgcagtggcacaatcttggctcaggctcgctgcaacctctgcctcccaggttcaagtgattctcctgcctcagcttcctaagtagccgggactacaggcgtgcgccaccacgtccagctaattttggtatttttagtagagacagggtttcaccatgttggccaggctggtctcacacttctgacctcaagtgatctggccacctcggcctcccaaagtgctgggattacaagcatgagccaccgctcccgacctctcatgcatgtgtgtttagggccgcacaacaagcttggctgctactgaaaggacatatcagttacggaggcatggaagtagcccatagtatgtgaagataaagatttgggactgcttcctagagccatgagccctgtcagtttgaagtagttgcacactggaatgaacactatgctctttgggcacctggaacagaaacttctccaggagctctctactgggtaatggtgcattctgtatctggcctctgaaggagaagaccacatgatatgtcacacacttggcaatggggagcagtgggtgcctgatggcatttgttgtggttgtcgctgtgcagaacaggaggcctgccatcggagcctgtcgtgccctggtccccctgtgggaagctctggaatagactgctttctggggcctgacttcatctggccacactgagagatgagagataagaggatcagtattttggggtacccctttaatccatccactttacaggctgagtatccctttttctttcttttttttttttttttttgagacggagtctcactctgttgcccaggctggagtgcagtggtgcgatctcggctcactgcaagctctgccttccgggttcacgccattctcctgcctcagcctccccagtagctgggactacaggcacccgccaccacacctgggtaattttttgcatttttagtagagatgaggtttcaccgtgttagccaggatggtctcgatcttctaacctcttgatctgcctgcctcggcctcccaaagtgctgggattacaggtgtgagccaccgcgcccagccttgagtatccctttttcaaaatacttggtaccagaagtattttggatttctaatttttttggattttgaaatctttgcatatacataatgagatatcttgggaaagggattcaagtctaaacacgaaactcatttatgtttcatataaaccctatagacatagcctgaaggtaattttatgtagtattttaaataatttgtagatgaaacaaagtttctctacatagaaccatcagaaagcaaaaatatcactatgtcagccacccatgaggacaagctggttgtttggcatcagcatcattcctgaccctaaattgataggaattgatattgataagcaatcatcttcttacatttattcacacggaagtacttaccagtaaaaaatatgaagtaccattcatgaagtgaaaaaataatgtgttcaaggtaatgaagcagcacagtggcatcaccagaatacctgtgtcagctgttagcaacagcaaacaccggactttcagtctctgcctgcaatgctgtgttttgattagaaggttactgtatactgtacaggttgagtgacccttatctgaaatgcctgggacctccaaatgttttggttttggagcattttggatttagcattttcagattagggatggttaacttgtattgcaatgtccagtgggtaaggattcctgagttagggtagtcctagatttcagttaaggcattaattattcctgatagatgataatttgaaaaaagagactcgatgatcaagtgactttgggaaatgctgtgttgaacaaagttaagtttcatgattgtagaacattccaaagactttaatatactaatacacactataaatgaccatatagaactacatataaatattatatataaaccataatattcagagttttccagacatttttgatcactgaagccttttattgagaagctctggctgggcgcagtggctcatgcctgtaatcccagcactttgggaggtcacgggaggtggatcacgaggtcaggagttcaagagaagcaccttgaggaatgagtgttaaacagaacacagtttagaaaatatattgataagaagttattaaaaattcatgccttgcaggctgtaaatgcactttaatcagagtgccatttgttttgttcaaatgttttaaattattggaatgcacactttttaaaatatgcaaataaagtttggaaactaaaaaataaagttagtgcctgttctttagagatggaaggataaaattataaattataagttttacctatttcaaaacaaaagtcagcattatacttattggtaaaagactagtgttctagattattaataataataattatatttttataaaatggattattatcactttatgcattaatgttgctttggtagtgctggccagtgccatgagtcatgacagagaaataagatacaataagaagataatacaaaaagtattattagaaaatataaaataatcaactgaaagattttaattaatacatttttcaggaaatatataatcaatagcaaaaattcaatttttacctcaaacacttgaaattacagggctcgaaaaaatatttcatcacaatatctacaaaacccataaaatactcaggcatcatcttcttggaggattgtgtgtgacttacatgacgaacctcaaaatatgtaatatttaatttagagatctataagggatatatatatctaaatatacacctcttagatgtgaaaactattctaaaatgttaattctcaatgtatagctgattgcaatagcaataaaactttcaatggtatttcatttggaatttctaaattgtatatggatttctgtatttcctttggaataataaattggtattgatgaacattcctaaaaagaggctaatagagtggcaataaataaaatgctatggtaatggcacaagactagaaatgcaaatcagaatagaattaacagaatggacaattgatagaattaatctcaatcacataaaagatgataatacacgataaagtgcaaggaatcaagcacctggtaaagtaggaaaagctaatctttcactttgaatcacatcaaaataaacttcagatgaattactcagtgtgttgtccagtgtcaaaaacaaaaaacaaagaacaaacaaacaaaccacagtaaatctatctgtaaattgttgaagaaaatagaattaagtatttgccagacctcgagaaaaagggtgatttttctttgtctctctcttgggcctttcaaaggataagtttctcaactttacagtatgagaagaaatctcaacagatgtgactacctaaaaataaaggataatgtacttttaaaatgaccttaaatttaaaaaccaaacatcagctttgtgcagtggcagtgtcgtaaccagagagattttcccaagatactgttatggctaataagaaccttgctagttcaactgtgttcaactcgttgaatttcagtgagataaggcaaatatacaaaggtgaattgggcaggattgttcaataaagaattgattattgattataataatgaaaaatcagaaactaaacatccacaattggagggttgattaaatacattttgataaagctctataatggaatatcaggcagtcactaaaaataataaggtaatgaatatttattgagaatgaaagatccaatttattgctgagtgagaaattagattagagaacaacattaaaagtagttaactctgggccgggcgcagaggctcacacctgtaatcccagcactttgggaggctgaggcagttggatcatttgaggtcaggagtttgagaccagtctgaccaatatggtgaaaccccgtctctactaaaaatacgaaagtgagcttggcggtagtggtgcacacctgtaatcccagctactccagagactgaggcaggaaaatctcttgagcctgggaggtggaggttgtggtgagtcgagatcatgccactgcactccagcctgggcgacatggcaagactccatctcaaaaaaaaaaaaaaaaaagacaaaaaaaaagaaaaaaagaaaagagtagttaactctgggtagaatttgaagtgattttaacttaaactttcatctgtgtctttttcctccagtaattgtgtatgattttgatcatcagaaaggaaatggagctgttttcattttagaaaaacaagttcaaacaactgacctggaaaattgtttgcagtaacttcgacatagggttaagtctttattattcaaacaggtcatgcaaattgtaaagaaataattgaagatcccagtagggttgagcagagaacatgaatagacaattcataacatagaaaacagagatggtaaacaaacatatggatcattattcagattcatttgtaatcaaagcagtgtaaatttaaataatgaggtaatatttatttgttgttaaattagcaaaagtttattgctgtgttataataaagaaaaaataatatcaataaattatggtgtattattttggtaccattaaaaatggaaggttgtgtaaattatgttgcaacctggaaaaatataacatttacgtgaagtaattaaggagttaagattttatactgtaagtactaacaggtgggatggggtggagtgaggtgaggtggggtggggtgtggggggagaagagcaggattgttcaaatgaggaagatctgagttcagtccagctctgccactcaataactctgtgatcttgggcaaggtgcttagcctctctgagctttggtttctttttttctctacggttgtaaaagtatatacagtacctgacgtagaacctggtgtatagtgtttattcagtacatatttgttgagtgagtgaatggtagttattcaatgccatatataaaagaatatgtatgaagaaagattggaagaaaatacagcaaaatgatgagtagttatgttagggggaagagaatttgactgattttaaaatttcctattttctactattgggtggtattatatttctaattgaaataattacctaaactcatgcctaatctctttctttctgggtgtcctactgtatttactgtttgatacattttgacacctttttcttttctttgagacaaggtctggttctgtcgccaggctggcgtgcagtagtgtgatcatggctcactgcagcctcgacctgctgacctcaagcaatcctcctgcctgggcctaccaaactgctataggcatgagctcccatgcttagcacaatttagagacttaattacattattgtcctttattctttcactcagccaaacaccttggagttggccttaacccttttctttctctctgcacctaacataaaatttatcagcaaatcttgttggctctgctctttagaatatatccagaatctgccgggcgcggtggctcacgcctgtaatcccagcactttgggaggctgaggcgggtggataatgaggttaggagatcgagaccatcctggccaacatggtgaaaccttgtctctactaaaaatacaaaaaattagctgggcatggtggtgtgcgcctgtagtcccagctactcaggaggcagaggcaagagaatcgcttgaacccgggaggtggaggttgcagtgagccgagatcaagccactgcactccaacctgggcaacagagagagactctgtctcaaaaaaaaaaaaaaaagaaagaaagaatatatccagaatgctgacatttctcaccaccttcactgctaccattctggcccacatctctcacctggagtattgcagaggcctcctgactggtctctctgcttccacccttttcataatagccaaagtgatcagcagaccgcatcactgtgctgcctggaaaaacccttcagcggcttctcatctcattcagagtaaaagccgaaatccttaaagtagcctacagggctttttttttttttttttttttttttgagatggagttttgttcttgttgcccaggctggagtgcaatggtgcaatggcgcaatctcggctcactgcaacctccgcctcccaggttcaagcaattctcctgcctcagcctcccaacttgctgggattacagttatgcgccaccatgcctggctaattttgtatttttagtagagacagggtttcaccctgttggccaggctggtctcaaactcctgacctcaggtgaaccaccctcctcggcctcccgaagtgctgggaatacaggtgtgagccaccgcacctagccaaggcctctttacaatcaccctcaaactcatacctttctgatcttatttcttactcttctgcacttactgttctctctgcctgaaaactctgcagttgttcataaggctggttccttcccctccttcaggtgtctgcccaagggtcgccttaccacagaggcaggcctctctaagaccaccgtatcaacccattctcccccacccacgcccagcactcctcgtgtccctaccctgtttattccttcctctatttctcacaccatttgccttactatgtattttatcgaatattacgagcttatatttctttcccaataaaagtagctctatggaggcaggaatttttttctattttgttccttgccataaccttagcacattgtaagtactaggtaactgtttactgaatatatatatgagtgtttcatatatgtaagtcatagtccaaaactagtttgaaagctttttgagtaaatgtcatgttggtttttatgcctttcttcccccaactccacaagcaaagaataaggcaaggtaggcagggaacactgttgataagcaaacagtatctgtttttattggtttcactgtgcctctcaggctacgactctacccaaaggacttgagatagagaggccgctgctggaaatattctgtcaccgtgattggagtggttgagtggttccatgagtatatgcgtatgtaaacacttaattaagctgtgtatttaagatcagtgcacctttaccatatgtatattttgcctcagaaaaaatgtttacaaatacagtgtatcctttgacatctccagaggaagttaaacatgctaaatgatacataaatataaggagagggttcttcatatgcttacttattaagattgctagtctggttattagaatttttgttttgaattcaaagctaaagtaaactaatttttatttactttgtcttttgcagagataatagtagcagaatttcacaaaaaaatcaaagaggcatttgaagtctttgaccatgagtcgaataatacagtggatgtgaggtgtggaaatatttttttttttgttacacttttaaattactgatacaagtcataagatacaagagagctattttctctttttacactgtaccttggatttattatgctcttttaagtatttattttccatgctccgtaaaaggtctttgctagctattgctttgataagtactgtttcttattcttcatactctggtagaaacaatatactgtattctcattgcctgttccaacctataattgtaaactctgtgactgagatgaactctattttagctttagtgcttggcacatagttggtactcaggaaatagtcgttgagtgaaggaacagcatttgctttgtaaaacacataaatatgtattataaggccacaaataggatattgcaaggaaacagtaatgcttatgcgatgacacactccccctgtaaaatagcaaaaagaacccaaacagaagaacataaaaaggcaagagaagacatgaatactggtaggtctgaaatggaggacacagcttgggactgaaacaaaacaaacaaaaaaccccttaagagaagagattagacgctaataagaattgtagggtttgtgccacacacatcaaagaaaagcaatgaagccaggcgtggtggctgacacctgtaatccaagtactttgggaggtcaaggtggacagatcacctaaggtcaggagttcaggaccagcctgaccaacatggtgaaactctgtctctactaaaaatacaaaaactagccgggcacgatggcaggcacctgtaatcccagctactttggaggctgaggcagaagaatcacttgtacccgggaggcagaggttgcagtgagctgagatcatgccactgcactccagcctgggcgacagagcgagactctgtctcaaaaaaaaaaaaaaaaaaaaaggcaatgaaaccatcctttcaggaggccgggctaaatgagggttatttgatgagattgcaatctcaagaccagaacctagtagagaggccagcaaagcagtgggaagtggtttgaaaatggttctggaaaggaactgtttgatgcttataaaccagtgccatcagagctgcagcaccatacagctccggtggctgtggtcacattgcattctgtgggaatgacattgtggaacaccaggccttcctgtgggtatcccagtaggaaatgagtgggcagggtgctggtggtggtggtagggttagggagggggtgcagcaggcagcccggcctgcaatttgaataactaactacatgaatgacaagtgccttgacctcagacctctccttgaagggttctcctcctgggggcgggggacagaggtattgttagagaagtcagggaaagtatggcattatgagagagagggaaaagagagaaaagaaaccagcatctgcttgaggcttgtcatctaacacactacgtgtagttgggtgccagaggcttcacgtggattacctcattttaatctttttatttatgggttaagggttggcatctccggtttccagagacaaggagaaggtaaatcgtttgctccatgtcacaccaggtttctctaacgccaagtctcttgctacactgtgggcatgccacactgcccacactcccactcctactctttagagacatcaggggcttctcttctgccttcaggcttcctgacagtagcagtgaaaagaaaatctcccgatcactgacagcaatgatgccaggccttttttggtaaaagggccaattcagtaaaagaaaacgtgtttatgggctgaatctttttttccattgaaagttaaaataactttaccgaggccctgagggaaagtggatgttcttacaacctaaagagtctgctttgttaattaaagatggttactaagaaaattgttattgtttttagcattaaaatattgctgctgagtatatttgaggaataacaacatggatgaatgtagctttataatttttcctgtgttaatttgtatatcactttaaagtttataatgaatgttctcatgctgctggtatcattaccatccactctttttaaaaaattcgtttaaagatagggtcttactctgtcctccaggctagattatagtggcttgatcataactcactgtatgtaaccttgaactcctgaagtgatcctcctgcctcagcctcccaagcagctaggactaccacgcccagctaattattatttcttgtagtgacaggggtgttgctatgttgcccaggctggtcttgaactcctggcctcaagtgatagaccctccttagcctcccaaagtgttggtattacaggtgtgagccactgcactcggccactctttataaattggaaattaagctttgggaggccaaggtgggtggctcacctgaggtcaggaattcaagaccagcctggccaacatggtgaaacctcatctctcctaaaaataaaaactaaaaactaaaaaataaaaataattagctgggcatggtggtgtgcacctgtagtcccagctgcttgggaggctgaggcattagaatctcttgaacccaggaggtggagattgcagtgagctgagattgcaccactgcactccagcctgggcgactaagtgaggctttgtctaaaaataaaaaagaaagaagtgtctttgaacggagggagagatatgtaatggctcagtgggggcaggacagagagagctgttcctggagacgccccccgcccccaggcactggctgttcctcccctaactgctttatccctcaggtggaggtttggtgttacttcctgtgtagggctgatctaggtcccctgagaggtctaggtcttagaattttgtggtggctactttccctttcccttatctctgctttgcacaaattgaaatatttgatttgaaattgtattgcattagataaagggaaagtctggtattccaaatgctgggcagccaccagcccactgtcaaaagcattatgagctgggctcctgctactgcccttccacctctgaggggcagtcctgaggtctggaatcagacttcctgggttcccatcccagctccgtgactgcgagtcactttgttattctctttgtgcctccatgtacctttgcctcctaggtttcatagtataagtaattagttctcagagtgcccccaagaccctttccggggtctgtgaagtcataactattttcataataaatttaagacagtatttgttcttttcattctcactgtttccacaagtatatactggagtttttctttctttttttttttttttttttttttttagacagggtctcgctctgtcacccaggctggagtgcaatggtgcaatctcagctcactgcaacctccgccttccgggttcaagcaattctcctgcatcagcctcccaagtagctgggattacaggtgcccgccaccacgcccggctaattttcgtatttttttttttttttagtagagacggggtttcaccatgttgtccaggctggtcatgaactcctggcctcaggtgatccacccaccttggcctcccaaagtgctgggattacaggcgtgagccaccacacccagccttatactggagtttttcaaaggctacatgacgtgcagttttacaacagattgaacgcagaactagatatgagaatgcagctgtcctctgtgaagccaggtgttacatatttacattgaacgtatgtaaaacaatgtaaaacaatgccattcttctaaatatactttttgttttggaaaatatagtttaaaaaattaacaactatttatgtaaacatttgggttgatttatgatttttaaatgaattaataaatacatatttttaaaatgtaagctttaatttctaatatgatagtaaatatagatgcatataactcacacaaacatagacgctttgagcgccttgataatttttgatagtttgtaaaaggagttatcagaccaaaaagtttgagaaccactattgtgagtggacatttttaaagctcttagaacaatattagcttgggatttaaagctaagaacagtattagctattataattattctactttatatatatatagtttttattattattattttgagatggcatctcactgtgtggctcaagctggattgtagtggcccaatctcggctcattgtaacctctgcctcctgagttcaagcaattctcctgcattggcctcccaagtagctgggattacaggtgcccaccaccacgcccatctaatttttgtatttttagtagagacagggtcttgctatgttgcccaggctgttctcaaactcctggcctcaagtcatccgcctgcctcagcctcccaaagtgctgggattacagacgtgagccactgtgcctggccccattttatgttcttaaagtaaataactcagacttgttttgcccctgtttaatctggatgagcaatgttatgctgtatgtaacaaaactctcataagaactttaaaatacatattttgttttagagacaagctctctttatgttgcccaggctgaccttgaaaccctgagctcaagcgatcctcctgtctcagcctcccgagctgggactataagcacgtaccacacctggctagaactttttacttatttccgtatgttccatatcgatctcttaagatctgaagcattttattttcctttttcatttccttgttaaatagttttcgaaagctagcgccttgaaaaacattgggcaggttttcaatatcactaattagggacattctgattttgcctcatataaaacacagactttttttttttttttccagacagtctcactctattgcccaggcaggagcgcagtggagtgatctcggctcactgcaacctccacctcctgggttcaagcgattctcctgcctcagcctcccaagtaccaggaatagtgagattacaggtgtgtgccaccacccccggctaatttttttttttttccatacttttagtagagacagggttttgccatgatagctaggctggtctcgaattcctggcctcaagtgacccgcccgcctcagcctcccaaagtactggaattacaggcatgagccaccgcacccagccacattttcatttatatatattttcctgctctgtgtttagaagttaagaagactgattgaaaattaaatttttgaatagatgatatatgtacatgggataaaattctaaaggtagaaataatatatagtgataaataaatctcttttttacctatccagttcccctttctaaaggcaaagtttgttacagttttctctaattcttccagagattctccatgcaaatatgtatgagtatgcatgtgcatgtgcgtgtgcgtgtgtgtgtgtgtgcatgtgtgtattttttactgtggtaaaatatagataacctaaaatttatcattttaagtacagaatgcagtggcattaacattactctacaaccatcaccgctatccattttaggctttttcatcttcccaaactgaaactctgtacccatttaacaataattccatatcccaccctctcgcagcctgtggcaaccaccgttctgctttctgtgtctatgagtttcattatcttaggtgcctcatatatcaatggaagagtacaatatttgtccttcctgtgcttgcttgggcagcacatatactaaaattggaacgctacagagattagcatggcccctgcacgaggatgacatgcaaatttgtgaagcattccatttttaaaatacaaacaaacaatatttgtcttgtgtctggtttatttcacgtagcgtaatgttctcagggttcatccatcttgttgcatgcgtcagaattttattccttttttgaataatattccattgtatttatatcccacattttgttcatccatctgtgtattgatggacatttgggttgttttcatcttctgactgttgtgaataatgctgctatgaatactggtgtatagatatctgttccagtctctgcttttaattcttttgggtgcatatccaggagtggaattgctggatcatgtggtagttctgtgtttgatatttgaggaaccactgtactgttttccacagcggctgcgccatgctgcattcccaccagcaatgcccagagattctgttttctccacatctttgccagcacttgtcatttctgttggttttttggaggggggtgttgttgttattgttgtttctctaataaccatcctactgggtgtgaaatggtatctcactggggctttgatttgcattttcctaatgattagtaatattgaacatcttttcatgtacttattggccatttgtacatcttctttggagaagtgtctagtctttgcccatttttaaaccaggttgttttattttgttggtttttgagttgtaggatatgtgtttatttttaacgtgaatggtatgatactatataaaccattctgcactctgctttttttacttatcaatatatcttgactatttattaatatataaaaattggctgggcgcagtggctcaaacctgtaatcccagcactttgggaggccgaggtgggcagatcacctgaggtcaggagttcaagaccaccctggccaacatggtgaaaccccgtctctactaaaaatacaaaaattagccatgcatgatggcgggtgcctgtaatcccagctacttgggaggctgagacaggagaatcgtttgaacccgggagacggtggttgcagtgagccgagattgtgccactgcactccagcctgtgcggctgagcgagactcttatctcaaaaaaaaaaaattatccttatttcattgtatggatgaatcataatatattgaattaatctccttactaatggacgtttaagttgtttccaggcttttgctataatagctcatgctgcagagaatatcttagcatgcatatcatctcacaaaagtgagaactttttctcggtaaattattggaaatatgtcaaagggcttgacaatttttggtagatgttgctatcttgatgatagagtctctcatcttgtgtgagagtaccagtttcttcagtccttctgaaacaagctttaattatcaagcattgggattttttcccaatctaatatgtgaaaaatagaaactcagtgttaattttctttttcttttcttttctttctcttttttttttttttgagacagagtctcgctctgttgcccaggctggagtgcagtggcacgatctcagctcactgcaacctctgcctcctgggttcatgccattctcctgtctcagcctcctgagaagctgggatcacaggcttgtgtccacctggctaatttttgtatttttagtagagatgggggttcaccatattggtcaggctggtctcgaacccctgacctcaggtgatccacccaccttggcctcccaaagtgctgggattacagacgtgagccaccatgtccagcctaattttcattttctaaattagaacatctttcatatctcttaaaactgtttgtatttccttttgtttgacctgacagtttatgatttttccccatttcttcccactgaattattgatctttttctatatgaaaggtctcagccttagtcatgatgtgtctgtcatctatcttttcactctacttttactttctggcatgcagatttttttttttaatttagtcaaattacacacctttggagtatggatttaatttttggaaacaaacgaatgtcatttcgagtagttttagtagaataaatttaggttcccctaaataaagctaatttggtggggacaaaatacacccacaaggagtgcctctaaggtaaagaagataatttttccatgtagctgataaatttaatttgaaaatgactctaatcttattcacaaacaaatccagtttttttgtaatctaatggaataaaagtacaccacaagtccgtagagacagttgctggctctatcatgcattttctatgtgtcaccctctttttatttcattttccttatctataaaattgaaataaaaatgccagcaccacttaagccacaagagtataagaatatcaaataaaaaatatcaacttactttttttaacactccattctaatcaatttcagaacaggttgatactcaagaatttggtgagctaaaatgagatggggcccaatcctggaataaaagtgccaatctttcccctttcccaagccacacccatctgtcctgttcctatgcttcaatgcctttacagtgcgaccttatttttagtattccagactattctgtgtgatatggtttcactgtgtccccacccagatctcatcttgaattgtcgctgccattatccccacatgttgtgggagggacccggtaagaggtaattgaatcataggggcaggtttttcccatgctgttcttgtggtagtgaatcagatgattttataaagggcagctcccctgcagacggtctctttcctgccgccatgtaagatgtgcctctgctcctccttcgccttccaccatgattgtgaggcctccccagccatgtggaactgtgaatccatgaagcctctttttctttataaattacccagtctcgggtatttcttcatagcagtattagtggtatgagaatggactagtacactgtgtttactttatacctgccctatctataggagattttccctaatattttcttaatctttagacaaattttgcagtccagcagcaccaagtatccacttgctaatacagtgagtctcttttttcattgcttccatcttcaactcagtataagtctctgaggctcttggtatccaatatttatttcttttactgatagggagacttcagcttcgttagcaattggcaggaaccttgagtgtactaggtcctgtctaaaattctgtaagaaatagtaacaataacttatttgtaatggattagaaataacttttcctaggagcactggaggtaccataaatattacttttacttcttcacatatagtgctgttttgaagagatattaaaataacatttcgcaattcatgtttatcaggtagtagaaagtgtgagcaatgtggagagattgcatggacagttcccccaagacagttattatctgagaaagctggaagctactcagagagctttataaaaactgttatcgatactgggtctgcatttgtgcaatggaaaaacatggaagaggaatgggaattgctgggtccacacacccctcaataagaaatgaattgtaaaaacaggtttattcatgcagtgattgttcacatgtatgaatgaagtgaatgatgaactaagactacatgtgtaacttggataaatctcaaaaaacaacgttgaatttaaaaaattacaaaaggacggaaacatagtaccatatatatacactttaaatacacaaaataatagtaaatattgtttatgaatacaaatatatgcatggaaatgataaggattatcctcagaatagtggtgtgattgcatctgaagatgaaaggagaagggatgaggagtggaatgttagctgtttctgcaatgctttcttgtcaggaaaaaaattctgaagaaaatgtggcaagatgttaacatctgttaaatcttggtattggctgtcgtattttctcctgtacttttctctgaaatactgtacaactacacataaaaataaatatttttaaaagagtgatttatatcttatctctttaccatctcactttgtagttgctttgttaaaaattggtttcttatcatggtccttttgatgaactgggattaaagaaaagagtcaaagagaattttttaaagtcattccaaattctacttcctgaaataataatttttaatgttagactactattattctagagctctttctatccctgtgtaataaaataagtggatagaagggtgggaaattaatgagaaaggaagaaggaggaaaggaaaggaaggaaaaagatattgaagaaaaaatctaggatataatcttcatgtgggaaggacttactttaattttacttgactgggacaaaagaaaaaaaattaagttgaagaaattgtggaatctcaaatgtttgttagccataagagacgatatttattttaagttcagaaaagattttgagaaaaacattaagagactgtagtccttgtgtgtttttttaaactatctatttcgaatataaaaagtgtcagttgattccttgctgtgaaagataaggacattagcacttccaaaattctgtctacgttttctctcccaacccccaatttatcttaggtatatttttatttttacactgacaaggtagaatgttcatactttgtttagtattcacacatattttagtagttttgtatatttgaatgaaattaccactaaccacattttctcatttttttctccatccttgaattctttgatttatttttgtgtgttgattctcttgtcagtttttttttttttttcaggaagtgctcatggatgtttttgagactgggtctccgtctgtcacccaggcaggaatgcagtggtgccatcacggctaactgcagcctcgacctcctgggctcacacgatcctcctgcctcagcctcctgagtagctgggaccacaggtacacgctaccacacccagctaaattttagtttttgtagagacagggtctccctatgttgcccaggctgggcttgaacttccgggctcaagcaatctgcctgctcagcctcccaaagtgttgggattagaggcgtcagccaccatgctgagcctcttttatcttttacatgttttttttgtgcttgaatactttttacttgaatgacatcttataaatttacacaatcatttctcatggctaagaagtgttccaatgtgtaactatactagaatttaacatatttcctaattttagaaatgtaggttgtttgtaatatgatgctgctgtaattgtgactgggctagaattattagtgtggaacttttcaaagatcttatttctctcctgcactgccaaaaaataaaccctggatgcccaatttattttatctttaccttttcttaaagaggaatattttttttcttgttgggagaagagatatgtcaatcattatagttacgttctgagagtgggatggtgtgcaggataaagaagaaacccactctgaccgagactggaagaggagtttgttaaagatgtgggggaagtaagatttgagagagaggagtggaacttgagcagttacagaatatgaaggagcaatcaggaaaggggattacagcttaaaagtttttgaatagataatatgttcacatgtttaaatccaaagagaataaaattcaaagaaaagtccctgtaactcttttccaccagtcacccagttccctctaaaatattggcaaccagaatactagtttctagggatcactccagattctagccatacacaaggaaatgcaggtatattattttcttataccctgtttttactgaaatggttacttactttcatactatggtatgattcccatggagtggggtcatatctgtgatgaagcttgcttttatggcttttctgtagcgttcggggatctggaatggaggtagctctccagttcaagcttaggctaagtggcataaatgccataagggttaatgtattggaggacatcacaaagggcatggggtcggtcctagatatcccagtaggctatgttccaggctttacagatgggagttaataggaatggcattgtgacaagaaaaataacatttggattcaggcttccctcttcagggcccattactggctgttttaataaagaaggccatttctgtatctttggaggccaactttggttgactgtggattacaggtatctgtctgtttttgtttttgagatggagcctcactctgtcacccaggctggagtgcagtggcctgatctcagctcactgcaacctccacctccccggttcaagcaattctcttgcctcagcctcccaagtagctgggattacaggcacccgccaccatgctcagctaatttttgtgtttttagtagagaaggggtttcactatgttggccaggctggtctggaactcctgacctcaggtcatctgcccatctcagccctcccaaagtgttgggattacaggtgtgagccactgtgcccagccctgtttttttttttggaaaaggaatctcgctctgtcacccggactggagtgcaatgatgtgacctcagctcactgcaaccttcatctcctgggttcaagtgattctcctgcctcagcctcccaagtagctggcattacaggcaggagccaccacgcctggccaatttttgtatttttagtagagatggggtttcaccatgttggccaggctggtctcgaactcctggcctcaagtgatccgcctgcctcagcctcccaaaatgctgggatcacaagcatgagccactgtgcccagcctattgttcttattggactgtcttgatcaagtgcaaattttgctgtatgatttcaaaagtggggagccagaggctgtctgaggattggtggtttcagagagtgtacttcctgaggcctctgggtgtgtaccctctgtggcttccagattcattcgtcctgcagcctcaacctattctccttaacagaggaaatctaatattagattcactcgaaaagtgtggaagacttaatgcaaatgcaccacaaagaacagctcatggtagtttctttattagctttgaaatatagaatggacacaagccagaaagtgttactgtgtattcctgtggccccacacttgtttggaaacggggctcctttttatcattctgttggtcatgctctgtcaggttggatgggaccaaatattctttaagttttctcagttcgagcaagtttcttgtaaggacgtatttggaaataagtataagtgatagaaggtgttataagtaatccagagaggatttaaagtatatggaaggatgtgcttaggttatatgcaaatactatgccatttaatacaaggaattcatttgtataaggaatagcaaaaagtcccctcagcagcattccagcctctcagtgtactggaaggacatttattgccattagggtaacacaggggctctcgtatttcaagtcactctggtgactccacatcacctggtaatctaacatgctggtgattctactcacctgcttttatttcttcttttccagattcttcctattttgctcccgactgatttgatcctgctgtgtgtctcctactcctttgcgtctacctcctcatgggttcagatgctttgtgattctgcacctgccttctctctctgtgccgttcctcttccatctctcttccatctgtatgtcttgctttaaaactcccaaggaaaaaagaagaaaagtcggctttggtcatttgtcaatattcagtagtgtgtgcctttgttgagcagagctcaactgcatcagcccctctcttgcacacctatagagggacgccttattttggttaagtagccatctctggttcaagtatctgtgcctagggaggcaggtccaatggtacaaagcatagcaacctatacattcagaaactctggggagggaagtgtggatttggcagagaccttactgctcatctgatatagttaccccaaatcctaatgaggttgtttgagcctagtgttaggccattccaacacagtttctaggccaacagttggaactctgtggtaaactcaccggtttattaccatccccctccctggtagtgctagtgattcatgtcatggtggtcggctgtggtggagattgcatagtctaattctgtttcctctcctcctgagcacatagctatactgtaattcccagattctcttgcagatagaggggagctgggaattatggtctagctagaccatgtgacctagtttttaccaatgaaatgtggatggaggtaatgggtgctacttctaggcccggtccatggaaacctcccacgtgggaggtgcttttccctttacagcttgatatatacagtatagtgacattggaagccatatgttgaaaattatggaaccacaagatggaaggagctgggtccctgaatgagttgtcggaggaaagccatccaccgatcaggaaaatccattttggattttatgtgagccgtctccatgactattgtgttaagccactggaggctggagtttgttacagcagtggctgttatcctcacatagtggcattattgattttgctccacagggacccaaggaaggctttgggctccttaggtatcttggtgagcactgtcccaggcggaagttggttaacaggatggcccccttcagggagggctgatggggtatgggagagcgaccatcgctttgctactcctgataagcatgacataaagaatgtctctctttaagccttcctccccgaatcccaagctgtggatatcaatacatttgtatagattcatgcgagagttccagagtattctgaaactgcctctgaatttatttgcagaaaggtaggggttagtaactagtgataccactttatgcacagagcaagtaaactccatctttaccatggccaactgtagcaatagagttcagtgttttctatatcacagatagaagaagtaacaaaacttcatccatttcatcttcatatatagtaaggcgaggtgtctgagaggcaggggtgagaaagacaagactggcatgcatggtattgaaatggctgtgaaagggagaagatttgcttatagtagcagggcccaggtagcatgggaattcattacttttatctttaaaggggttagaaacaagtgttcagaggtgccatgcagtaatgaaaccagtccaggagccaggctgtaagtgctgtaattcaagtaagcttttggttaatttaaagggatggtagttacaccagctcctaacccatcgccatcttctgtttcatgtttttgattactgagaagtgacactcaaatgtttattttttcttaaaactactgagtacattttgtaacagctccagtttctactgagagctcatttatgccatatttcctttgctcacataactctaagagtacttctgttttttactgaaagcttgtatttctgtctctgctaagttataaacttactgatgacaaaatgtatttattatttgagttctgtaacgcatacaacattgccttttctctatatacagtgtgataatattagctgggggtatgtaactagttgtgtggtgttattaggaaatgaatctgtaaaggtgggctggggccattcagtgaatgatcttgtctgttgctctaggatcctggatttcattgtgtaagcaatacaaatccataaatgctgagaagggataagatgagatttgggcttttagaaagaaaaccctagccaggtgtggtggtgcacgcctgctgtcccagctacccaggaggctgagacggaagattgcttgagcttgggagttcgagaccagcctgagcaacatttcaggattaaaaaaaaaaaaacaaaaacccaaaaaagaaagcaaactctagctttaggatggtagatccattggcgtgcggaccagagcagtagttcttaatcctgggtgagcttcagagcggcctcacagcacggctagtccggtactgcatgcgaaggagcagcacagagctggcacacggcgggctctccaacccaactggacctggtgacctttatgaacccgcagcccaaagccaggcagaatcaaggaggtctccacaggtgccggtgtgggtagcttatgggccttagccacaccctggcaagtaactatcccttttcataacaaagctttcctgggcacttaccctgccaactgtattctgccgagttctcctctcccggaggcagtgagcatggaatgcccttgtctacgttgggaaaaggatataaaggattatggatgaaataccttctcccacaaacgccttctatataaaacaaaactaaaaaatttccacccactaaaacccctggctaaggccctatgattatctttctctttacagctaagaatcttaaaaaagagtttgctctttattgagcactctgttccttcttcaacgtgcaatttgtaatttcacttctatctctccgtcccatcctgttcaaactgtttttcctgaggttgttgtctcttactttatttttcatatgattgtcttttgttttcttttcttttctctcttcctttcctttcctttctttctttcttttttcttttttttgacagagtctcacttgcccaggctggagtgcagtggcgcaatctcggctcactgtagcctctgcttcctgggttcaagtgattctcctgcctcagcctcccaagtagctggaattacaggcgtgcaccaccatgcccggctaattttttatttttagtagagatggggtttcaccatgttggccaggccggtcttgaattcctgacctcaaatgacccacctgcctcagcctcccaaagtgctgggattacaggcatgagccaccacagccggcatcttttgttttcatccaacacctctgactcttttttctcagcctctgctttgggacgattatctttctatctggactattaatgtctgctagagtttcatctccatccttcttttcatttacaccctttctgggaaatctcttccatacctaaatctgtatcttaacctggaaaacatttttaaagtctatataaaaaaagcccttcttagttcaaaggtaaaattttaggaaaattaaattgaaaacttataagaaaataacaataatggaaactagatttgaaaacagaaatgacaggatgggcgcagtggctcatgcctgtaatcccagcattttgggaggccaaggcaggcgaatcttttgaggtcaggagttcaagaccagcctggccaacatggcgaaaccctgtctctaataaaaataccaaaattagccaggcatggtggcatgcacctgtaatcccatctacttgggaggctgaggcaggagaattgcttgaacctaggaggcagaggttgcagtgagccatcattgtgccattccactccagcctgggtaacagaatgagactccatctcaaaaaaaaaaaaaaaaaaaaaaaaaaagaaaagaaaatggaaatgatgttagaatctatgagatacaaccaaattaagactcattaaatgcctatataaagaaaaatgaaagcatgaagaaaatgaacagaacatccaactcaaaaaagctagggaaaataggtaaactgaaagaaagcagaaaggagaaattaatgaagataaaaacagaattaatggggttgggaaacagtgtaacagtaggaaccaataaatgaaagttttttttttttttttgcaaaagtttaatagaaagataaatcactagcagtgtcttatttgggaaaggacaaatgcaagataacttgggagacagaatgattaaaacataggaaaatttcaaatctaatgagagtcatttgtacaactctatacaagtgaatttgaacacctagctaaaatggtcaactttctagtaaaatacaatttgccagaaccagtcctagtcatatgtatatagattggaagagttaatattgttatgattgcaatactccccaaattgattaacagattcattgcaatctctatcaaaatcctggttgcctttttttttttttaaacaaattgacagttaattctaaaattcatatagaaatgtaagggacctagaatagccaaaacaatcttgaaaaaggataacaaagttggactcccatttcccgatctcaaaatttactgaaaagctacagtaattaagactgtgatactggcatgatgatgtaaggctagacacatgcatcagtggaatagaattgagtctggaaataaacccttacacttatggtcaattgatcttcaataaaggcggcaagacaattcgatagaaaaaagaatagtctttacaacacatgatgctaggatgactgaatatccacatgcaaatgaatgaagttggaccctaccacacaccatatatgaaaattaactcaaaatggataaaagggctgggcacagtggctcacgcctgtaattccagcactttgggaggccaaggcaggcagatcacctgaggtcaggagttcaagaccagcctggccaacgtggtgaaaccccatttctactaaacatacaaaaattagctgggcacggtggtacacacctgtaatcccagctacttgggaggctgaggcaggagaatcgctggaacctggaaggcgggggttgcagtgagccgagatcacaccactgcactccagtctgggcaacagagcgagactctgtctcaaaaaaaaaaaaaaagaagaagaagaagaagataaaagatctcaataaagagctaaaatcgtaagacccttagaagaaaacattgatgtgaatgtttgtgactttggattaggcagtggtttcttagctatgatacctaaaacaagcaacccaagacaaaaatagataaattgaatttcaccaaaattaaaaactttgtgcttcaaaggacactgtcaggaagataaagagacaagccacagagtgggagaaaatatttgcaaatcatatatctgataaggggtctagtacctgtaatatataaaaaactgacaacaataaaaagacaacccaattaaaatgtggacaaagtatttgaatagacatttctccaaggaagattatttaatggccaaaacatcacatgaaaatatgctaagcatcattagtcatcagggaaatgcaaatcaaaaccatagtgaaatactactttagatccactaggatggctgtaattttaaaaatgaaagatagcaaatgttggtggaaatataaaatggtgcagccactttagaaaacagtttagtagttcttgggaaagttaaatgtagagttaccatatgacccagcaaattcattcctaggcgtatactgacgagaaatgaaaaaatatgtccatacaaaaacctgtggatgaatgatcatagtagcattatttatactagccaaaaaatagaaacaactcatgtcaatcaggtgatgaatggataaatgaaacgtgatgtatttataaaatagaatattgttcagctataaaaggaatgaagtactgatgtgtgttacaacgcggatgaacctaggaaacattctgctaagtgaaagaagctggacacagaaggccacatgtgtatgacatttatatgaaatgtctagagcaggcaaatctgtagacacacagatcagtggttgtgaggaggtaaggggagggagggatggacgtagctgctaacaggtatggggattctttatggggtgattaaaatgttctgggattagatggtggtgatggtagctcaaccttgtgaatatactaaagccactggattacacacttaaaaaatcaattgatgaaaaagcaaaacaaactgatctcacaaagatagaaactctaaacacaccaatttacatagaatcattaggcaagttttcagagttctctcaccaaaaggcttcaatccagatagtttcacaggataattctatcaaagaagaacattttagctctagtgctacttcatctctttcagagaatacaaagtaagtataatgttgacaccaaaaacttaaaaaagactgcattaaaaaatcttacaaaacaatcttatgaatatctgtacaaaaattgtagataaaatgttagcaacaaaattcagtggcacacataagcaaatggagtttattccagaaatgtaaaaatagttctgtgttgggaagtttattaatgtaattcatcatataaacagatctgtgaagaaaaatcataggatcatctctatagaggcatttgacagaattcacacattcataattttgaagactcgataaagtagaaattaaggacatgatttcttagcataaaatatgtgtgtttcagcccaaaatctagtttcttacttaataaagaaggcacaaacagcattttcattaatgtcaggaataagataaagatatccgcatttgctgttattatttagtattgactagaggtattaagcaatataattatataggtgataacagacacgtaagtatttgacgttaaatggtagaaggtagaaaagatagaagaaagaactatctttattcacagatatatgattaaatatctggaaacctcaagaaaataaatggaaaaactacaaagaaaaataatatttgctaaagtatagtagggaataaaattaatacatagaaatcaagagcgttcacctatacaaacaatgcccagttggatgatataatggaaaataagactcatttacaatagcaacaaaaaagctaaaatttatagacaaaaatataacaaaaaccatataaatgctacataattcagataacttgaaatatataaaaatagatgaacaaatagacataccatgttgttggataagaggacttgaaattataaagatgccaaataattctaaattaacttattaagttaacacagtctcaattaaaatatcaccagatcttttctggacctagataagtgaattttaattttcatatgagaaataagttagcaagaataggcaagaaaactctgataaagagtaaggtggcccagcgtggtggctcacacctgtaatcccagcactttgggaggccgaggcaagcagatcacgaggtcaggagatcgagaccaccctggctaacatggtgaaaccttgtctctacgaaaaatacaaaaaattagctgggcatggtggcaggcgcctgtagtcccagctactcaggaggctgaggcaggagaaaggcatgaacctgggaggcggagcttgcagtgagctgagaccgtgccactgcactccagcctgggtgacagagtgagactccgtctcaaaaaaaaaagtagggtggtgagtttagctttgtttgatattaaaacatactacaaatcctctattgttaaaacagtatggcataatggatcaatgaaatagaaaatccagaaattgttccaagtgcatatggaaagttaatataggatataaatagcatctctgatgtgtgaggaaaacatagatttaactggatagctatttagaaaaatataaaattgggtctgtacttcatgctgtatagtaagataaagtttgtgtgcaacaagtatctaggtttaaaacaaaaccttgttaagtatttaaaaatatgaatgaattccattataaacttggagtaggaaaaataactcaaaacaaaagccagaagtagaaagattttaaaatttaataaaattttacataataaaatttcaagccaaaaaagaattataaaatcaagagataaataacaccttgagaaaaatcttacattgtaaatggctaatatccctgatattgtgtaaaagtggtaactcttttaaaaatatttgattaaccagaaatttccatttcttgaccacagagaaaaaaggaatctagtatgccattattttgaaatttaatcttttcagtgcacccccttatttactgcattattcacaatagccaatatagggaattaacctaagtgtccaaacgaatgaatggataaggaaaatgtgatatgtttacacagtgaaatactatccagtattttaaaaaacattttattttgaaataattttagagttatataaatgcaaaaacatagtacccaggatgggcaacataatgaaaccttgtctctacaaaaaaaaaaaaaaaaaaaaaaaaaaaaaaaaagccaagtgtggtggcacagtgcttccagctgctcaggaggttgaggtggttggattgcttgaacccaggagctcgaggctgcagtgagctatgatggcatcactgcacttcagagtgcaacagagtgagacgctgcctcttaaaaaaaaaaaaaaagagtttgtgtatccttcaccccattcacatcttacataactacactacaatgatcaaaaccaataaattaacgttggttcagtaccatcaactgaactagagatgtactggagtttcaccaatttcccacgaattccctcctctctcccaggatccgtgcagaacgctgtcctgcgctgttgtcttgtctctttagccctccagtctgtgacagttcctctttcatcaccttgatacttttgaaaaatcctgctgaattcttttttagaatgtccctcagtttgggtttgccagatattttcctgtgattagattgagccagtatatttttggcgagaatactacacacaagtgagtttgtgcccttctcagagcatcatgtcagggaatacatgatgttgctctgctttagtactgatgatgttaaccttaattgcttgcttaagatagtgtctgccaggtttccccacagcaaagttatgaattttccttttgtatttggtaaataccttggaggagatactttaagactgtgcaaatattgattcccctcaaactctggcccacaagtagcatccgttggtcaatcttgcctgtgaatgttattactgtggtttttgccaagcggcgttttggtgttatttttaaaaaggaaattccaggacagtgggcttgttctcattttgttgggcagtcggcagccattgggcaatgtggaatttagaattacttaggcctttcccaacacagaaaaatgccatagtctattaattcagtaaacatttatggaacccttgttatgaccaaggcctcttggtgaaatatgcagacagcataggatctggtctgcacctgagtctttttctctgccactacttttcaccttgaatcacactcgccatcaagatttgttctaagatgttattgcaaaaagtgctgagagacaagtccaggagtcagaggataggaccaatttccaattttgccccagactagctacgttactagcagggcgagtcagatatcgtctcaaagttctagtctccttatttttaaaatagggaatataatatagattgacattagaattaaatgagtggatatatatgaaagtactgtttaagtgaaaggcatttttcaagctataaagtgttctacaaattaattattgtctgggcacggtggctcatgcctgtaatcccagcactttgggaggttgaggcgggaggatcgattgagcccatgagttcaggaccagcctggccaacatagtgaggccctgtctataaaaaacaaacacacaaacatgaattactcaacaaatatttgatttcttattaagtgtgagctttttctaggtgttagaatatagcaatgaaagccaaagcctctgccctccaggaacttatattttagaggaaaaaggtggataatagaaaagtaaacaagtaataaatacaatttcaaatagtaataaatgctacactgtaaataaaacaggatgatgtaacaaaatgtgctataaagaaaataaagtaggataatacattagagaattggggtgtgtttaggtgggatggaatagtttagacgttctggtcagggagtgcgtctctggaagtaattttcgagataagaactttaagattaggagtcagctgtgtgaagcaggggagagcaaatataaaggccctttgaaggggaaaggattaggatgctggagaaaagcaaagaggatagtgtacctgtgaggtcgctagagagtggtgtaagatcaagccaaaaacgttggcagggccaaatgacgtagagcattacatgctgtgaaaaagaagtttctcggtgcagttgatcaggaagaagttgaccagaaagccattgaagggttttaagcagggcattacatgttatgattttcattttaaaaagattgttctggctgctgtgagaatggattgagatggccatcaagagcagaagcagaatgacagcctgtggtctattgcagtggtgcaggcaagagggaatggtggccaggcaagcttggtggtggcagtaagttgtaagatgtcattattgttattgttatgggctgaattacgtcccctccaaattcgtgttttaaagtcttaacctccagtatacctcagaatgaaaccttagttggagataaggtctttaaagaggtgattaagttaaaaagcccaaacaaaagggaggtgattaagttaaaatgaggccattggggtgggccctaatccaatctgacttgtgtcctcctaagaagaggaagtttggacacccagagagacagtgggatgctcgcgcacagaggggtgaccaggtgagggcacagggagaaaaagtggcgcctacaaattgaggaaggccccagaagcagccgacctgctgacacctttatctgggacctctggcctccggaaccgagaaaatcaatttctgtggtttaagtcacacagtctatggtaatttgttatggcagccctagcaaactgatagagctatgacaatcatgggtatggtgctgatctcttcattgtatttatcactacctaaaattcgcttagatttatttatgtttactctttcactcccttgattgtaagttccattacagcagggattttgtctaattcatagtaatcgcaatgctgcggagtgcctgcgccatggcacatgaaaagtgaccgtgtggttaaattgtttctcagtcactctgtaatatccagtattttgtagagcttttgtttttaatgatatacaggagatccagagttttttagggggctacaaactctagcacataggactatataagaaataacactgcagcaagttagaaccaggtgttcaggaagcatatcttagcagtggagacacgatctcttgattagagggaccttggataaaagaggccttttttgaacagaatagctctgctgaagaaagagatttcgtcattattttaccttcatttcatggcttttccaaaataaggtacatgtgtgaaaaatgccctccgtaagggcgaggtctttattttgttctctgctgttctgtaaacgataccagcacatcatagggttcaaatatttgttaaatgaatgaaaacattttcagatcctgctttgtccttagacatttttggattgctttaaatgttctcttatccttagcataatattagctatttaatagagcaggtaaaatgttttgcctatttttttttgtctcttataattgtgtgaaatattctgaatctggtcttcactttggtgtttttgaccttaggctgcccttaaactgaagtcacagcctagctcaatggcactggctcccccttgtgtcaggaacttgatactacacccactaaatgccagcctgccaagaaccaagcttccccgggtcaaacattttaagtggtccaaatgctatacataattaaatgatgacaccacgattgggccaccttattggggctcatttgctccaaatagtcttactcctatgcccactactatatatatagcacaggtacagaaaaacatttttaatacttgtaaccataaaggcttttggagttagtttgtacttcttatcaatataagacatctacgttgacaaaagaaatcgaatgttgactgagtgcggtggctcacgcctgcaataccagcactttgggagacctaggcgggcggatcacttgaagtcaggagtttgagatcagcctggccagcatggtgaaactctgtctctactaaaaacacaaaaaattagctgggcatggtggtgggcacctgtaatcccagctacttgggaggctgaggcaggagaattgcttgaacctgggaagcggaggttgcagtgagccgagattatgccactgcactccagcctgggcgacagagcgagactctgtctcaaaggaaaaaaaaaaagaaagaaagaaaaagaaatcaaatgtctcagcatattttaaatactttatatggaacagttgattttcactttctttcaaaagcctaccaaaattgaggagttagcgtttttttaatcccatgaaatcgatttaaaaggaagaaaattatttttcaaagggacaacattttattttcaagagtagtatttgatttctgttttgtgtacatggtagaatactgagtgagttgctcctggccactctcgctgttgaggagatgaacccgtgcagggacggccccaggaaggcctctttagctgtctgaatgaagtgattttgactctcagcgtcagtggtgtgctggagccagaccgtgccgacttatcccagctcacaagagctaatggctaaatttcaggagttctgcaaactattgttaaagctagtttatattagaaataaattatatagacaattcagttatattaaaaaacaagggtgctttcttcagcagcacttatctaagatcagaacaacatcgagaagatgagcgtggcacctacacaggctggcacacacatttgtgaagcgttccatattttttcaggttattctgtattaaatgcaaaataaatgcttttattaacaatgacaaaaagaaaggtaattgtaataaatacaatttaccacttcgtaattactttattatattttactcatactttgaggttatttgtgtctagtgtatgtgtggtggatgtaccatataatggtatgctattgtcatttcttccagactccacctttagtgatttcatgtttgtaattggcagcttgaaatcgatcttggaacaatggaaataaaaccacaatggaaataaaaaaggatccaaatcaggactttttgcctatgaggagccagtgataaccagcccattactatatgcaaaacgagtttatatgttttttctctactccaaaaacttaacaaaagaaggaattattaaactttaaaaaacgattttaattttattttactacattggtttcagttttttattttattttatcatttatttatttatttttgagacggagtctcactctgtcgcccaggctggatttatttatttatttatttatttatttatttatttactttttttgagacggagtctcgttctgttgcccaggctggagtgcagtggcaccatctcggctctacctcccgggttcaagggattctcctgcctcagcctccttagtaggtgggattacaggcgcctgccaccacgcctggctatttgtgtgtgtgtgtttgtgtatttttagtagagatggcatttcaccatgttggtcaggctggtcttgaactcctgacctcaagtgatccacctacctcggtaccccctcccccgacccagccccaacaaagtgctgggattacaggtgtgagccaccatggctggcttggtttcagttttttaaatagttttttgaaaagataacttcaataatttaaattctttaataattttaataatgttaaaaatggttttaaaaggttgctttaatttaattgaatttatttatgttgagacagagtcttgttctgtcacccaggctgccgtgtgatggcagcatcacagagctcactgcagcttcaacctcacctgctcaagtcatcctcccatctcagcctccagggtagctggaactacagccacacaccaccatgcctggctaattttacatttttttgtagaaacaggttcttactgtattgctcagggtggtcttgaactcctggacacaggtggtcctcccgcctcagccttccacagtgctgggatcacaggtgtgagccaccttgccttgtcactggtcgagggttgtgactgcaagttgtccaggttcttggcattttgaacaaagaattggacaaaatgcccagcaaagcaaagcaaagtatgaagcaacaaaagaacaaaagcagggattcattgaaaatgaaagtacactccacagtgtgggagtgggccagagcagcagctccagggtccagatgcagaatcttcttgggtccaaatacccgctagcagttttccattggccacttcacgtccatctcatgtaaatgaagtgctagcccacagtcagtctgaatggttgcagaaagcagccaaccagaggctgaagtgaagttacaaaggtcacacccctgtgcaaacaggagttggttttcgcagccaatcagaggctagggtgaagttacaaagttatacctctgtgcaaacagacttggcaggccattagtctgactggttgtggacagcagccatcggtctgactggttgtggacagcaaccattcagaggccggagtgaacaaagatgcaaacgaagactcaacccgcagtcagtctggtttgttgcagacagccaatttcccatctgcctaccagaaaaggtagtgagtttgcaaagggagtagcctctggtccttttgttacttaggctggaaagttagggttttcctttcaatttagttctaggaagtcagtgtgaaatagccttaggatccctgcctccagaccctattgccctgcctcagcctggcctaaaagctttacttgaatcttcaatcaattcacttaattcaaagtttcatttagtagaaataggttaaccaaccttaatattatatatgattttatcaattatgttatatttttgtttcattttctagttcctgtctaatgtcttgttttcttatttctaaacttctttcttttattttcatcattaagctatgaatttttttcctatctcctgtaactttcttttcacttatttcagtgtttttacatttttctcttcagctgtctccctttgcagacagacctcgatctctttctcagaattaatggcctcatattttcctgacctgtgctccttctcgctgtctcttttattcttagctcacctttaggatcctcactactcctgaggctgaactgttagcaatacggtttcctccactgtggccaggatcccagctccatccggataccatctggacatgtgcagggctcacctggccccttctgctgttttcccatgtctttggcaccagaaatacgatgcgaggatagtgcataggatcattcggtcatttttgcctctagccccgtatttcagaacatgggaggacaagagaagctctgagtcgtttttgcttctgctgtaatttgtttttattctcatctcaaggaatttggaagtccttttgaaataaatgcatctcatttcattatcatttgaggaaagagacatttgagaggaaagggcgattaatatttaaacaccacctcccttcccctacctcatttgcccttgtatttttttcttctcactcgctctcttatattgcctttactgggcaactatgtcaacaaattgccactgaaaggcacctgactggtgagctgccttgagctgaggtcagtgtgatccttcagctgggagccgctgctccgttttagagggcgagccattgctaccgctgatgagctgagcctggggctcaacgagtccatctgaaaagccatctctcttccagcagcagggagccactcgcagtgctgctttcatcagccttcgtgaaggatgaaaagggcttcgtcttttccacacacacttgactccagcagcgtgggggtttggagcactgatctcccctaccgttgaaaacccacgtgtaacttttgactctcccaaaacacaactaacagcctgctgtggactgaaaaccttactgataacataaatgtcaattaacacatattttatatgttatatggattatctactgtattcttacactaaagtaaactaatgttactttaataagagagaacattaggccaggcgcagtggctcacgcctgtaatcctagcactttgggaggctaaggcaggtggatcacttgaggccaagagttcaagaccagcctggccaacatggtaaaaccccatctccactaaaaatacaaaacttagccaggcgtggtggcgggcgcctgtaattccagctacttaggaggctgaggcaggagaatcgcttgaacctgggaggtggaggttgtagagagctgagatggtgccacggcactccagcctggtcgagagagctagactccatctccaaaaaaaaaaaaaaacgaaaaagaaaatgttattaagaaaatcataaggggctggtgcagtggctcatgcctgcaatcccagcactggcactttggaaggccaaagcaggtggatcacttgaggtcaggagtttgagactagcttggccaacatggtgaaacctcgtctctactaaaaataaaaaaataaacttagtggaacatggtgacacgtacctgtaatctcttatttgagaggctgcggcaggggaatcgcttgaaccccagaggcggaggttgcagtgagctgagatggtgccactgcactccagcctgggtgagagagctggactctgtctcaaaaaaaaaaaaaaaaaaaggaagagaaaatatatttactcctccttaagaggaggtggatcatcataaaggtcttgattatcatcttcacatggaggaggctgaggaggaggaggaggaggaagaggggttggtcttgtttcgagtggcagaggcaggagaaaatccacatctaagtgggcttgtgttgttcacaccatgttgttgaagggtccactgtgcctttcttttacctgcaaggaatggtaggctgatacacagcctcatctcaacttttacttcaggaaacaatattttaggtctatccagggtctccaagtttctgaagtactgagtgaaaatgttgtaactaatatattttgttatgaaactgaggattaagacatccttcataaccagcttctgaagccaaagtgatacagatagtataacaccagagtaaattgttgtataagtagtttatgtatatgaggcagggtttctgttatcctttgttattactgtggttttgatggatgagagtgaaatgtgcttatcttgttttttttttaaataaaatctttttatttaaaaaatttcaaacttctaaacggtaagagtgttgccctgaactcctgcacacttttacttagattcgccaatccctcatgatctgccacatttgtttttgcctcctctttctccttctccctctctcccccgtttctctctatatatgcacaaacacacatacctatttatacattttattattattgttattttcatcatcaccattttgctagactatttgagagtaaactgtaaacattgtaacctttccctgaaatgcttcactgtggatcttctttctttctttctttctttttggagaaaggtgtcttgctatattgtccaggtgggaaatggacatgaactcctgggctcaagtggtcctcccaccccagtttcccaagtagctgggactataggtgtgcaccgctggggtcttcctttctttctttttcttttctttttttttttttttttgagacagagtcccactccatcacccagatgggagtgcagtagctcgatctcgactcacgcaacctccacctcccaggttcaagtgattctcatgcctcagcctctcgagtagctggacttacaggtgtgtaccactacagctggctaatttttgtatttctagtagagacaaagttttgccatgtgggccaggctggtctccaactcctggcctcaagtgatccacccacctcggcctcccagagtgctgggattacaggcatgagccaccgtgcccagcctcagtgtaggtcttctaagacaagaacattctcttacataagccacagtgtctgtgtgtgctcttaaaaataaccttagagtcagatcacttgggttaaggtgtcatttggctcattcctctgcttcttgcaggtgcatttctaaacagtacaaaactgatattttctgggagtgatagaccgaaattcttatgggggccagcctgtgatataaaagtgagaatctgacagagttcatactgtactcatgacatgtatgtatgccccacctaaacaaataaacacgccaatcctagactaaaaaaaaactgtaataagaaaaaatcatcaacaacaacaacaacaaaaatacccgatggccaaatttgtcacttgggtcaacaatttgcggccctggatctacggtcaaagctcccgtggggtggaatatccacagctttctttggaagcactgtggtatagttcagaagttctcctttaagtccaagtgcttgactgagatttgtgagaggcagcagtcgcagtggcaggtagcatgagagctaggctgtgtgtgtgaatcccgtttccaccatttgctaccggtgtgatcttgggaaaatgtcttaacctttctgtggttcacttttcctcatctgtaaaatagtacctttcacacaaagctgtcatgaggaagaagtgaggaagaatatttaaagcaccttacaccagagtctggcacgcgtaataagtcactgtagaactggattctgcgaagacgaacctgatggctagaggccatcacatccatgcagatcatgatcctggtataaggggagagggatgtgaggactgttcctcctggaagacctagagaagatgttcattcttgagccagaaagctacttaatctacttttctcccattgggagtgactttcttttgttcttatccccgttgtcttttttttcttttttcttttccctttttttattagacggattttcgctcttgttagtagagatggggtttcaccatgctggccaggctggtctcgaactcctgacctcaggtgatctgcccaccttggcttcccaaactcctgggataacaggcgtgacccaccgcgcccagccctcatccccgttttctactcatccttcttgtcagacttctccccagctctctcctatatttccctagtgctgagggggtcactgcttgaatattaactctacgtgatccctgacaagttatttaatgtctttgagctttagttttctatctgtaaagtggggacaataatagtacctacctcctagttgttgtgagggttcagtgagttaatgtagggattactgtgtcaggacagtccctggcacacagtaagtgctgtggaactctcagctattgggtaggatgtgcatcattctctttaatagccatattcctccacggtgtactctatacttgtgatctcaattttctttttgctggctcttttttggagttttttcttcctctttttctcctctgcaagtgctcttattgaggtcagtcctcttctttttgtccagatctaagattctgcttattctcttagccttctgaaatattttatttttttactttgagacagggtttcactctgttgcctaggctggagtgcagtgccacgatctcggttcactgcagcctcaacctcctgggctcaagcaatcctcccccaagtagctgggactacaggcatgcgccaccataccccaataatttttaaaaaatttttggtagagatggggacttgccatgttgtccaggccaccttctgtaatactttaaactgtagcaacctggccaggctcatgcctgtaatcccactactttgggaggctgaggtaggaggattgcttgatcccaggagttcaagaccagcctgggcaacatagcaagactctgtctctattaagaaaaaaaaaaaatcagctgggcatgatggtgtgtacttgtagtctcagttgctcggaaggctgaagcaggagaatcgcttgagcccaggagtttgagtatgtagtgagtgtgatcgtgccacttctccagcctgggtaacagagcagaccccatctcctcaatcccccccacccaaaaggaagacaaaaccatcgatattattttgcagccagaagcttgggggtaggggacagtaaggaggttattggagaaagggaagtggagatgaggagggaagggagggagtgggagggagacactggctgattggctgagcagtggagagctaccgatggcaggattctgcagcgcggtgaggcatggggtggatgttgcgaaatgaagctggcggttacaagataagccatttagaagaagtgttgtgattagtgaaaggaagccgggaaatagaatagagtggcgaagcacctatcaagttttttcaagataaggaagatacctgaatattttaaggcaaaagaggaaacagctaataaagaaaataatgaagatgctgagagggagaggtaattgtgtgaagaacaagagctgagtgtggaaacgaaaaactaagagggagatttgcttctttgaggaggagcactttttatttctccaaggctacgagcacgaggcaagagctataggacattcctctaaagtggtacaaagtcagcgactgtaaaggtgacgtgaggattaataatagcacccagtgatcgtgcagttcacatctgttgagtgcagtgggtgataaggacgttttctgagatgaagggagggaagtgggtgataaggacgttttctgagatgaagggagggagtactttggagcttgaggcaagagatgctgcagaatagctgttttgagggagtttgccaggaagtcaacagacgactgagcggattgttaggcaacacccaggacagatttgatgttggatgggggtgaatttgtcataggccacgcttttttattttattatttattgcagcagtgctttgcaggaacaaagaaagtgaaaattgagatgttcaggattatggactaacagcaggcaggatggagggtgaagggcccagagttcagggtggtgacagtggccattttgagtggctgagtgtagaggactgagcagccgtgtgtagattaactgccaagcacagctgcgtgagtgagcctaggccaagctagcggaggaaccacgcagccaacccgcaggatggcggaaaagaataagccgtggttgattccatcactctgtggcgggcagcttgttacacagcagtagaagatgcatgccatgccttgtgttgactgcgcacagcagggagcctgaggcaagggagcctggcacagaagcagaggtcagtcggctggagaagctgggcaggtggagaagaatagagggggcctctggggagcacccagaaatacccagcagctctggagaagtgcaggttttagaatgtgagagtgagaaggaggcttgccatcttgagagatacacacctggtggcaagttgtggtgacggtaagtgctggagggagcgcagccacagctcagactgtctcttttcttccgtgccattcactctcagcagaggaccttgccttgtactacacagaggacagagaagtctttttatgtgagtttcttcatcatcccatttccaaagacaaactagggatacagatatgaattgtatgataaaacttgagataacagataagtcacattacttttctaagtctgattaaatcttgtgcccctacttgtcaagaccaataaaaagttagtagttttcgtggcttctttttggctcttatattgtacagtaagtcttctcttaacctttcaatcagttgttggaaactgcgactttaaatgaaatgatgtacagcaagtctttgaataatgttgttacaaagttgatgagaaaaaaaaatggttttgttatatgtccttttgcttacggttgtagtttccaagaacccatcaatgatactcagagaagacttgctgttctgggactccaaggcttagtgcagtctctgggggaaactggagagaggaaaagcattgtgctcatgagctgtctaggcctgagacagggacagcatccgtgtcgtctgcaccaggctcagccacagggagccttagcacagcttccagggccccagagctcaatggagagattagctttccataagaggaaggaacctcatccagtgcagtagaggaaaagagaagaacataggtgagatataggtgggctagtggagcagtttgtaggtgtacagggagagttcttgaggaagccgtggtattgttcttcaggccactgtggcctcatcagcaaaagaatctttgcctttttttcttatatcatcaggcctttgtgattcgagactagagagaaagaagttgcttaatgcctgcaagatgtcaatcacgtgggctttgttttctggggtctacccgggcaggtgagaccatagcagattcgctcagcagagaagaggatggtgatgggttcctcaaggggatgtgaaagagggagagggaaatttcctatgatagggaagaacttgccattctctcacatgtagcaccttgcaggcggcaggacctaggatgggggtggctggaagaacactgagcgctaagtgcctggccaaggccctcccaccctctcaggaaacccacccacccagtgaacaacgcccgcatcagccttctttgcacgggctctttcccagtagcattaaaatatgctcacatcattcaggtcttcagtatcaaaaaagaaaaaacatcctctttaacaccatgttcctctccagacaccccttccctcccctttacttctgtttgttttttggggtttttgtttgtttgttttttgatgtgggggtctgtgtatgttgcccacgctggagtgccaagtcagtgtctgttcacatcacgatctctgctcactgcaaccttcgcccccacttcctctgggctcaagtgatcctcacgcctcagcctcatgagtagctgggactaccggcatctgtcaccatgcctgacttctccctttcacttcttagatcctccttgacccactgcaatctaatttctcctccaccttcaacggagagtgcccttgtcaaaatcatagctgatctccttttttactaactccagtggctgtttctcagaatttacctccctcgacctctcagcagcatcggaaagccaaggatgactttccattttttttctccttagcctccacgccccggccctctcctggatgttcacttccctctctggctgctctgctccatctctcatgcgggttcctctttcttggatcgttccttgaatgtgggtactcctcagacctcttccttctctttcccagccaatacattctacgtagaggagctcttctgctcctgtggcttcatgaccggatccacgtctccagccagatccttctcctgcacttcgcactcttatgagtatcaagtctgtggtttgattttaccccacttgtaagctagcaagttagcttgttactgtctcatggatgttggcacaagacttgagactcctgagtcagtgacaaaggacttcattcctcttggcacagcaggcaacatgagcatcagcttgtgggtgacagttactcctgccctcaccttttcctggtgatgggcccagctggatgcctgcacaggaaatgggtggcatcacagaaagggaacagagctttcagaacagagaatttcagggaacagaacaggggatatctactgcttttatagcaagcaggaagcaagcctgctctttggcctggagggagacattatgtcatctctcgaggctgctcactgcggcatagccctgagagatggtcagggttttcatggcataaccagcaagaacaagcatgttggaaattcaacatgtcccagattgaactcttcatttcccttcacctaaacttttttacttcctttttaaaaatttatttttatttattttgcacatttattggtatttcttttagagacacgatctcactctgtcacccaggctggagtacaattgcaggatcatagtccactgcagccttgaactcctcggctcaaccgatcctgccatctctgtctcctgagtagctgggactacaggcacgtgccaccacactcgactaatttttaaaattttttgtagacatggcagtcttgctgtgttgcccaggctggtcttgaaatcctggcctcaagtgatcctcccacccacagcctcccagagtgctgggattacagatgtgagccaccgcgcctggcctgtttctccttctattttctgaactcagtgattgatgcagtcctcgatatttgtaactcattaccaactgataagaaattcttaactcttttgactttcctctccctcatgaagtctgatgactccttcgaactctctcttaggtttatttgctcttcttgccgctcgctgcctatccctgggtcagactgtgcttctcttatgtgtttaagacaattacagccttttatcatccagctagaatattcattttatgaagttgtaagttgttttattacgaaatgtttttagagacagggtcttgctgtgctgcccaggtggagtgcagtggccatttacaggtgtgtaatagctcactgcagccttgaacccctggcctccagccgtcctcctgccccagccttcctagtagctgagactaagttacttaatttaaaatgtatgtattcatttgtttgtaattcaaaagattcaaaaggtagatgctgaaaagacttcctccagcctttgcccctgccacctgctctcctccaaggcattctccaccctccagttaatgttaccagctcctcctgtatcctgttaatactgtacccaaggtagacattttatactcaggttactcaagtaccgtatgtgagattgtgacacaaatttccataccttacatttgcttaatacttttttttttgagacagattctcactctgttgcccaggctggagagcagtggtgccatctcagctcactgcaacctccgcctcctgcgttcaagcgattctcctgcctcagcctcctgagtagctgggagtgtcccagagaggaacatggaggcttctgttgctgacacagcacagtggaattctcactttctccttatctgctctcttctcagtctgactccagatggaagctcttccctagaaaagccctgtccagaaggagtttgcatagtctatcattttccattttctgttagccacattttttcaagtaaaaaagaaacaggtgttggaagaaaaactttagacaaggccgggtgtggtggctcacgcctgtaatcccagcactttgggaggctgaggtgggtggatcacgaggtcaagaaatcaagaccatcctggccaacatggtgagaccccatctctactaaaaatacaaaaaattagctgggcgtggcggcccatgcctgtagtcccagctactcaggaggctgaggcaggagaattgcttgaacccgggagatggaggttgcagtgagccgagattgtgccactgcactccagcctggagatagagcaagactccatctcaaaaaaaaaaagaaaaaggaaaactttagacaaattgaatttaacagaatttaattgagcaaagaaccatctgagaatcagctcacccttccaaaaaaagggaagtgatgtacggaaaatggaagtgaggtgcagaaacagctggtgtagttacagctcgaagttggcctcctttgaacaaggtttgaaccgttggctgtgattggccgaaactctgtgattggggcatgagtaggttatgtctgttgtaacatccggttaggttgcagttcactatatatgcggaaacctctaggtcaagcttaaaacatgtaaggaggcagctttaggcgaaacttatataggttggtgcaaaagtaattgcagtttttgcccttttaatggcaaaacccacaattttgcacgagcctaataatttaacacaagtaaaattaattttaacaacgtatcttatttaacccaatgtgtctaaagtgttatcatttcaacatgtaaccaatattaaaaattattaatgagctattttgcattttctttttcatactaagcttttggaatcagtgtgtattttacactgacagtacatttccatttgcagtagtcacatttcaaatgcataatagccagatgtagttggtggctgctgtttggtctagcacgggcctagaatttgtcttttcccaatcttgtctccttcaaaaatctttttttttttttggtaattaaaaagtcgatatatcatggttgtacatatttatgaggtccgtgggctattttgatacctgcatacaatgtgtaatgatcaagtcagggcaattgggatatccatcacctcaaacgtttatctttgtgttgggaacattataattcttctcttcttgctattttgaaaatagaataaattgttcactctaattttcctactgtactatcaaatactggaacttactccttctatctaactaatatatttgttcctattaacccaatatctctttgtcctccttctcctcttcccttcccagcctctggtaaccatcattctactctctacctccctgagaccaacttatttagctccagtaagtgtgagaatgtgcgatttgtgttgccctccttcaaaactcttgcctgcaataagagtgagaatgtgcgattagccgtgcatggtggtgcacatctgtagtcccagctacttgggaggctgaggtgggaggatcacctgagttttgggaagtcaaggctgcagtgagctgagattgcatcactgcactccagcctggacaacaaaagcaagaccctttctaaaaataataataataataataatatctttgctatatgaaagaaaaaaaacaagaaaatgggaaaaaaggaaatatacttgacatgaggatagtacatgttttgttggcccttcatttattaagaaggaagatgagtaagtgaaaagaatcctatattccacagttactgactttaggtttcacttttaagttgatacttattctgcaacctctttcagtgaagaaatttaaaattcttatttaaaacgttttctttgtaaatagggagtaaatataataccactaaaattatccagagtggtaaagaaattaactactctagttaagtgaatatttgcgaaattaaattaacattcaaacattacaactttaattttgataattttgaatggaagtatttcgtaatcaattacacatccctgtcttaatattcagagagtattgaatagcatttatacttttcttaggttatttgtggaattgaactacgttatgatgggggcagggagaggtgaataactcatatttattgagtcgctgctctgccaggagatgtgctttgtattatgatagctcttcttatttaacccttagtgtatcccccttcctggttcttagtgtttgaaggaagtcactgtgttttacctaccaggtaggcttatgcacacattgattaggtaggtgatctctccaatctagtaagtcacagagctgggatttgaaccctagtggtttggcgctagaggccatgcttttaacactctgatactaatgtcaacttcaccacaaaactctgcggtagacattatcatccccattttacaggtgtggaaactgaggctcaaaagagttaagtaacacttaacgtcagttggtacatggccaatgtttctttttctttctagaacttttttatattggcccaggcaaggcatttgccagtcaatgaaaccatttctttcatctttctttggttcacttatcctcctttttctttccccagaaaacatcttttataatcatgaggcaatatcggagtgatttggtttcctacattacaaaatatgctctgagataatttggagaaacctggccttttcggagtttatattctaaaaccattgaaaacttttttttttccagagagattggaacaattatcaggtcattaggatgctgtcctacggaaggagagctgcatgatctgattgcagaggtgagtacggcgaaaaggtttcattcagccagctctctgtgtgagagctactccttgtaattaaaaacaatccttaccggaaactaaaaaaaagtgccccaaactactgaatgtgctcagtggaaatattaggataactattcatattagccaaccaacaaaatctgaaagaattgagcagatcttgaagaaatgactatgaacaagtaacacaactgatcaaataaagaacccactgtagaaatgatcctctctgtaaaattagttgaaaagaggccagtagatgcaaggggctgaccgtatgcagaaaggctattgacagagacagtaaggaatttttatttatttggggaaataaaactaacttttagaacaagtagtaaacagaataaaatatcaagaatgaactttacattgaccagagagtctaagaagtttaaaaacgagtcatgtgtaatagtggaggtgaatgatcccataaggcagtggatgagcagcccacgatgagagtgcttcatgctctgtttgactttccagaaaggtctctgatctcatttcaaatgcagcattcggttcaacaacagagactttaagggaaaaaagctacctggccaggagaagaatcttttcagaattgcttatctaggcacaaagattttagtggagtctggggatggcaaaggggataacaggagacaggtgaggaggtggaattttatctctttattttgcacctagcgcagtacctgcttgttcaacattaagttggagagaaggaattgtgaccgtggtgagtcacttaacccctgttgagtgtcagtttctccataataataactacttcaaagtttgcttcaaagataaatgaaagaaggtacaagaatgcatgttttgaatcctaaagcattatgtaaagttaaggaagggaagattagaaagatgagtctgctgcacagatattagcaccttggtgaccaaaaagcagtagcaattttttgaagcatttggaaatattcagtaaaggaatctaagttgtaagaacacattgtttttaccttttgggattcaataaagctatttttaccaagagtaagaggaaaagcttgtttttcctgaattgatgctcacattaaaaaaagatactgattactgccttaaagtgtttctgcacaaagctggaattagtgttagggaaaagcaagctggaagtgtggaagaggtaagaactagaggacgaatttacagcgaaatcatcatcatcacatgctcaggatagtaagtgaagcaataatgaaaaatacctccgaaggtcagaaaaggaggatctctagagtctagtccctttatggtttgtttgtatgttttaatctctatcaggagttagcaaatcatggcccctggccaaatcctgcccaccgcctgtgcatgtaaataaagtttcactgaaacacagctaaactcatttatttgtatattatctatggttgtttcctgactacaagggcagagttcagtagttgccacagagacctacagcttggaaagcttaagatatttaccatctggcctttgcagaaaaaggttgccaactcctgatctatgggcttctgtgccaaagtagaacaaataccacatctagtactagaagatctgagttcaaactccacagctaccacttatagccatgtggccttcaatgagccacttaatccttcaaagcttcgtttcacatctgcaaaaggagtataataacatgaaaatgtttttatgaggattaaatttaataaccgaggaatcaactgttacttggtgggcatgcagtacatacttgagtttgcttgcactgctggtggctctctaggataataatccccactggtttgggcagttagccacagtgggtgcttaggtcctaaagttttattttatttttacccttttttagggacatgacacaacctttgaaaattacagatatttagaatacttatgtaccagtaggggtcactgagctattaagctctgtaaatatttttctatatttgtatacgaacacaatttactctaattaaattctactgataaacagctttgggtataactaccttttaagaacttttccaaataaatgggtgggaaaaaagcacataaaaaaagcacaaatttgaattgataaatacaagtatgtatttgtacatatttaaatacatttaatagtgaatacatgtaaacacatttagaaaatcaaagccccgtaaaagtcaacatctaggggtaaatgtcatattgctaaatgttctataatagtttcagagatcaaactatttaaatgtatgtgtgtatatgctttaaaattgctctataaggctgggcacagcagctcacgcctgcaatcccagcacttggggaggctgaagcaggtggatcactcgaggtcaggagtttgagaccagcctggccaacatggtgaagtcctgtctctactaaaaatagaaaaaatagctgggtgtggtggtacacacttgtaatcccagctagttgggaggctgagggaggaggatcacttgaacctgggaggcagaggttgcaatgagctgaggtcataccactacactccagcctgcgtgacagagcaagactctgtctcaaaaaaacgaacaaacaaaaaatagtcctataaaaagttgaaacctttgtaaaattctctggttgtcatgtacttgaactttagtgtagacacattcttttctctttaatttttataactttcagccctttgcttcctgaagatcaatttcaaatatggtgtttctcttgaaatagatcattttaaaaatcatttaactttgatccatgcagtttatattctataaatagcaacttcctgcaaatactttctgccttttggaatatcacaaaaactggcaactgtgagaaggattagtgaaaaatcttaccgacatataggctaccaaataatccttcttttaatattaagttagcgccttctaggatcttcagggtatgggagctgggaggagataatggcattttcatacaaatggaaaggttatttagaggtctatgtcttctgaagttccaacctaagtggaattatggagaacttcaactaattacaaaggaaaactaaaagatgatttaaaagtaagacctatgtttgtcagattattgactcaggcttaggcactaagcacggattatgactttttattggggtgaccatctgcatcctccccttccccatccttgcccttttttggttgtagatgttaggcagcacctttgttggctccacatctgttttgctcctaagcgtgctatgttctattaaccatctccacctttccccgtgactccctcttcaatctgtctgctcattatatgaggcctcttaacttctgtgctcaaacaactctgcttggcctctgttacctgggtgtaggagagctggctagcaaatcattacatggatttaacaaacccaggtctacaattacctaatctagtcaaccctggcttgcagaagacaccatcacagaacttagtgacaccagtgcctttctcaccagcctgatacccttggtgagcagtgcatctgagccctcccatggaacagaatcctccagtgagtcttctgactcattagatgcccattctgccctcccacttccgtcagcttggtttgccacttcactcagggtttggtgtcgcttgttccaggtctccacttcactcagggtttggtgtcacttgttccaggtctcaccctcgcagcaagggtgccccatctcctagggtccttgccagagtgttaagtctgtgtcctgagaaagtgcctgaagtcgatgaattcttgcttatccagttttatattccagacctcttggtcaagcactctcatccaatctcaggggtactcccctagctcctagttcaggagccaattcctatctaattccttttgcgattttagtgtatagtctttttctttccttattaggcccagcacttcctcagccagattatgctgggatttaacacttcattattgcctggagcagcccattggatggatggccttggctcaaatatgatggctaggatcatcattcaattacatttcctgcaactgtagatttaagaggtgcatttcattgggaggctgaggtgagaggattgcttgagctcaggaatgaggcacaatggtggcccactgctctgcagcctgggtaacagagccagatctcaactcttttttttgagatggagtctgactctgtcgcccgggctggagtgcagtggcacaatctcggctcactgcaacctctgcctcctggcttcaggtgattctcctgcctcagcctcccgagtagctgggggttacaggcacgcaccaccacacccggctaatttttatatttttagtagagacggggtttcaccatgtcggccaggctggtctcgaactcctgacctcaggtgatccgccctcctcggcctcccaaagtgctgggattacaggcgtgaccaaccacgcccggcccagatctcaacttttttttaaaaaaagagaaagaaaattgaattttcatggctgccatagttgtcgtctggaagagctgtaatgcgaatcaggtgttaagtgtccagtagaatatgaccaaaaggagttggctgctctatatattttatttctaaactcactagggcctacccctggctttcaggattagatcaaagcataaaactacttaggaatgaaatgaaggtcctcatcagatccaaggagtggggcaagagtgagcagaaacttgaccagcacatagtaaagataggtcagtgataagaactgggccaggcttatcctggaattctgttcttggatcaaaagaggataccatggcagggagaccatggtaatgatagttcttaacaaaactgtccctttacatatgatggttgacctcgacatctgtgcacagccatcattctgggatctttgtgatatttctgggagtcactgttttccttctgggttggacttctttctatcccaagttttcctctttctagttcctctagcattttaacatattatttgataacttcttgggaaagagtgccttgggggtaaaatttttgagatttgtatgtttgaaagtgattatgctaatctttggctggaaatagaattctacattcaatggatttttcttcattaaatggatttggatttttcaggtcttcagtaagagttctgaaggcactgctcatcttcatgttcctggtaatgctattgagatagtgcaaatccattctggttcccaatcctttgtatataaacattaattttttttttcctgaaactctggacagttttttttccccagagtttgaaatttcacaaagatttacgttggtgtaaacacatatctaatgtgttaggtacctggtgggccttttcaaactagtgacttgtattttttggttccaggaagttttcttgcaattattttgttttcttttttctgttttttggaactcctattattcatttttgtgtttctggactggactagtctttaacattcttcttttttttttttttttttttttttgtatttttagtagagacagggtttttaccatgtttgccaggctggtcttgaacacctgacctcaaatgatctacctgccttggcctcccaaattacaggcgcatgccatcacgcccggctaatttttgtattttcagtagagatggcatttcaccatgttggccaggctggtcttgaacgcctgacctcaagtgatctgcccgcctcggcctcccaaagtgctcggattataggtatgagccaccgcgcccagcctaatattcttatttttcacttattttccatctctgtctctgtgttctctctggtagatttcttgaactttgtcttccaatatttttattgagtttctcatttctgttgtgttttaaatttccagtagcttgtttttgttctttgaatgttcttttttaaatagcatcctgttcttgtttcagatctctgaagataatagtgttactttatttgaagttttcttctctttgcataatctgttttctccaagttgatacctgtgtctgttctggtctttgtttttgttagtagctttcctcagtgtctgataaaccttggctgtcagttcctaacaaacacatgcatggaacttgtcaactttaaacttcatcactgggtaatctgggaatcacccgcatcggagtgttggggatttttctgtcgtgcaggcttgattctttggaatagagtgttcagtcttctgcttgggaggcaaaagcgtctagctgccagttcggacaccttctgtttacactctttagaaggtaaatctcgaaactcctgcagggatggagggcaggcagtcacttagtggggaaaactgagagggaatttacagcttttcaaacatattttaccctagttcccctaattttagttcctggtccctcatcctcatttccagaagcaaccaatgctttttgaggattctttactcactactgtcttgggttcagttttctagatctactagattattgccactcatccatctacttctcagcttccaaaattttattcccattatattttttcctattcttcctaagtaggtgtatgattattttaacaaatgtttctttactgcaattttaataaggtttgagagagagtaaagttagatgcagatatacagtttgcctccttaacacagaagtttcattgatatttgattagtcagaaaatagcaacagtactcctgagaaaagtattaataatgtaaatctagatgagacattgtaatagtctttagaaagagagcattagtaaatgttgggactaaagcactgataattatagcatataagatgtaatacattggagtgaattaagtatgcatgtgtaaatattaagtgtaactacaaaagagtataaagtgaatgcataacttccaaactgatatagaggataaaagaattagagggcattctgtcagtccaaaaagacagaaaagaagcatagaataatcagagtatctagaaaacataagataatggtacttataatcataataggccaggcatggtggctcacacctgtaatcccagcactttgggaggccgaggtgggcggatcataaggtcaggagactgagaccatcctggctaacatggtgaaaccccatctctactaaaagtagaaaaaattagccgggcttggtggcgggcacctgtagtcccagctactcgggaggctgaggcaggagaatggcgtgaacccgggaggcggagcttgcagtgagccgagattgcgccagtgcactccagcctgggtgacagagtgagactccatctcaaaaagaaaaaaaaatcataataaatgcaactggattaaactcaccagtgacaagaaattgaaattggacttctggaaaaatccgatattataatacatcaacacatttctgccatctctaccttcacattataaatttaactttctcatcatttccacatccatcaccttagtccaagccttgtcatttctccatgaatgactgcaatggcatttatttacttatttacttatttttcagacagagtctcactttgtcgcccaggttggagtgcagtggcatgatctcggctcactgcaacctccacctcccaggttcaagtgattctcttgcctcagccacctgagtagctgggattacaggtgccggccaacatgaccacgcctggcccaatacatgcatttttaaatatttgagatggtattcagtccctactcatttcgctaagtgaggaaacccataaacaaatgttacagttttttttatatctgtggtcagtggtttaatgttacatttatagtgttgagacaactatgatgtcaaagtgtgataaatactccccagtaaccagttaaaataatgtaatgacactagtgaatcatttcctacacttttcatcttggatggaaagtatcatactactccaggcataccacaagccccggaggtcccaaatctccatctttcattattcttaattggttaagtatccttggattttttttctttgaaacttcggaattggcttttgagttagtagaacaagatccacgtaatctacaccctggtgaagtgggaatttctatcagcctgtgcctggactctatcattgagcttctggaagagccctgggactttacatcgtttggaatttgactgtatcaagtttctcagagaatgagaaagggtgggagtaattatgttcttattttgaagtagttggtgatatgaaatgttttatctgttattgttcctacacatcctgcctttgggagatgggggagaatggaattgatctgctctaatttttatttatgttagatgctggaatttaattatagagctgatggtactttgcagattagttagtaatggctaccatccagccattacttcgagtagcatcaggtaaatttggggcaatgaggagaatatattgtaaaaagcatatactgagagtattgcttatttgtaattggtaggaaaacatttaacgatgccaaagccatgatcagcagcgggaaaacgtgacccagggaaatcttcaaaagtggttttttctttattagataaataaaacgtgtttttatatagaacagaaacaatcacggcaatagactaataaatacggttttattccagatttcttattgtataggtaatatccagattacaaaaaattttaaataaataggaacttcctttccaacaatgccatcaccttaatataatcattgttaatattttggtacacttccttacatattatttttctgtgtaggtttttaactggactgtaattttttttgttgctatcgtattcttttttttagagactgggtctcactctgttacccaggctggagtactatggcaagatcatagctcactgcagcctggaactcctggactaaagtggtcctctcatctcagccttccaaatagctggtactacaggtatatgccaccactcccagctaattttttttttttttttagagacggggccttgaaatgttgactaggctggtcttgaactcctggcctcaagtgatcctcccacctcagcctcccaaagtgcagggattacaggtgtgagcatgtgagccaccatacctggcagaactataatcttatagtataattcagtaggtaaaattctgaatcttgcttttttccacctaattatatcacaaattatatctccatgttattacaaagctttcattataaaaatgcatgctgattaaattgcacaagaaaaaaaaggaagggaatgatctctcttctgtgcatcactcagacacaaccagaatattttacctttttcactcactattacatcaaaatgatttttcccttctgttatctagtttttagaaaccaacgctttaagaaagaaatcctgttctactataacatggatgaaacttaaggatattatgctaagcaaaacaagctacagttgacccttaaacaacatgggggttcaaggcaccgacccccgtgcagttgaaaatccaagtataattttgcctcccccaaaacttaaactaatagtctaccattgactggaagccatatcaataacatacacaatcaattaacaaagattttgtatgttatatgtattatttactgaattcttacaataaagtaagccagagtaaagaaaatactattaagaaaatcataaggaagcaaaaatatagttactatccaacaagtggaagtgggtcatcataaaggtctcgtcctcattgtcttcacactgagtaggctggggaggacgaggagaggaggggtttggtcttgctgttccagggtaacagaggcagaagaaaatccatggagaagtggacccatggatttcaaacccatgtttgagggtcacctgtagttataagtattaatgcacaaatactgcatgtgaggtatccaaaatagcccaactcctagaaacagaaaatagagcagtagtggccggggaatggcggaggggaaaggggagctgctgttcaatgagtacagaatttcagttttgcaagatgaagacgttctagagagctgttacacaacaatgtacatgtagttaacactgctgtactgtacacttaaaaatggtgaagatgggctgggcatgggggtgcaccccaatagtttcagctactcgggaggctgaggcttgaggattgcttgaagccaggagttcgggaccagcctgggcaacattgtgagaccctgtctctacaaaaaaatttttaaaaattagccaggcttggtggtgtgtgcctatagtcccagctacttgggaagctgagacaggagggtcacttttgcccaggagttcaaggctgtagtgagctatcgtggcaccaccacactccagcctgggcaacagagtaagaccctgtctctaaataaaaaataaaccaataaagtatacagaaggatgtgcataggttatatgcaaataatgtgccattttatatgaggaagttgagtatttgcagattttggtatccatgaggagtccgggaaccaatccaccatggatacagagggacacctatactaatatcattaatattttccatgccaatattctactataataggagtgcaatcgcttcctaatatttaattatatggcaatgaccatattaataaatagaaacataatattccattaaatgaatattccatattacatatccattcatctattggtaaaggttgctaacaatttttaatatcatggatcctgcatgataaacattatttgaataaagtataggcccttttcagatgccagagggccttgtgaagcaagccaaggcagtgatgggttactgaagggttttaaatgagaataacatgatgagatttgcattttattttattttaattcgtatttgtttttattgaaggaggttgtactttagacaaaccagtctgatggtagtaagcagttagattggaataatttatagtcatcctttccctgggtcatatctgacagcttggagccctttgtacattttgggtaattttttcctaaatggttttatttatctcttttattcagtaaaacttaattgccatgtttctatgatgctgtggtcagaatgtatgtgccccttcaaaattcatatgttggagcttaaaccccaatgagatagtattaagaggtggagtcttcagggggcaattaagtcgagagagtagatccctcacgaacgggattagcaatgttataaaagggctggagagaattagctagtttttgcccttgcatccctctgccatgttaggacacagtgctcatcccctctgggggccacagcattcaaggccccatcttggaagcagagaccaggccttcaccagacaccaaggctgctggtaccctgatctgggacttcccaacctccataactgcaagctgttaggtatgctgtttatacattacccagtctaaggtacttcgtcatagcagcacaattggactaagaccgaaattgatcttcgtgggactatttctataacaaatacctgacaatgtggaagtggctttggaactgggggtcaaggctggaagactttgaggtgtatgctagaaaagcctggattgctgtgaacagagcactaatggtgattctgatgagggctcagagaagagatctgtagagagagcctcaatcttcttagagattatctaagtagacaagaacagaatgttggtagaaatatggatggcaaaggcaattctgttgaggtcacagacataaatgagggatgaggtattggaatccggaagaaaggacgtcgttgctataacatggcaaggaacttgtctgaattgtgtccgtgtccatgctttatggaaggcagaacttagaaataatgaaccttggatattgaaattggcaaagagtttctaaaagtggtaagttcctggcattgacacttttgcacattgctaatagcagtagaaaatggtggtattcatactcccttcctggacggcattttagcaatacttatcaataagctaaaaaaaatatacaagctcattgatcagtttctggaggagatactgtatggagaacaaacagaaagattttacttcaaagatgttagtcacacggttgtttgtaacaacaactggaaacaacctgagtgtccattaacacaaaaatggttcaacaaatcttggtctgtctgtggaatggaatgctgtgcagtcattacaagtatgtcgtgaaagactgatgccaccacacacctatgagagtggataaaatccaaagcaccgacaacaacaaatgctgacaagaaagtggagcagcaggaactctccttcaccattggtgaggacagtgcagcactctcttagaaaacgaaacatcctcttaccacataacccagcactcttctccttttatttatgcaaaggaattgaaaatttatggccacacagaaacctgcacacagatgcttatagcagcttcattcataattggcaaaacttggaagcaaccaagatgtcctttagtgggtgaatggataaataaatgtggtacatccagacaatggaatattattcagcactaaaatgagttatcaagccatgaaaattcattgaagaaaccttttttcttttttcttttttttgagacagggtctcactctgtcacccaggctggagtgccagttctcccacctcagcttcccaagcagctggggttacaggcacatgccatgcccagctaatttttaaaaatttttgtagagatgaggtttcgccatgttgcccaagctgagctcaaactcctggcctcaagtgatccacccaccttgccctcccaaagtgtgggattacaggcatgagccaccacgcctggcctcagaggagtttgagggcagtgaaactactctgtgtgatactatcatggtgaagacttgttgttatgcatttgtccacacccattgaatgtacaacaccaaaagcgatatagtttgaatatttgtccccgcccaaatctcatgttaaaatgtaatcctcggtgtcagagatgggacctggtgggaggcgtttgaatcatgggggaagatccctcaggcatggctcgggccgtcccttggtgataaatgacttcacacaagctctgagttcacacaagctctggtcatttaaaactgcgtggctcctccctccgcactctctcttgctcctgttctggccatgtgatgtgcctgttgcctcttcaccttccaccatgattggaagctccctgaggcctcccaagaaaccaagcagatgtcagcaccatgcttcctgtacagcctgcagaactgtgagccaattcaacctcttttctttataaattacccagtctcaagtgtttatagcaatacaagaacagcctaatacaaagaattaaacctaatgaaaactatgaactttgggtaataaagaggtatcaatgtagctctattaattttttttgtttgtttgtttttgagacagagtctcactctgttgcccaggctggagtgcagtggcatgatcttggttcactgtaacctctgcctcccaggttcaagtgtttcttctgcctcagcctcccgagtagctgggactacaggcatgcaccaccacacccagctaatttttgtagttttagtagaggtgtggtttcaccatgttggccaggctggtctcaaactcctggcctcaggtgatctggccacctcggcctcccaaagtgctgggattacaggcatgagctactgcgcccggccagcttcattaatttttaacacatataccactctcgtggggatgctgattgtaggggaggctgaggatggggagagcaatccaggggacggggcgtggcatatgggaactgtctggacattccacttaattttgctgtgacataaaactactcttaacaaactcaaatttattaattaaaaaaagactaatggcttgataagatgttcacagtgttaagtaaataaaaaaagacgctagaattctatttcttgctaaaatatatatatacatgtatatataatacatacacaaatataatatgtggatatagcattgtattaatgaatataaaactaaaacaaagctctccagcactgtatatacagaagtgatctgtagatgacaggatcgaatccctgcgtgatttgtattctttgtgctcgtctctatttttcactgttccacaaagaacatgtattatctctgtaacaagaaaaagaagaaaagaaaactgcattatatcattcaaaaagttgtctagtggtcacaaagacactattgaagatgcatgttgaaagtttgaataaagttggtttttaaaatgcaaaaataaagagcaatatttttaaattaacgtcgttacatacatgatctgaaacatagctgtggacgtagtaaagtttatatatttaacttgaccaaaactcctttaggggattttcttattagggaaaggagggtcactttttgttcatcagtatattcagatatttattgtgttaaccactgctcctttgcttaatcacaaccaagaataaagcttttcctccaatcatattgcaacacaactttaaatcattgtttttggtctgagtggggttgaagagtatcttagtgagatgattgctgcaacacttgctgcaatcaccatctctatcaaatacaataaaactacttggcgtgggagcggcactcacccttaagtagagaaactggaactggagaggatgaaacaattagtgtagctggtgctcctgaagccccaccctcagaggattaaaacagggaaattaatggtctgacaggcactgctgcagcctttcccccatctcttcaaattggagaaactctcggttggaagtgatcttactaagtaccggatttagccacctgttgattcttagactctctggtgattcatctgtttttaacacttgcacttaaataggaaaggaatttataacccagaagactcgtgcagcctcgtggttgcacagcagcctctggaatctttagaataaataatttttctaaagtaagtggctttaaaatttttgtttttaaagacaacatttttggtagatgccaattaattattgtgattttgttctattcaaggtagagaaatattttctaaattgtgtttatgttttggttttgaaacatagtttatgtcaaaatttgtatctatactatttagagcctaatgtgaactatctcatggtttttatattttttactacaaacagtttttaaacattcacatgtgtatctgatttggtgacctggaactagctgaaatgcagatgctttataaaccatcttaactactgacattatcttgttttttgtgaagcatgaaatggttcagtttattgactgattgttatgtcactggggagaaaggaattttcacggtgtgttttattgtgcctatttagtgggttcagcattaaaataaataatgcttttatgagaaaagagatggcctgatgatttctcgatgcaagtggaagttaagaactccaggctgtgatcccgtcaaaacacctgccggaccctgacgccctcagataggcacttaacctctctgtgcctgtatttcctcaaatccaaaatggattaagaaaattgatttagaccaaagtagagtgagaagcacagtatttgccacatgctttgaggctgagataaatgttgatattattaaaaagtcccacagtatttattgagatggctccatattggggaagaggaggagagagactgtggagtgccggaaggcactgtgttagcctccagaatttgggcccctttgtgtggcaatgaaggcagtatattttcttcaggtcacctactccaccttaattctttgcaggaggagaagccaggcgtatcagggccttggttttccaggtgagcatctgctggcacactgttaagatgaattccctgcgaatggtacttttagcaggctacactcgagggatcttctggcaaagacgtttttcctgtacattcacaaacgctgcccggcttacttttaaattattactccacgttagcccttcccatagaagaaacaaactagacttaacttactttgcctcattcatgtttgcagtaacaagatgtatttgttttgtgagttgcttctgtcttttgaagggagggatgtggagtttggtggatatttgttactctcgcctttttttcagtccaaagaggccatgtggggaaacagcagaggtggaggcatcaccgctaacccacatagcctgccctctagacatggggcgaggcaacaagcggggagggagaaggtgttgaatgcgcctagcaattccgtgcgctatcttatttaattgccacattccacgtggcattttacggataggcggcagaggcaaacttctgtataaacaggtgggtctacactgtgggtcggggaggatgtgcctgaaatttcagcaccagcgattgagtcttttaggaaaaagtgccattgcatgtcatagaaccagaagtgtgtacactgctggtacaaatcatcatcatcatcgtcatgattgactctcagagttcacaaagcaccttcatatctcatggaaccttcacaaccatcctttaggttactggtccccctgttagacatgagcatgctgaagctagaggatgaattttaataacattcttaactattattggtctaacatggggaatatattgtgatttttctctgtaagaaaggtaatgtcttttttatttacttttcatacctagtactgtagaacatctgttttttaaaaaagactctgaccaatacagaaagaagtcaagtggattttcccaacacgactttgctttaagtgaagaaatgcaatgactttgtagtcttttcaaacatgtctgatataatatatggaatctttcttgaattcatttcagtataattgagttttctcctggagaaaataggtcccaattgcaccattttttctgcatttctgcatcaactctgtgaaatacatttttttttttggtttgtttgtgtttttttggagacagaatcttgctctggagtgtagtggtgcgatcttggttcactgcaccctccatctcctgggttcaagagatcctcctgcctcagcctcccgagtagctgggactacaggtgcacaccaccatgtccagctaatttttgtatttttagtagagatggggtttcgccgtgttggccaggatggtctcgatctcctgacctcgtgatccgcccaccttagcctcccaaagtgctgggattacaggcgtgaaatacagttctgaattctgaatatctgctctgcttgatgatagtgattcaaacttgatcagacttctgcttgatgatagtgattcaaagtctttggctaaaaatatgtcatatacacttagaatatatgttagttataatgtttgctagagccgctttgatagtgcaccacacagagtggcttaaacaatagaaatttattgtctcacagttctaaaggctgaaagtttaagatcaaggtatcagcatgattaaacatctaccctattcttcttgttcttttttatgacattggaatataccatatttgaaaaatgcattttagaaaaactaatggaatccaaataaagtttggaatttagtgactaataatatattaatattgattcattagttatgacaagtgtaccataataatgtaagagttaacaatagaggaattgtatcacaaatgaaattacaaattatgttacaaagcaaaagtaatcaaaacagtgtggtactggcacaaaaacagtcatatagactattggaacagaatagaaagcctataaatgaagccatgcataaatggccagctaatcctcagcaagagtgccaagaatacacgatagggaaaggatagtgtcttcaatgaatgatgatgggaaaactgttatttacatggagaagaatgaaattggatccgtatctcacaccatacacagaaatcaactcaagctggattaaagatttaaatgtgagacttggagccataaaactagaagaaaacatagggaaaatgctctttgacattggtctgggcaatgattttttggatatgatactaagagcacaggcaacaaaagcaaaaataaacaagtggcactacatcaaactaaaaagtttctgcatgcaaaagaaacaaggagcaacctatggaatgggagaaaatgttgcaaaccatacatttgacaagggattaatattccaatacatataaggaactcagacaactcaattgcaaaaacaaaaacgacctaattaaaaaaaacggaaaaaaggacctgacattttttcaaaggtgatgtacaaatgtccaacaggtatatgaacatcattgttcatcaaggaaatgcaaaccaaaaccacaatgggatgtcacctcacccctattgtaatggctactatcaaaaagacaaaagtgttggtgagggtgtggagaaaaaggaacctgttggtgggagtgtaaattggcacagccactacggaaaacagtacgggggtttctcaagaaactaaaaatagaattaccatatcatccaacaatcccacttatgggtataagtcccaaaagaaataaaatcagaatctctaagagctatctgtattgccatgtttattgcagcattattcacagtagctaagatatggaaacaacgtgtctataaacaaatgagtggatagtatatgtacacacacacacacgtatgtaatggaatattattcagccttaaaaaaggaggtcctgctatttgcaacaacatggatgaacttggaggacattatgctaagtgaaataagccagacacacagaaagacaaatactgcatgatctctgttacattttcaaaagtcaaactcatggaaacagagagtagatgggtagttaaccgggggtgggggtagaggaaatgggaaaatgttggtcaaagagtacaaacttttagtgataagaaaaacaatttctgatgtacagtgtggtaactatggttaataattattctatacttgaaatttactaagagagtagttctcaagtattctcaccacacatacaaaaaaggtaactagtgagtcggtggataagttaattagcctgtgtggtaatcattccacaaggtatatgtatatcaaaacatcgtgtggcacaccttaaatatatgcaatttttatttgtccatcatacctcagtaagactggaaaaaaatagaggaaactgagtgagagaggtatatgggaactctgtattatatttggaacttttctgtatatctaaaactattctaaaatccaaaggttattcaaatataaaatccttttataatataaaatagtgtctatattaaacattccatgaattctgtacttagaattattgtataattttattgtttttaatgccattgcttatacatgtttttgtactcaagaacaaattggatacggcctctagaggacagtgttgggtcatagaaagattttacaatttctgcccaagttgaagatggtcataatcatttttcttcttcttttctaaccacaagtcctgtttattcgttgtccctctgtaaaaacaacaataacaaagaacacttatgacccctctgctgttctgactagttggctgttttgttttaacttattttcgtataattttggttccacaaacatctattaggcaagaaagatctgcggagttggcaccataatgttcacatccctgagggtttgtgaaagttgtgagggaacccggggaagcgatatgaggcgtatattatgtgtcatttgtgagttcttccacgatggagacggaattatagagttgaacttcctttggaaaaacaaaccacggttcgtagcttgatcagggtgcatgtaagctaaagaggggttttggtcttttaaaggttgagactgcctgctctacagtggtttgttggtggtgggaggaaaggaaaaaaaccattgctcttgcttctggagcaaatttctggagtaatcagaatagcaactcaacattttaattttaaaattcctcctccggagataacctcgtaggattgccattgtatttgcccggggctcctgaggtggggagttgcagagtgctgctcaagtgcgtcagagccatatgaacattcacctgcaaaatgctcgccttggacttagaggcagctgaagacaattgttcatgaatggatgggctcagaaattctgaaacacacaattctgtcattgaatgcgctgaattttctgccgagagtggagtctgagggttctaccttgctaggtgtgaatctagtataaacattaaaaaataggagtcatttggatgatggtgtgttccacttagcagcaacctatagtttttcgtttgtttgtttttgctcgaagaataaatctgtccaaagctcatctgctgaattgggatctttgagccttttaataggagtcttgagagggagtggaaaatgtacagctccttatagatagcccgacatgaaagttaaggtcaatggtgttttgttcagccactccatccaagtcgaacccacgggcagggatctgttttgttctcatttactagtgctaagtgccaaacattctctttctcaggtatagtcttctaatttagtggtggtgtgacaaagttctatttaccatataggtacttaatacgtattatgatgatttaagatgtagttggtccttgagatcgtgattggtcccctcagctggtccctcactcaggattccttatctcagggaaaagcatcaccttatcccagtggtataagtcagaatcttgggagtcatccttgaatcctctgttttttccatccttactcataatgaatgcaggaccaggtcctaccaatttcacttcttaaatattttttgaagccatccatttctctctccatggccgccactccaatctaagcccttgtcatatctgcttagactactgaagaagctgcctcaccctcaagcagtgtgctcttccaaaacatgcatctatgagaccgtcactgatttcccattgttctcaggctagcaaccttatcactgtcatggacaagaaggccctgccgtcgggcccctgtctctctttctagcctcatcttgaagccttctccctgctccttgtactccagcctcctagccgccaatgtgtcagcagagagtcttcgcgtattcagtttcctctaggtgactgtctctcccctgctgtctctgtctcattaccttctactcatactctctaaatcagctggagtgttatttcctcatggatgacttccctggtctcctggtctaagaagtgttctttatttttttatttttattttattttattattttatttattttttatttttttatttatctatatatatatattttttgagacggagtctcgctctgtcacgcaggctggaatgcagtggcctgatctcggctcactgcaagctctgcctcctgggttcacgtgattctcctgcctcagcctcctgagtagctgggactacaggcgcccaccaccatgcctggctaattttttgtagttttagtagagacagggtttcaccgtgttagccaggatggtctccatctgctgacctcgtgatccacccacctcggcctcccaaagttctgggattacaggcgtgagccatcgcacccggcaatttttttattttttatttttttattgagatggagtctcgctctgttgcccatactggagtacagtggtgcgatctcggctcactgcaacctccatctcccgggttcaagtggttctcctgcttcagcctcccgtgtagcttggattacaggtgtgcgccactacgcccatataatttttgtatttttagtagagacggggtttcaccatgttggccaagctgatcttgaactcctgacctcaagtaatctgcctgccttggcctcctcaagtgctgggattacaggcgtgagccaccacgcccggccgagtgttctttattggctgttcttacagacccatgctccttcccctcactgtacttacatcagttcacagtgtctttggttgctgtttcttgattaatgtctgtctccctgatcagagtatcagctgtgctccagttgaatgatgaaggtaaatcttaaaaagataaagtaaaggaccatctctgtgagcaggggtcacgcccaagtgtgctcaccatccagagtctctagcacttggcacagtgcttggaacaactagttgctgaatacatttgttgaatgactaaatggctatttacttattgaatgtttaggtagaggaagaagaacccactggatacattcgattcgaaaaatttcttccggtgatgacagaaatactactagaaagaaagtaagtaagtaaatgcaattgttaaggcaaagtaatggtcagaattatgaatccattcatttcaggacgcttggctttttcactttgtgtgttatactcaagcagtgtgtcctaaggtggcctccctctaacctttcaagctacttctgaactggcagttggtacctgcttagaaatatcaaccacactagtgttatcctaagcaaagcataattagagggtaaataagctataaagatcgtaaatcaacattcttagtatcttctgttttgaattatcaatgataaataagaatcctaatatttttctagcaaaaatatagcattagcttaccatagttggttcatcatagaagtcttgtgcccagataaattgatgtccaaaaagctaatagataacctcaaacatgtcagtgattttgcactaaatatttcctgtggggctgaggtattttcaactttcatatccagaaatccaaaaagatttcaatgaggcaagtattatcatcccagtatgttagcagcttttattttattttattttattttattttatttttgagatggactttcgcttttgtcacccaggctggaatgcagtggcaccatcttggctcactgcaacctccacctcctgggttcaagcaattctcctgcctcagcctcccgagtagctgggattacaggcacgtgcatgccaccatgcctggctaatttttgtatttttagtagagacagagtttcactatgttggccaggctggtctcgaactcctgacctcagatgatctgcccacctcagcctcccaaagtgctgggattacaggcatgagccaccatacccagccctattttgttttatgtggtcatttattacggggatccccaaccaccaggccaggtactggtgccagtccctggcctgttaggacccctgggccacacagcaggaggtgagcagcaagagagtgagcattactgcccgaactccgcctcctgtctgagaagcattggcattagattatcataggaatgcgaaccctattgtgaactgtgcgtgttagggatctaagttgcatgctccttatgagaatctaatgcctgatgatctgaggtggagcagtttcatccccaaaccatccctcccctcccctggtctgtggaagaattgtcttccatgaaactggtccctggtgccaaaagggttggagactgctgatttattatgtaaagactgcggtaaataccacggcatttactcattttattgcataattatagatacagaccaattccagaagatgtccttcttcgagcttttgaggtatgtaaactccagcttatatgcatatacatatatataaatacatttatttacatacacacatatatgaaaaatttatcatgtagaacttattcaccaaatgaaaaatataatatctatcttttcttttcccctaggttttagattcagctaaacgtgggtttcttactaaggacgagctgatcaagtatatgactgaagaaggtaagtgtgatttattacttatcacaatgacttatgtgaggaattaataatttgttaacagttatgcgaaagttataggggatactttaaaatcagtcattctggtgaaagttatttactgttcctgctattttggcttggggatggtttctgttctgtgggggttaagaggacaaagagtagggaaaggggagatgggttgttgtctcgtagaattttgtgaagcacagtgattacttctataatttcaggcattgcattcagagcatttccagaataaaagatatgccatctggaaaacatgaactatcgatcactgtaaatgaaggcctcttcctagattgaagatttgaataaagaatataaaaattccgccccccccccggcgccccggcttttttttttttgagacggatccggtcttgctctgtcacccaggctggagtgcagtggcgcgatcttagctcactgcaacctccgcctcctgggttcaagtgattctcctgcctcagcctcccgagtagctgggattacaggcacaggccactgcgcccagctaattttttgtatttttagtagagatgggtttcaccatgttggccaggctggtctcgaacttctgacctcaggtgatccacccatcttggcttcccacagtgctggtaaaaattcccttttaaagagcttttctgtcagtgaagttacagataatgtagcctcaattgaatactgaggtcatttttaacactaaaaatgtccttttttaatgttaattgaaccatatatatttgttttgaacatggcccatcatacatatatgcatacacacacataaaacctgcacacttatatatatatgccaacatatttcctttaggaattctctctgctaggctgatgtgtaaatttgtttacactgaaggtcagtagcctgatggacagtctcctgaaaccatcctcatattggtccccttgccttctcccatacaaagctagagctctctggttcacagactgggtcctgaatgactcagagttgctaatcacttgaggcagaatgaaaagcgcaagtgattttgagtagggaagactaagactgcatctacacgcacaactggtttgaccattccagcttcatccaccttaaggcggaatacagagagtgagggtcagaatggcaaggccgtcacagctgccacccaagaactctgacgccattgttaaaattaccttcgggattaattctgatggggatgttacgactttcaaagcatcagcttcttcatcctgaggattagtctaaagaaagtaaatcctaggttatatatcaggcaacatgaatttagtcaaaatggcccaaacagttagattttcctactgttgtgtgcctactatatgtttaatatttagtaagtgtagtaaggtataatgatacttaaatctacttcctctctcaaggatattacaatcttatttgggaaataaaactaacataaaataattcacaatacaagacaatagaaagctaaatatcagaagatcaactagggctggcccagcctggaaaacttggtttgggaagacttaaagagaaaataggttttttgagatggtagaatgtatatggttaaattgttgagggcaaaggtaaactcttgtgcattataattctgtcacacatggtagatatcaacaaatgtttgttgaatgaatgagtgaatgagtagatgatgaagaccaggtgaaggggctaatgagagggagacattatcgatgtgtaaaacagtctgaacaaaaatggggaggtaggaatgaacatgctatttcagagagaaaataagcctagctggcccagagggtaatgttggcaaacagcaggaaattaacttcagtagacttactgggactaaattgtggagtcccaggctcaggagtttggaattcatcctgtgggcgatggagaagtattacaggcttttgagcagatgactcacatggtgtgtgagtgattgtgagaaggtttttctggtgctggtcggtttgttagatgcataagaaagaggttggactagggaggccacttagaaggttatttcagcattttgagggcacccaaataagggcctgacctggcagtgggaatggcaatgggaagaagggattggtacaataggactgtctgtggcaggatccatgggtcatgatgagtaacagagtgtaggcgacaaagctgagagctgaatccaaagtaccaccaaggctttgccctcgatggcgagtatgatggtaatgagactgactcaaacagaaaggtcagaacagaccgcagtgtatacagagacagtgcgaccacgtggtttacttggaggtgctgtgtgataatttcgaaaatggtatgtttacagagagttcatggtacttaaagatcaactattgagtatctcagcggactaagcataggacaggtatggtcaaataagaatacatatgttttcaattattcactcagcaagtattattacaaaccttccacatatatgaaccaatatgtttggaagtaatatgtaagatgtaaatctatacaaatctaagttacgatttaatataacagacccatcagctaagtgtaatagcagttgactagtttggtaaaataggagcttaagaattgctgctttgagagtctcagaattctacaaattgtttttaagtacatttatgctatataacaatatggattcaagctacttgcacattcatcctaatatccacaaagtatcaaacacactagtttgagaatatgcattcctacagccctggatgtcatatgataaaataaatcacactgaatcaagttcctacaagatagaagtccctaagtgtccaggaatgtgtattgcatcagacagtgtttagcagccgggaagatctcagaacaattttttaaacaaacacttgcatgttgctgcttctatgccaggtactgttctaagtcccattcaaatcataacacgtttcattctcatgacaaccctatgtgacaggtggtgtcgttatcacccccattctagagacaggtaagctaaggtggggagctgtgaagtgacttgctcaagatctcagagctcgtgagaggcagccagcatgtggatccaaacttgtgctttaaccactcagttatcttccttccatctttcatcaaatactggggcttcaagttaatcctctggtaatttcaaaagttttaatctaaataaataaccttgttcatgatgtctgtatgtcttcctactgttttgcctgaaatgacgtgttctagaggttgcttgatctatgacatctgcaggctaaaagaagtccagaatctaccagggtgtacaatagccttgtctttgaacctctggactgtcgtgatgtcctggctctacagctccagggagcgtaactagtggcactgtgggagcttgtggggctccatggctattaagctggctagtggaaagagaaaaaaatcagatgatcctaaatgataaattttcctttttgtctctctgaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataaattactatttatttaaaaactattcttaaaacattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaatttattttttt

SEQ ID NO: 2228 - DNA, 154901 bp, Homo sapiens
ggccaggctcgccgcggggcgctgagcaggccgggacaccgcggccgaggttatcgttaggcatctcccaggcgaccggctccgcagcaagatggcggacgagaaggacagggaaggtaaggtaggggagccggggagccgctgccctcgccgcccgccgcgaccccgggctgcacggggaagcgccgggtggggtgggccctcgtccatctggagttcccacccgcagggaaagggcggcctgaggagggggccacccggcagcagcagtcgccctgcccccgtccccgtagcccgcccggcccgccgctccgccccgccccgccccgcctctctcccccgccccgccccgcctctctcccctcttccctccctcttctctctcccctcctcccgccttcttctttctcctcccgccctcttcaccctcttcccctcctcccgccccgtcctccttccccctccctcggaggccgggccttgcatcctgcgcgggctgcgccggaggcgccggcagggggtgctgataatggcgtcgttgttcacggtcgcggggaagccgccgccgcctccacactctcgcctggggtctcggtgccgcaggcgccacgcccgtagctgtccaggctgtgggccccggggggtggcctgggtgaggaggagttctggccgcctgaatctgacgggatcctctgtttgcgccgaaaccccgcgctggcgcagcctgatggcgttcgcggccaccattttgcctccttaatgaggacgcaggaggacggtctggaggtcacagccgctgcctccgagcttcccggtcctccgaaatgcctgccccgccgccggctagcgccgcgcaattggcctagtgtcttgtcttaaaaaaaaaaaaagacacacacccaaacagcaattttaataacgacgaaaaaccaaaacctggttgagatcttggaaccgctgtgcgccggccgggcctctcccaggggaccacccagccccgcgcggtggccgcctgcagaggcgggactgcgcttcgaggcttaaggtcgccagttcggaggcatcgatgtgttgtctgtgcggagaagccaaaaagtgattacgtttatttgcaagaccgttcatgttgttttcagttcatggtatgattaaaacccgatcctttgttaccatgcccttaggtactaaaaaataattgtgtttgatagttggcagtcacccaaaaatatccaaaaagccatgaaacagtaaaggtaaacaagtaggaagtgaaaataatattcgtcctttgttttctttctggagtgctcaaaacaccctctcaaaccatttttctcagcatagaaccaagtgtggtcaggttaacagctaatatttacaagggaagaaacgaaccctgagatatttagtcacttgttccggtgatcacagaaaatcggcgaagaaacacatgaaactgccaacgatctctctattgataacaaggataccgtgatttttatgtaatattaatctgagaagccaggattattttgtaggtattagctttacgaagatgcccttacatacaaagaaaaggataattttaaaactttcccagaaaaatggatggcttatttttgttctttaccaaaaaaaaaaaaaaaaaagccattaggagataaactagcaaggtaattatggatatttattttcttaaaaaagacttggttaggtcagcatgagaaaaaacgcactggagtatggtacaaatacagtatttctcgttttttaaaaactgagagctttcctgatttttcagcttttgaacaatttttttccatttaaagtaaattcagagaaacaattttgtcgataactcatagaagtaatgactgttaaaagctggatgccattcattcagaatacatatattcaatgccattatgtagataaggcattctacttagaactttgaaagatacgaaaatgaaagacattgtctttgcttccaaggaaggtgagatgagtaagggagatgagaaatttacaaatgggaggaaatagttaactgggctgagtagtctgggtgccaaccactgtgctaggtgtgtatccttgtagtccgtggacagcagcctggacatcactggctgccaccgacctaataatgaatcagtcttcattttaacatgtttgtaggtgatttgtatgtacattaactttcgagaaggccgggcgcggtggctcacgcctgcaatcccagcactttgggaggctgaggcgggcggatcacgaggtcaagagatcgagaccatcctggccaacatggtgaaccccgtctctactaaaaatacaaaaattagctgggcgtggtggcacgccctgtagtcccagctactcaggaggctgagacaggagaattgcttgaaccggggaggcggaggctgcagtgagccaagatcacaccactgcactccagcctggcgacagagtaagactccgtctcaaaaaaaaaaaaaaacaaaaacaaaaaacaaagttcgagaagcactcatgtgctgtatctcatttattgttaacagttttatggattaactaattgcagtttgtgaagggtattatgaaataaaggcattttgttagaggataaactaagtagagactcattttggtggtaagatctttttatggaaatagtctattactatatttgattgtcagctactgtattttgaattttcagaaattacgtctaaccaattaatcagaattgattaagttttgaggattcactcaactaaactcataaaagactgatgtgcaaacctgaatgatttattaatttaaataagggtatatacattgacttgaaggctgattttgccaatatactaatataataattttggcaatatactaatataataatatactgttttatgggtactaagcttcgggtagtgtgaatttgtatttcagaagtcatttgatgaccgtggaatcacacaaaagaaaggataattttgaaggatgtgttcagtaccctctaagttccaaaagatctgggaccatttctgatctgttaatactgagtgttgtgcagagtgcttggaacgtggtaggtaatcaataaatatttgttgaattcagaacatttgaattaatcaaagacagcttatgagattttaaccaaagcattcctagctattttccccaaacttattctatacctaaaagtacacaaaactcgttttaggtctcttttcccctctgctttaccggtaagatacattcttctattccatctggctcaacaaaacgttttatttcacagtgccacggtattcactagcatgtctttaaaaaacaactacaaaaaacctcattgtagaaatacacatatgttttaaatagttcatccttaatattgagatttctaaaagttctaaagggggaataagtttcagggtacctatcctatccactcttcttcaatatttagagattaactttgatagaagtattgagaatattgataagaaaaattacctaaattagaaggggctattgtgctcataaaatttttttctaagattatgtacgttgaagttgttatacttatttgtagcattttttgctttcatacagtataatttattttttcatagattaaaaattatacagaattatattagctaaaagtttaacctttagaaccaaattatttttaaaaccacttttttaactgaaagaagaatgtttgaaacgggatgagaaaaaatatttttgaaggtttattatttttccaaagtttcctcagccagaacattttttgttttgttctttcttttccttctgttttgtctgtttaaatggagagtcaatgcaattgttgattctttggctccttaaatcttattgtttctgtctcttagagaattttatataggactggaaggatcttctgtttgtaattagactcacgtctaggaaacaaactgcttagttataaaatttgaacttttggcagccagtgagctttggaaagtaagaactttttagtaagctgcagatattaaaagctcactctaggatttactatttttgtttctattaaaatattctttgttactttgcgtgctttgataacattgcttgataaagtgcctctaattcaattatcacctcctaaatggaagaggttttacaaggtttgttgttttgtttctgatttccttcattgtgccactcttttgaaaacccaacatttggaaatataaagtaaaaaacagaaatttcaggtgcctattactttataaaaagggttcccttaaataacgtctttgttttttttttcttcttttattttgagacagggtcttgctctgctgcccaggctggaatgtggtggtgcaacctctgttgcctaagctggaatgtagtggtgccatcacggctcactacagcctcgacctcctgggctcaagcgattcccccgacctcagcctcccaagtagctgggactacaggcgcaagccaccatgcccgactaatttttttaatttgtagagacagggtttcactgtgttggctacgctggtctcaaactctttattttttttatttttattttttttttgagatggagtctcgctctgtcgcccaggctggagtgcagtggcacgatcttggctcactgcaagctctgcctcccaggttcacaccattctcctgcctcagcctcccgagtagctgggactacaggtgcctgccaccacgcccggctaattttttgtatttttagtagtgatggggtttcaccgtattagccaggatggtctcgatctcctgaccttgtgatccgcccacctcggcctcccaaagtgctgggattacaggcgtgagccaccacgcctggctcgaactcttgagctcaagtgatctgcctgccttggcctcccaaagtgctgagattacaggcatgagccaccctgcctggcctcatagtaactgtcgatagtatagagtgtagcctgtgggacagtacaaaggttgagctttgaagtaagacttgaatttgaattccgtcttccccaagctctaattatctgatcttagccgagatgctaaacataagtagcttcaagttcctcagatgtaaagtggggataattatacccccaatatttcataatgttgtaatggggacaatgttttcttattcatttttacatccccagcacctgccacagtgcctggcatcaaaggaatgctgaggccggctcacgcctgtaatcctagcactttgagaggcccaggcaggtggatcacttgaggtcaggagttcaaaaccagcctggccaacatggtgaaaccctgtctctactaaaaatacaaaaaattagctgagtgtggtggcgcgtgcctgtaatcccaactactcaggaggctgaggcaggagaatcgcttgaacccaggaggtggaggttgcagtgagctgagatcacactactgcactccagcctgagtaacagggtgagactctgtctcaaaataaataaataaataaataaaaaatacaataaaggaatgctgaataaatgggaaagaaagtgtttggtacgtatctagtgaattagtaagtattagtatctgcttaacataaaacataagagttggccaggcgtggtggctcctgcttgtaattccagcactttgggaggccgaggtggggagatcacctgaggtcaggagttcgagaccagcctgaccaacatggtgaaacgctctctctacgaaaaatacaaaaattagttgggtgtggtggtggttgcctgttatcccagctactctagaggttgaggcaggagaattgcttgaacctgggggatggaggttgcagtgagcctagatcgcagcattgcactccagcccaggcaacagagcaagactccatctcaaaacaaaaaaacaaataaaacataagagttaagaaaacttttaagtcttaccaattgggatcatgcataatgcattcctgcatatttctggggtaatttaataagttttcttcctgttttagaccaatataaatatccggttaagactaagcaaacaagaagactagctttttgaagcctaatttgtttcctcttattcagaataaaaaaaaatttgaagaaaaactggactgaaatttgtttttgctctgatatataaaatttacagaaatgtctcaagaatagtcataattttaaagatcaaatggacagtgagatactacctcacgcctgttaggaaggctattatcaccagaagtcccccaaataataagtattggtgaggatgtggagaaactggaaccctcgtggactgttggtggcaatgagaaatggtgcagctactatggaaagtggtatggcggttcctcagaaagttaaaagttgagttaccatgtgacccagcagttccacgtgtgggtatatatccacagtaattgaaagcaaggcctcgaagagatatttgcacaaccatgttcatagcacattgttcacagtaggtaaaaggtggaagcaagccaagtgtccatcagcggatgaatgaacaaaccaaatgtggtatatacgtgtagtgaaatattattcagccttcaaaggaggaaattctgacacatgctaccgcttgaatgaacctgaaagacatcatgctaagtgaaataagccagtcaaaaagacaaatactctgtgattccacttacatgaggtacctagagaagtcaaattcatggagacagaaagtagattgctggttgccaggggctgtggggagaggagaatgggaagttgtttaaggagtgtagagttccagttctgcaagatgaaggaagttctggagattggttgcccagcagtgtgaaggtacttaacactattgaactatatggttaaaagtggttaatacagtaagttttacattatgtgtattttaccacattttagtaaatagaaaatgttgagtacattcagaatgaaagaaatggtacattgtttttcaaaggcaatttggaaatttgtattgaagaataaatgatgatggctaggcaaggtggctcacatctgtaaactcagcactttgggaggctgaggtaggaggattacttgagaccaggagttcgagaccagcctgggcaacatgctgagacctcatctttgctaaaaataaaataaataataataaagaagtcgggggttccctctgttggctttggagcccccatccctctgtctctgtacagggaagcttcttccttctcctttcttgctccttcttgcctgttaaactctctatttcttaaaaccaaaaaaataaaaaataataataaaaagtgatgtccacatgctttgagctttaatatacttctggatatttatccttagaaatatattctgaaaagaataaaaaatgctctaagcacaaaaatgatcaacataaagttatctataaatttgaaaatatagataacatttgcatgtccaactaatggggcatacaaaataaatggttgtatgtccacttgttgggttgcagccaaatatataaaaattatatgtgtaaatgggtaaggacacgtgggggagcccaggagatgatgatgatagcagggtgattagacttttaggggcacttatttttaaaatctcattttaatgtcagttctacaaaactttaaaaacccacttaaatatgctaattaaaaattattcttacccacttgtgaaagtgtgtttaccagatcctgtacttgacaatcctttgtaaacctctagtatggattttatagatattaagactgtaaaaaagtaattttagtttttatttttattttttaagagatgagatctaggccgggcgcagtggctcacgcctgtaatctcagcactttgggaggctgaggctggcggatcgcctgaggttggaaattcaagaccagcctggccaacacgggaaaaccccgtctctattaaaaatacaaaattagctgggcatggtggcgcatgcctgttatcccagctactcgggaggctgaggtaggagaatcacttgaacccgggaggcggaggttgtgatgagctgagagcaccattttactccagcctaggcaacaagagcggaactccgtctcaaaaaaaaaaaaaaaagagacgaggtctcactctgtcaccctggctggggtgcagtggcttgatcacagctcactgtagcctctactttctgggctcaagtgatcttcccactttggcctcccaagtagctgggactgcaggggcgtgccactgtgcccaactaacatttttatttttggtagagataagatcttgctctgttgcccaggctagtctcaaactcctggcctcaggcaatcctaccaccttggcctcccaaagtgctgggattacaggcttgagccaccacctctggcccataattttatttttttaaatgcactagtaaaattgggagtttaaaaacctggactagaatttggacattgcctttttttttattctttttaagattttgcttgttagtgtcaatttatctgacctttggtttgaagaatttccatctaaagaggaagataggcagctaaggagacaatgatacaataatgtgataagtgctatgatagttgcacatgtatgatgattgggtgcctggggagagtcacctgattcacacacaccctctttaaattatagcccctttttattccctctcatagctatttgtttttttcctctttcatactatattttgtaattgcctgtagatgtgttgtttgatgtctgcttctcctagactcttaacttccaaaaggataggggtcatgctcatgcatatacccagagcatggcatatagctcagtatttgctgaatgttgaatcaaagttggctttctgaaggagataaccgaagcttatcttttttttttttttttttttttttttttttgagacgtagtcttgctcttgtcgcccaggttggaatgcagtggcgtgatctcggctcactgcaacctctgcctcctgggttcaagcgattcttatgtctcagcctcccaagtagctgggattacagacatgtgccaccatgctgggctcatttttttatatttttagtagacggggtttcaccatactggccagtctggtctcgaactcctgacctcaaatgatccgcctgccttggcctcccaaagtactaggattacaggtgtgagccactgcgcctggcctaatttttgtatttttagtagagacggggtttcaccatgttggccaggctggtctggaactcctgacctcatgtgatccgcccaccttggcctcccaaagtgttggtattacaggtgtgagccacgactcccagccccaggcttatcttgaaggtgtaatagcacagagaacaagtaggggatggatatttcaggaagagaagaaataacatacttgaaattgtgaagactcaatatggccgaaatttaggatgggttaggagatgtgggaatttttattcttaaagcattggtgagtgattaaaagtttttaacaaggccgggtgcagtggctcacgcctgtaatcccagcactttgggaggccgaggcaggtggatcacgaggtcaggagatcaagaccattctggctaacacggtgaaaccccgtctctactaaaaaaaaaaaaaaaaaaaaaaaaaaaaattagctgggcgtggtggcaggtgcctgtagtcccaggtacttgggaggctgaggcaggacaatggcgtggacccaggaggtggaggttgcagtgagccgagatcacgccactgcactccagcaagggcaacacagcgagactccgtctcaaaaaaaaaaaaaaaaaagtttttaacaagatgggaggctgaggcaggataatcacttgaacccgggaggtggaggttgcagtgagccaggattgcaccactgaactccagcgtggctgacagaatgagactctgtctaaaaaataaaaatgaaaaaataaaaaataaagttttttttagcaagagacaatcatatttgttgtctagaaaaatcacttgggcaagtgtgctcagtggattagatggactccaggtttgggactccaggtttgtcccagtatagtagtccagaaagataaaaccctgaaccaaagtaatggaagtcaggaatgaaacaaggagataggctagaggaaatggatagattttgtaataggacagatatgaatattgagtcaggtcagggacacggtttctgattgggtaacaaagaataaagaggaatagtagagttatgtaaataatagttctagtcttgcacatgttgagtttgggtgcctgtgaggcattcaggttgagatataacataggcagcactgtgtgcttggtacctaaatatctgttgaatgaaaaatgagaatgatgtgtgttggatcgcttgaatgtattcctctgtaagtggttgtagtcttgggaatggttgagaatgtccagaaaaaatggatacaattttgttgactgaggccgggcgtggtggttcacgcctgtaatcccagcaccttgggaggcccaggcgggtggattacctgaggtaggcagttcgagaccagcctgaccaacatggcaaaaccccctctctacccaaaacacaaaaattagccaggtgtggtggcaggcgtctgtaatcccagctacttgagaggctgaggcaggagaatcgcttgaacctggggaggcagaggttgcagtgagccgagatcacgccattgcactccagcctggatgacagagtgagactctctgtccccaccccaccaccccaccgccaaaaaaaaatgttgactgaaaggagaagtgactaggatcagaactctgggtaaaaatcagtaattgaacagagaaaaataacttgtgaataagattgaaagcacaattgcaaaatcatgggaaaatgagcaaatagtgtcacaaaagccaagtaggaagaatttcatgaaggaagcacttaaaaatgttgggaaaaactccccaatggttaacatttatagagcacttactctgaagtaggcactgggctgaatgttttacgtgtattatgtcctttaatccttacaataaatctatgtggtaggtgcctctgttacccgctttccacaagtaaggaaatggaggcttagataggtaaagcagccttccagtttcagctcaaaaggtaagcgcttggaagtcatcactccggttgctcctggagccataaactgcaagaaatatttgttaattttgacaaattggtggaggctgcgtgtggactgtcatgagagtgagaaactcctggaggcctgcagtcttaggcggtccctcacacttcctccggttttactcctaggaaccccacggggttattctggtgaagagccaagcaaggttggtttaacaggggaaggggaaagcaacgcttttgaaatatgctagtgcattcttcataaaaaggccaatttcagtggccgctagtctggtcttatctcaacggatggaaaaagctgaaaaacacttgtgaaggtcacagcccattgacacaggtccactaaaagactgagatttcatcgtaagttgatagaattctcctcacccatccctcaccaccacatcaacaggaatacaactcagaccaactgacagcggcttgcagctggaagacctacaaggtggagactctatttaaggacaagttcttagggaagcctgaagaggaatctggcacctacagctacagcaaacattaaacacagccctactcctagccagattggggtaaagcctcacactagtagctgattactatcatgtctggcttccaacaaaaaatgacaagacatgctaataggcaagaaaaacagcccgaagagacaaagcaagcatcagaaccagacttagatatatgataatgggtgttttgtaattatcaaggaatttaaagaactgtgattaatatgttaaaggttcaggccgggcttggtgacgcatgcctgtaatcccagcactttgggaggccaaggagggtgggtcacttgaggttaggagtgtgagaccagcctagccaacatggcaaaaccccatctctacaaaaagacaaaaattagccaggcgtggtggcgtgtgcctgtagtcccagctacttgtgaggctgaggcaggagaatcactcggaccctggagtccatagactcaatgtggctgaggaaagaatcattgagcttgaaggtatgtcactagaaactttccaaactgaattgcaaagagagaaaagaatgaaaaaacaacacccaagaaccatgggataatttaaaaggtgtgaaataacatgtaattgaatgccagaaggaaaagaaagaatagagcagaagaaatatttgaaaaaatgggctgagcgggcccagcactttgggaggctgaggcgggtggatcacctgaggtcaggagatcgagaccagcctggccaacatggtgaaaccctgtctgtactaaaaataaaaatacaaaaaattagccaggtgtggtggtgggtgcctgtaatcttagctacttgggagcctgaggcagaagaatttcttgaatccaggaggcagaggttgcaatgagctgatatcgcgccattgcaagagggtgagactccaatctcctagggaaaaaaaaagaagaaaatcatctggaaagcttgttaaaacatagattgttgggtctcaccctcagtaatctggagtgagggggtctggaaatttgcatttctaacaagttaccacaggatgagcatgctgttaagaaacattgatctaaaatttaaagtgaattttgccatttcagtgtatttccttctaggttttgtctaggcagatttgtattttgttttgttttacaaacttgagatgatattgaatatggttttatgtccagcttttttcacttactattagaaacattttttcatgtcacaagtatttcttaaagacatataaaggagttgcattcattatattaggttggtgcaaaagtaattgtggtttttgctattaaaagtaatcgggcctggcgtggtagctcacacctgtaattccagcactttgggaggctgaggtgggcggaccacttgaggtcaggagtttgagaccagcctggccatcatggtgaaaccctgtctctactaaaaatacaaaaattagccagttgtggtggcgcatgcttgtaatcccagctactcgggaggccgaggcaggagaatcacttgtactcaggaggcggaggttgcagtgagccaaggtcatgccattgtactccagcctgggcagtagagcaagactctgtctcaaaaaaaaaaaaaaaaaaaagtaaccggaaataccgcaattacttttgcaccaacttaacctaacattaatacttatggtcactatgatttacttaaggtttgtctaactgttagatatttaaattgtttaaaaatgttctgttgtaaatgttcttatacaaggattttttttttgacccagctttgatcctcatcctctacccactttggaaaaatttcttttttttctggagagacagggtttctctctgtcatccaggctggagtgcagtggcccaatcttagctcactgcagcctcaaactcctgtgctcaagcggtcctcccacctcagactcctgagtagctgggactacaggtgtatgccaccgtacctggctaatttttttggggggggggaataattttgttgaatcccatctctggtgggtcttcctagttacagaggataacccaatttcccaattctgtgagtaccttgtgatccttttgtattaattacattatttctctccaattttaaagaaatcaatcatagacccacatattgccattcagagcttatgatcaggataaaatacagatttgcttattgtctctctatcctgttacagtggaaatgataggaaactagatattttgtttcttttgttactaaatccctggatttagaaaatgtgtaggatatagtaatcactgtaaatatttgttgcaagaatgcaggaaccaggagtagcacattgatggcaccttgcatcttcttattaagagtaaatgtatttttctgtgaatccttttaaaatactgaaaataggctatgtgtggtggctcacacctgtaatcccagcactttgggaaattgaggcaggtggatcacctgaggtcaggagttcgagaccagcctggccaacacagagaaaccctgtctctactaaaagtataaaaatgagccaggtgtggtggcacacgcctgtagtcccagctactcgggaggctgaggcaggagaatcgcttgaacctgggaggtggaggttgcggtgagccgagatcatgccactacactccagcctgggcgacagagcaagactctgtcaaaaaacacccccccttcaaaaaaaaaaaaaaactccctcaatttcctgacacatacgtgtttatctgtacttactggctccttacaaaaacctcttacctggtttacttgttttcatttattatgctgtaaatctggttattggttaatgaattctctacctaaaatccttaatgtcttcccattacccttaggatagtctgaattctaacaaaacagacaaggatgtcttctgtctccagggttttttttttttttttttttttctgattacatgtgtggtatcaccattcacgcattctacacttcattatacgcttcatcatagagagcaatttctttgttgttcctgtaatgaaagtgctagcctgcgcacatattgtttccttatcccagacttcatttagtaaatagcattgcttagtggttaagaacatgaagtctgtagttaatccttatgggctcaaattctggctttgccactttagagctggataactttaggcaaggtacttaggtgttctaatttcttcacatgtcaaatgaggagcatagcagagcctgtcccatgtggtggtaaaggatgttgtggagaacttcacatgccgtaagagctctagaaatgttatgagtccttacttaccgtgttaggcctggtgctagatgttggggaataaaacagatttgggccctgtcctcttagatattgctgtagaggagagaaccattaaagagttacataattattgggccaggtgtggtggcacacacctgtaatcccaatactttgggaggccaaggtgggcagatcactcgaggccaggagttcaagaccagcctggctaatgtggtgaaacccccgtctctactaaaatacaaaaattagccaggcatggtggcacacacctgtaatctgagctacttgggaggcggaggcatgagaattgcttgaacccgggaggcagaggttgcagtgagccgagatcgtgccactgaactccagcctgggcaacagagggagactccatctcaaaaaaaaaaaaaatacataattgttataagcagttcaaaaaagttcagggttccacaaaagggacatctgatttaaatttttcttttttctttcttttatttttttttcagacagagtttcactcttgttgcccaggctgaagtacagtggcatgatctcagctcaccacaacctccacctcccaggttcaagtgattcttatgcctcagcctcccgagtagctgggattacaggcgtgtgccaccatgcctggctaattttatatttttagtagagacggggtttctccatgttggtcaggctggtcttgaactcctgacctcaggtgacccgcccacctcggcctcccaaagtgctgggattacaggcatgagccaccatgcctggtctgatttaaatttttcttacttcagtggctttgaatgtgacatttcctctaccaaaaactactactagtaacagatggaactgcgaatttacaagcctgaagtaagaaaggagcatagcttattagaggagttgcacgaggctccattgtggctggaatggagacatgaaggtgggaagaatggtgtgaaatgaagtttgaaagtaggcagaggccaggtctttgtgaagaccaggtcagggaggctgacttctatacaagagcaagagggagccattggagctttttaaacagggaaatgatacaattcattatgtttttaagaggtcacttggccagatgtgatggcacgagcctggagtcccagctacttgggaggctgaggtgggaggattgcttgagcctagaagttcgaggatgcagtgagctatgatcacacctgtgaatagccactgcactccagcctgggtaacatagtgagaccctgtctcaaaaaaaaaaaaaaaaaagatcacttgcttgcactgtggaagggtggagcacggcaagagcagataatgatggtggtgtcttggattagacagcagcggaggaaatggcagagaaggtttgagagtcaagagagtctaaacgtttttgtgactggatgtggggactggaggagacagggatgaatgaacacctttcagtccaacttctgactcttgcttctcatctttatctaaggtccatcctcaagtctgaggtgggtgccactcttgtgcctccgtagggctgtctgtgtatgtcactaagttttagcactgatctgttgtgatttactatagctggtctgttttccttttaagttagaatgtatttatagtagatggtagctgatcaacaaacatttcataaatgaaagcacagattaacataaaagtagatgatgattgagtacagtatttctttctttttttttttttgagatggagtcttgctctgtcgctctggctggagtgcaatggcgcgttctcagctcactacaacctccacctcccgggttcaagcaattctcattcctccgccttccgagtagctgagattacaggcgtgcatcaccacacctggctaatttttttttgtatttttagtagacatggggtttcaccatgttggccaggctggtttcgaactcctgacctcaagtgatccgcccacctcagcctgccaaagtgctgggattacaggtgtgagccacagctacggtatttcattttaagcctagtgttttggtggtatattgtctttggatcaagttgtttatgaaaaaagaattctcaaagaactattcctaccacctctctcccctgacccccccagccaaaggccaagaattggattcttgatttttttttttttgacagcatatgtctggaatatgtattggtattaattgggtcaaatagaacaataacattatctgtactttcagttaattaaccttgagggcatttctttaccttcttttttgtatgctttaaacagttcccatggtaagtattcctcttggggcttattattttatcttaatttctgtaggtgggattttgagtatctaattagatatttaaatatgtaaacagacatctccatgttagaaaaaactcagctgcactatttgtttaaaaaacttctcttatatccttaggtgatttgacttgtgttttgttatgactgctcctttgtatttattatcattaatttgttctttcgaaattaagtttaactttttttgttgtttttctcctatggtttagattttaacttagtgcaatatgtagttttttagtctttgcagcatttccattgatggaaaacaaatacagtgtgaaattgttggctttcatatacccaatatggaattaaagtgaaaagggaactatttaatttattatttttttaaatgagatcgggtcccactatgttgcctaggctggccttgaactcttgggctcaagcgatcctcccgccttagcctcctgggtagctagagaattattatataatggtataacttgcctcaactgggatttttatcaattaagtggcattttgttattatattgacatactaatttagttatatttattttataataagcaacactgctgtttatattttgtggcctattagagtaggaacaactaaaaataaggtaaataatatatttttaaaggagcatgaaataaaaaattttatttaatatttaggaaagatgatatgcgtatccaacccattgcaaaaattatagtaattgctagttccaaaatattgttagtgaaatgtcatcagattcctataaggcttatatcttcatgaaaagtaatgctaataacactgagtgtgacattagacctttgcctgttttctctctttccatatatgcttcctgtgaatgactaatagaaaacttattttctctcaaccaaatctgtgtaacttactttcctgagatactaggcaacttccctacgttacaaaaaattagtaatgataatgggtaactttgattgaatattcctatagttcaggtggtaaccctcaaaacaaccttgtcagctagatactcgatattgtgcttttcacagatgagaaaaactgaatatttgagcagttatttatcctaaagattacagagctatgtacgtatgaatatgtaagaatatgatctttaaaccaggtggtctggttctagagtctgtgatcttaaccatgacactgtattgcaacctagaaatggtggcaaaatttgttcaaagtacaatgttaataaagtaattttgatttatttagttattatttatttattttttgtagagacaaggacccactttgttgtccaggctggtcttgaattcctgggcacaagcgattctcccaccttggcctcccgaagtgttgggattacaggcatgagtcaccacaccaggccaataaagtaattttaaaaattaactaaagtccatactttactcagattttcttaatttttacctaatgtccttttctgctccggagtcccatcaaggacaccaggttaccatttagttgctatggctccttcggctcctcttggctgtgatcgtttctcaggttttccttgtctttaatgacctccttgacagttttcagaatgggtcagaatgcccctctattagaatttgatgtttgtgtcctgattagactggtggaatgggattttaggagggagaccacagagttaaagtaccattttcatcacatgacatcaaggttatgtactattaatatcaatacaattgatcactgttgatgttagcctcgatcgcctggctgaggtagtgtttgtctggtttctccactgtggtaactctgtctccccattccgtagtctttggaaggaagtcatatgtgcagcccacactcaaggagtatggagttatgcttccctccttgagggcagagaatctacatgaattatttgaaattcttctgaacagaagatttgtatcttttctcctatatatttatttacagtttcctctattcatggtttggctttccgtggttttagttaactaaggtcaaccaagatctgaaaatattaaatggaaaattccagaaataaaccattcattttaaattgcatgctattttgagtatcatgacgaaatctctctctgtcctaccaggatgtgaatcatcgctttgtccagtttatccacattgtatatgctacctgtctttaatcattgacatcttctgcttctgacatttaaccatgaacattgtcatggctcgggatgacccgggatctcccaaggcaggtgctcttccttttggtgtatcatcaggtcaacagtagcctgacactgcatcatggtgctctgtgtcattcacctcacttcatctcatcacgtgggcattttatcgtctcacatatgacaagacgcatgagtacagtacaataagatattttgagagaggccattcatatagcttccattacagtatgttgttatgattattctattttattattggttactgttgttaatttcttaatgtgcttaatttatcacaggcatgtatgaataggggaaaacatagtatatatagggcttggtgttatctgaggttttaggcacccactgcaggtcttgggacttatccctcgtggataaggggagactactgcacttgatcattcattcctgtcagtatggacacattggatgtttattttatactttgggttatgagccagtactactttattcattttgttgctcaaattgtttcagctttggccattggaagctcttttcgctggctcctatgtcactatgacatagccccatcaaggtgtggtgtttttggggggttttattgagacagtgtcttgctctgttgcccaggctggaatctcgatttactgcaacctccgcctcccaggctcaagcagtcttcccacctcagccttcctagcagctgggactacaggcatgagccactgcgcctggcctaatgtgggtggtgtttttttttttgtacttctactactactactactactgctaggatctagttctactcagtacttctggcaccaaatgtgtgggttttccacaccaaacaattctccagttccctgtggacaccaactgggagtcctacaattcaactcaatttaataccaactacccagagttactacagatcccacaggttaaggatttggtcccacaagaccattccctaggaaagtaggctaactgctgattaaaggtagtggatccttaagttactcacacttcagttagatgtggctacaaattgggggtttccataacccccttcttagttccataatttgctataaaggttcacagaactcaaggaaacactttgtttaacatttactggtttatcataaaggatgcaaatgaagaaacagatggagtgacataaagggtgcggtgagctctgccaggtaccccagctgaggagcttctgttctgtggagttgggtgcactattctcccggcatgtggatgtgcttgccattccagagctcttggaacccctttgtttagggtttttgtgggggttccattatgtaggcatggttggttcgatcactggccattcgagattcgctcaatccccagcctcttccctctctggaggtcacagggtggggtcaggtttggggaatgagtcagaatttttggcagataatttctattttgtattagctttctggattattctgattccattattgtaacttgtttactatggtccagctttatgccctttgtatacattatgacttttaatcctcgtaacagccctgtgaggtagagaaatagagcagtaggagtcagggcctgtttggtcagcattttgctattaccacctttttaaacttttataggagtggctctgaatctctagaaagtcatgtaaagatcttgatatttatttaaaatcataaacaaatattcacaaggaaactttttttcttgacattcagtatgttttaagtaattttcatgtggttcgagccttgtaaaggtttttctggttttcatagtgtagaaagtaaagaaagctgttacaattgactgtctggactgatttattcaagagaaaatcacttggtttatagaaggcctttaacattttgtgagtatgtgttttaaaccaaaacccatagataggaagagccgacagggagctggaaactgcaataagctttcttctaactagcaaacgcagttgacagacatctttttatagacgtatctgtgattgcacgctgtttttaggcttgataattttttcaacaaggaaaaacttttcttcaatttgaaaaagctgtttacagtaaaatggcaaagtatgagaagacagaaagccatcctgctcattctaaagctaaattgggccacatttcccttaaagtatagacaacagcagcagtggaacacagttaagtgtgtgtttagtgaaggaaagttttttgaatactgccgccacaataatttttcaaaccttgaattctttattgagaaagtgacaaatcagtgagagagggaaagggaaaagaaaattaattgaatttgcaaaatttcttaaacaactaggattacagaagtaaaagaatgaatttgaaggctgggcgcagtggctcactcctataatcccagcattttgggaggctcaggcgggcagattacaggaggccaggagtttgagaccagcttggccaacatgctgaaaccctgtctctactaaaaatacaaaaaattagctaggcatggtggtacccatctgtaatcccagctactctggaggctgaggctggagaatcacttgaacctgggaggcgaaggttgcagtgagccgagattgtgccactgcaccgcagcctgggcaacagagtgagactgtgtctcaaaaaaagcccccaaaaaaacaaaaaacaaaaagaatgaatttgacgtagtgcctgtgtcagttagctattgctctgtaaccaattactcccaaatctagcagctaaaacccacaaatatttattatctctcataatttctggctgtagctttactgggtgattgtgcctaagggtctctcatagtctggggctcactcacatgacttttggcaggaagccttggttccttattggttgttggctggaggcctcagtttcttgacacatgagactctctataggccacttgactgtacatgcaacattgcatctggtatcccatagagtgagtcattcaagagacagaaagagatgacacagaagccacaatatcttttataacataatctcagaagtaaccaaacattacttttgctctattctattggtgacataaactaaccctatataatatcagtggtgactgcgcagtggtataaatagcaagaggtgagggtcatcgggaaccatctcagaggctggctaccacagtctgccttctggcctccagtgattcacgtttctcgcacatgtagaatgcactcactctctccaaaggcccactagaatgggccttccgtcccattacagccattacagcatcagctcaaagtccagaatatcatatctaaatcaagcccaggtggtaatgaggttccttggctgtagctacttatgtatgacttcttgagtggtttctcttgatctatagacctgtgaactagagagatgttacttgccccttaccactcaacatacaatgggaaaaggtaacatccacagacacttctatcaaaaaagaggatgtcttcgtgtatttgtgctgctgtaacaggataccacagactaggtaacttatgaagaacataaatttatttctcacatttctggaggctggaaagtccgagattgagggtctgcatctggtgagggccttcttgctgcatcataacatggtagaaggcatcatatggggatggggaaggaggctgaactcattcttgttaaggaacccactcctgctataacatacgtgctcctaagataacagcattaatccattcatgagggcagagccctcgtggcctaatcacctcttaagcttccacctcccaaaacttgcatgggggtttcagtttccaacacacgaactttggggatacattttttttttggtatactttttggtattcctccatagtaaggaggaaatgggaggaacacaggagtcgtggttcataaaactgagcctggcaagtattggacatttattgattaggactcagtcttactgtccagaagtgattctaggtggcctttagctctgtcccctgagctcttggttagactctttgtcatcttttcttttacgagaagtagtacatgtttacagctaagcagttttctaagcctgattcctgtcaatagaagttttgggagtccaaagaacgtttttccttttgtaatctctttgtcatttttagttcaggcttaaggtgtttctgcaaatagcttccttttaaaatttttcataggtctcccacgaatcttattgtccattagacaaaagccatatacacaaatttgtttgagataagctgttctctgtctttggctcctactaagatagctaagagacattaaacttctttttttattttttttcttagatggagtcttgctctgttacccaggctggagtgcagtggcacaatctcggctcattgtaacctccgcctcctgggctcaagtgagtctcctgcctcagcctcccaagtagctgggtctataggtgcatgccaccatgcctggctaatttttgtatttttagtagtgatggggtttcaccatattggccaggctggtctcaaactcctgacctcgtgatctgccggcctcagcctcccaaagtgctgggattacaggtgtgagcccctgcgcctgggacattaaacttctttttaaaccctgttgtttgagtgaaaggatctgtaagactcaccctcaaactttctagagattctttgctagtctgaatgttgccttgatgcaccacatttggtaattctgaagtcttaagaaaggactgtagaaccatatactgtattatgttttcctggcagtgccctaaatttgatctttaagaagccacttcttagtgttttcttgccatctggagatctagggaattttcacaactagcaattcctggctccttgttgtttaacaggctttcctttaggttatctctcctcttgtattttattttttgtttgtttgtttaaaagagacaggttctcggccgggcgcggtggctcacacctgtcatccccacactttgggaggccaaggcgggcagatcatgaaatcaggagatccagaccatcctggccaacatggcgaaaccccgtctctactaaaaatacaaaaattagccgggcgtggtggcaggcgcctgtaaccccagctacttgggaggctaagtcaggagaatcgcttgaatccgggaggtggaggttgcagtgagccgagattgtgccactgcactccagcctgagtgacaagagcaagactccatctcaaaaaaaaaaaagagggacaggttctcactctatcccccaggctggattgcagtggtgcgatcatagctcactgtaaccttgaactccttgggctcaagcgattttcccacctcaccttcccgagtagcaagaactacaggtatgtgccactgtgcctcactatttttaaatttttttgtagagatgaggtctctctgtgttgctcaggctggccttaagtgattgtgatcctaccacctcagtctcccaaagtgtggatgacaggcatgagacaccgagcccacccatctcttgtattttattatgcgcaactggaaggaaccaggaagcaccttcagtgcttttcctggaaatccccttatctagattacccagtttattttctactttccatgttgatacaggtgacaatgttgcaaaatttctgctattgcataaaaaggatctctctttgcagtttccaatgtgattttcctcactttcccttaagctctaacctagagcctacggaagggccagtactgcttggctgcaaagcctctcccacatttttaggcatgtgttacgccagctccccgttttcccgtaccatacctctagatgttatctagtactattacctattagtcatctattttgtggtaacaaattacccccaaaacttagtggcttaagacaataaacatttattttttcacacagtttcttagggtcaggaatctagaagttgtttaattgggtggttctggctccgagtctctcatgaggttgtagtcaagatgttggctggggctgccgtaatctgatggattggttgggcagagactctgctttcctggggtttcccataggctgcttgagtgctgcttgagtggggttacccataggcagctggtttcccgcaggactcgtgataagaggggtgtgggggggccaacatgaaaatctagtatgaaagtgatgtgctgttacttctgccatattctgttggtcccatgggtcagccctggtgtattgtgaaaggggactgcacgaatgtgtgaaagccaggaggcgggaatcactggaagccatatggacgttaccaggaggcaggaatcactggaagctatctggacgttgtcttctacaaccctgtcttgaagaatttcgtagcctactgggcacgagtgcctacatgttctaagcattgtgttagactgtcacatgttgttgatttggcatttacaatccagaaaggaactgctacccccagttgaagtttaaagagatcaagtaacttgttcacgacagattcgaatctagcctgggaataaacgcttggagcctaggccttaggtaaaggagtggataaatattctatagcatcattgcctttgtatttaaatatgaattttcttcattatacttatgtttagcagcagccatttaatgtctattttatatgtggacacctctgctcaactgttttttcttgtattcccttctccatgcagtcaccccttggcatgtggcggggataggctccaggacctcctgtggataccaaaatccacggatgctgaagtcccttacataaaatggcagaatatttgcatataacctatgcacatcttcttgtatacttcaaatcatctctagatcagttataatacctaatacaatgtaaatgctgtataaatagtttttatactgtattgtttagggaataatgataaggaaaaaagactgtacatgttcagtacagatgcagttttttccccaaatattttcaatatacagttgaatccatgggtgtacagagggctgattgtgtagctctgacctttttattttttttaacctatcctatctcgttcttctactgactttccttccaacactttccatagagtcctttggagcgtcagacttactctaacgtgaataaacttctttacaaatactctttttatagactacccctctcatctctgtcttaactaaatcctggctttcctgctagaatgccactcttcggggaccatcttgaatgaaagctgttcattcttccataccattttgtcttcaagccagtaagctgaatcagtctacttccaattccaaatcattgttctttcaccctcatgtaaaaattcttcttcctttgaaattcgtgccatctttttttttttttttttggtttatttttattttttgagacggagtttcgctcttgttgcccaggctggagtgcaatggtgtgatctcggctcaccacaacctctgcctcctgggttcaagcaattctcctgcctcagcctcctgactagctgggattacaggcgccctccacgacacccagctaattttttgtatttttagtagaaacgaggtttcaccatgttggccaggctgattttgacttcttgacctcaggtgatccgcccacctcggcctcccaaagtgctggggttacaggtgtgagccactgtgtctggccctgaaattcgtgtcatcttaatcattttctgtcattctttgtcactgtcatttattagtctgcctgtagcttatcccttgtttatcaaagactttggcactcttttctcagttttctgtccatctcttccactatcattctgggtggcttcagtagccaggtggactaccatgcaacatgctagtttcatcatccttgttcttttcaactccagtgaccttcacttccacttctttccaacattttactatcatgacttttagactgtaagacactctgaaatcttgactccttcattctattgactgaccaccatctcctaatttccagaggtactctgctcccttacatatatatttattttatttttcttttttcttttgagaccaggtcttgctttgttctccaggctggagtacagtgatgcgatcacagctcactgcagcctcgaatggctgggctcaagcaatcatcccacctcagcctcctgagtagctgggactataggtgtgcaccactgcatttggctaattttaaaattttatttttagtagagatgaggtcttgctatgttgcccgggctggtcttgaactgagctcaagcaatccttccaccttggcctcctgaagtgctgggattccaggcgtgagccactgcgcccagctcccttacatatataataccggtgttggatcttaccaagatgtctaggctgacccccttcccccaattggcttatcagtcaaacaaatggctaatatcaaacgattctggctaatgaagtagaaaaggaatttattagaagatagtaggtagctcacaaaatcaacagggaagctggagaaccagcttggaaaatgggcaggaagcaaagaggcccagcagcatataccccagctaatgccatggcactaggacagtggttaatgtgctgttgctcctacattcttgctgttatttcttctgccattcccataaataattttaatactgtctctccatttttatattacctgcttaggattcaaaatcttgcacaagaacatctgattggctgagtataggtcacatgcctattcctttgctaccagggagctgggagaggaaagatctgccttctttggcttacttagtgagaaggtagacacttttctgccaatattatacataataggattccctcaaaagacaacgaatgtttggatcctgggtcaaaaaaaaaaaaaaaaaaaaaaaagaaagaaaaggagaggaaggggaggggaagaatagaaggaggagaaaaaggaggaagtggaggaggaggcagcaatattgacaaatgtctactttagcccactactggcttgggaatggggagaagtctgcctttaagcctcctgaaaaaaaaaaaaagcctcctgatccaactttaacctccaaattctcactagatgatcttgcttcttatttcaaaaataggagccattaggcctggaatcccttcacttgttgcctctgtctttaaatgtacctaatcaacattgtcttttcctgtttccctttagctatcttagtagaagagctcttccttctcttgttcaaggctaatttttccatttatattcatgatgtcatccacacttgtcttctccaggacccctcatcattaattaagccttccttcttagttaagattatttattaatattccttttttgtcagacattgctgaatacaggagatataaagatgaatttgatatagctttgaagtatttattatttagtgggaaaaagacagacacaaataattgctgtgcaataatttaatcatgattgtaattatagtagttccttactttatccatggggaatactacaccaagacccccagtggatgcctgaaacaatggatagtactgaaccctatatataccatggtttttcctatacatacatacccatgataaagtttttttgtttttttgttttgtttgttttttgaggcggagtcttgctgtgtcacccaggctggagtgcagtggtgcaatcttggatctccgcccactgcaacctctgcctcccgggttcaagcaattctcctccctcagcctcctgagtagctgggactacaggcatgtgccaccacactcagctaatttttgtatttttagtagacatggggtttcaccatgttggccaggctggtcttgaactcttgacctcaggtgatccacctgcctcagcctcccagggtgctgggattacaggcgtgagccaccacacccggccaataaagtttaatttttaaatgaggcacagcaagagctgaatactaataactaatgataaaatagattagttttaacaatatactgtaataaaagttatgtgactggtctctctctcaaaatatcttattgtactgtactcacccttcttgtgatgaagaagggatggagtggaatgacgtgagatttcatcatactgctcaactgcgtgcaacttaaaacttaagaattgtttatttctggaattttccatttaatatatttggaccacggttgagtgtgctaactgaaactgtggaaagtgaaactgtggacaaagggagactgctgcatttgtgtaatttgtttgatacatgattttctattagaatgtgtcttcagtggccaggcacggtggttcaagcctgtaatcccagcactttgggagccaaggcaggcagatcatgaggtcaggagattgaaactatcccagctaacacggtgaaaccccgtctctactaaaaatacaaaaaaattagctgggcatggttgcaggtgtctatagtcccagctactctggaggctgaggcaggagaatggcgtgaaccctggaggcggagcttgctgtgaccacagattgtgccactgcattctagtctgggcaacagagcgagactccatctcaaaaaaaaaaaaaaatgtgtcttcagtgtctaatacctaagaggtgctcaataaatattattgaatgaatgaagaggggtaagcacagggtactgtggaatcatagaggataggtacttggccctcccctaggagggaaggaagattgggcttatgtcagtggaggcttggtggaggagactgcagcagccagcaggggaaaaaaaatcaggggaaagtaccaggcagagagaggggcatgaacaaaagttgagaatggtgaggaggtggagatggtttgaacagttaggtgttaaatagagttattaacagttaacatctattgagtttacatacatacatagtatatgtttatgtatacttgttaagtactttacatatattttctcatttaatacttacagtattctttgattaaggtattattcccattttagaatagaaaaatctctgcaatacgtagggaaaatagttaacttgcccaagaccatttagcctataaaggatcaaggagggatttgttttggggtctttctggatgcaaaacctggtgctctttataaatgccatgttatactaatacagtgtggttcccaaacttggtggctcatcagagtcccctgaggacctttgtaaaaatacaaattcctggccataccccagacctgttgagtcagagtttccaggggcagagcttatagatctatatttttgggtggttcacatgtaactggcctgggactggttctctcaccctggggagttattgcaggtggtgtcaagagcaaggcaggaatagctgactagccagggaggttttcctgtgtcttgctcctgatccttgactttaccccgtagatggtggggcactgaagctgagaagtgtcatcagatacacatattgtgcccaccactttagcaacagtgtgaaggatgaagttgaaggcacaggttacaggcaataagaacttacatctttagactgctgtcttgactgagttcgtcctttttcctcacattctcaagttttctaaattttttttctcttggttctgccaacccttcagttctcttttccctagctaatttcttgaaagaaatagttatactcaatgttaggtttcagtcagttcaagaaatgttccttactgacttactcttctttgaggtcatcttccatcaataaatgtttattgaatgttatttgaaagcatggtcctttctcagattttgctttgaagtgaaaataccagggatgatttattttttcatcacgtaatcactcatatgacaatttttattgatcaccaagtactcttcatgtgtctcctttatgctagggcctgggatacaacagtgatgagataaggcctcggactttactgatcgaacatctaatggaaggtggaagaagagaccatcacacaatgacggtgttatggggaacacagggtacagtgcattcatacctcctccccatcactgtgtcaatcgcttaaccatctctctgcctccagccttgcttccttccagttaagttatcctcattgattatacatctagccagatactccctactctataaatcttcatttgatagctattgtccttaaaataaaatccaaactccttcaatgtgtcttactaaaaaaacttgagcctatccccaccttgcgtactctcattctgtttcattatagggaagttaaggagcaagaatttgaacttttccttatgtttctttagtttcttttctttctttccaacatgttcttgttctgttgcccgagctgaagtacagtggtgtgatctcggctcactttgacttcccaggctcaagccatcctcctgcctcagtttcctgagtagctgggactacaggtgcacaccagcacgcccagctaatttttgtgtttttttgtagagatagggttttgccatgttgctcaggccttagtttcttttctggaagatttttttttttttttagtattttgaattatttttaagtaagagaaaaaaaaatcaaccttgttaatataaagggtaatcacttaaaaagcacacctaagaattagtatctcaaattgttgtgtagccgccaccaccatccaacttcagaacctttttgtcaccccaaactaaagctctgtgcccattaatcaataacttcacatctccccctcctggaaactaccgttctgctttctgccttaatgagtttgagcactctaggtacttcagataagtggagtcatacaataatttgtcttgtgtctgacttatttcacttagtataatgtcttcaaggttcatctaccctataagaatgtgtcagaatttccttccttttcaaggctaagtaatataccattgtatgtgtatgccgcattttgtttatccatctgttgatggacatttgggctgtttccaccttctgtctattgtgaataatgctactgtgaacactggtgtgtaagtatctgttcgagttcccacttacaatacttttagttatttactcagaagtggaattgctagatcatatggtaatttgatgtgtaactttatgaggaactacgatactggtttccaaagaagatactattattatcaccatgtggcaagtggggagacttgggcacagagaggttaagtaacttgcccaaggtctcacagctagtacatggtaaagccaatggtggctggctccaggtcagtgctcttaaccagcaatatatacatacttactggcctcttttgtaatctctgttataattatgttttcctatttggggaagattgacatcatttggaggttttttttgagatggggttttgctctgttgagcaggctagggtgcagtggtggaattatggcttactgcagccttgacctcctgggctcaagtgatccttccacctcagcctcccaagtggctgggactacaggcatgtgccaccatgcccagctaaatttaaattttagaattttaacttttttgtagagacaggatctcactatgttgcccaggctagtcttgaactcctggcctcaagcaatcctcccccctcagcctcccaaaatgctgggattacaggtgtgaactaccgcctgttttgttttgtttttagaggcagggtctccctatgttgtcaggctagacttgaactcctgggcccaagctattagcttgctgagtagctgggacaataggcatgtgccaccttcgagttttgagaattggactaaatcaaacaatattttactcgtagagtatttccttcttggattgatttttttgtttgtttgtttctgagatggggtcttactgtgtggccctggctagtctcaaactcctgggcttaagtgatcctcctgccttagcctctggagcagctgggactataggtgtgagccatggtacccagctttggattgattttttttttacatgacaaaattgttatagttctcactcttaaatattttttagaatagttctagatgagtatacaggaaactctttaggaatttgtattctacaaaacaaaatgaaaaacaaaagtatactgacacagtgtatcagtaacaaatagcctgactctcaaagtactctcattacaaaacttagaatgatactttttttttttttttaaaggtggtatgttacccagtctcaaactcctgggctcaagtgatcttcccacctcagcctcctgagtagcggggactataggcatgtaccaccacactcagtgaattatatgttttaaaaggatattttgtatattggccatttctctaacatttcccaaaactgcatgcttttggcatctgtgctataaacttagaccaaagtagcttcagaaatacagtagaagctccccttaacgtgtgtgccagattaacataaaacagacatttcctttctaagacatgcttattctaagggcacgcagaataccttttgccattcattaagtatgatgttagttgtgagtttttcataaataccttttatcctgatgaggaagttcacttctattcctagttttcttttaaacaataaccttaagaagtattttttaattgacacataataattgtacatatttatggagcacagtgtgacattttgatatgtacacataatgtgctatgatcaaatcactattcctagttttccgagtgtttttataatgaaaagatgttatgtattgtcaaatacttgttctgtgtctattgagatgacatggtttttttgctcctcttcgttctattaatgtggtgtattatggtgattggttttcatatgttcattctcgggagaaatcccatttggtcatagtggataatcccccataaagtggctggattatgttttcaagtgttttgttgaggattttgcatttatatttataatggatgttggtttgtagttttcttcttatgtctcagttttgttttttttttaaatcatgttaatactggccttatagaatgagttgggcagtgcttccgtctcttcaatttttgggaagattttgtgaaggattggtagattggtattaatttttttttttttagacggagcctcactctgtcacccaggctggagtgtggtggtgtgatctcggctcactgtaacctctgcctcccaggttcaagtttttctcatgcctcagcctcctgagtagctgggattacaggcgcacaccaccacacctggctaatttttgttagagacgggatttcaacgtgttggtcaggctggccttgaactcctggccttgagtgatctgcctgcctcggcctcccaaagtgctgggattacaggcgtgagccactggcacccggccttattgagtttttagtaggtttacaggtactatcagagttattctcaaggtgtttacagtatggaaagtgagacaaataagtaaactgctaattataatatggtttgatagactattatgatagagatagcatgtatgctacatgattacataggagggtacttaacaaaaaagagaagggaagccttcaaaaggtcagttactcttaaacgtgagtgacgaatgggagatagccaggaaggaggagagcaatattccaggcaggagtgtccgtcacaaaggcggagggcaatattccaggcaggagtgtccatcacaaaggcactgggaaaaagcattatcactgggacactacagagacttcctgcctagtgcatctgtgtggaaaagtgtgaagagatcacatttttgagataggtaggagcctaagttcataaagggctttgtgcgcctggttaaggagtctgaatgttagtttgaaaggccttgcgaaccattggaggattttaaaccagacggtcaaattactaaatttgcattttagatcatcctagcaaaatgtggattatggtttgatgggtggaatgggaagtgagagaaaggagactaaaggcaaaaaggcaggaagtgactacattaatttagctggaagtgatgagtgtttatttatttatttatttatttttgagacagagtctcgctctgcctcccagcctggagtgcaatggtgcgatctccacttactgcaacctccacctcccatgttcaagtgatcctcctgcctcagcctgtgattacaggcgcatgccaccacacccagctaatttttttttgtatttttagtagaggtggggttttatcatgttggccaggctggtttcaaactcctgatgtcaagtgatccacccacctaggcctcccaaagtgctgggattgtagtctaatcgtaagcaatgacaatggaaatggaagggaaagaacagagttcagaagggtttataagtagatggccgggtgcactggctcacgcctgtaatcccagcactttgggaggctgagatgtgtggattgcttgagctcagaagtttgagaccagcctgggcagcatggcaaaaacctgtctctactaaaaacacaaaaattagctgggcatggtggcacaggcctgcagtcctagctacttggggagctaaggtgggaggatcgcttgaacccaggaggtggaggttgcagtgatctgggattgcgccagtgaattccagcctgggcaacagagcaagactctgtctcaaaaacaaacaaacaacaacaacaacaacaacaacaaaaaaccccagaaaggttgaaaggtgttgatgatcaaatagaattaggaagatgaatttgttagaatgagaaatttggaggactgtgatcagggaatcagtagaagatagcagtgagaaggaatagtagattatgtgtcctcaagtgatgaaccttaatagagtagtagtttttaatatgaagttgaaacaaggatgctcccagacaagtccaggttgtgggccattctgtatgatgctataaagcctggtctcttcaacaagctaatttcatgtgtgtggggaggggtggggaaggatggaggactgttttagtttcaaagagaacaaaataatatgtaacagccaaatgcagtacataatctttgattggattttagtatgaaaaaaatacctatgagacatttagggacagatggagacatttgaatatggaatagatattagatgatcttagtgaatttttgttaatttttaaagatgtcataatagcattgggattatgcaggagaatgtctttatttttaggagatatgctgaagtatttagggatgaattattctgatgtctgcaattgacttagagacagacagacatggaaagaggaatcaaaaaatggcaaaatattaacaatagtttaggcggtgggtatagagttgcttgtaacactaagctttcaacttttctgtgtgtttgaaaatttccttcattagagaagctggcaaaaaatatggcagattaggagtatggggctatgagtagcaatggggagctctctattgctaaccttccccaagtccctgagataggtaagccacgggagaatgagcagccagttctgaaagggacttcaagatgggtaatgactttggggtagtgcttctcagcttttatcactttaaaacctaaacattggccaggctcagtggctcacgtgtgtaatcccaggactttgagaggccaacgtgggaggattgcttgaggccaggagttcaaaaccagcctggtcagcacagagtgaccttgtctctacaaatgaaaacaaaaattaaaaaaaattagccaggcatggtggtctgtgcctgtagttccagctactcaggtggctgaggcgggaggattgcgtgagcctgggagtttgatgctacagtgagccatggtctcaccacagcacttcagcctgggacagagcacgactctgtctcaaaaacaaagaaacaaacaaaaaccctgagcatggaaaataatatttgtgtggcacacaatatctggtaaaactagatgagctttgggactctacatgaggcttgattattaaaaaaatcattatgttaaaaaattttgttatgtatttcattatgtaaaaaaatttataagaaaataaaacagagcattaggaaattttaaaatgatgacccttttttaaaagttccaaatgtatttaaaatgttaaaggtggaacttgagcttgcttcccaacgtgttactttttaatatcaaactttttgcttgaaatagttgtactcaattcctgattttaaaaaatctttaatatgagctcttcaatttttgatcatttactaccaatgagtaactgttcatgcagaaatgtaaaagcatttttcccaaccattaaaaaatcaaaatatgaactaggcccctacctatctcaaaaatgtgatctcttaacatgttctcacacttttttttttttttttttaaattttcagagcaagatccttcaggctgcagtgcagtggtgctatcatagctcactgcaaccttgaactcctgggcttaagggatcctcccatgtcagcctcccgagtagttgggactataagcatgtgccaccatgcctggctaattgctttttaaaaaattttgtgtgtgtgtgtatgtagaagtgaggtctcgctatgttgcttaggctggccccaaactcctgggctcaagcagtgcccccagcctggcctctcaaagtgctaggattagaggcatgagtcactgcacctggccctcgcacaaatttttgtagtttcccaaggattatgcttttctttttttttttttttttttttttttgagactgagtctcgctctgtcacccgggctggagtgcagtggcaccacctcagctcactgcaacctccacctcccaagttcaagtgattctcctgcctcagcctcctgagtagctgggattacaggctcgcaccaccacgcccggctaatttgtatttttagtagagacaggggtttcaccatgttggtcaggctggtctcgaactcctgaccttgtgatccgcctgcctcggcctcccaaagtgctgggattacaggcataagccactgtgcccggctggattgtgctttttcactgtgcctttgtcagtgatactcctgcctggaatatttcaaaccagttgaaattatatcatctaaaaacttctcctttaattaaccaatataacttggaaaattttctaataatccaaacgatttttttttttttttgagttggagtctcgctctgtcacccaggctggagtgcggtggcacgatctctgctcactgcaagctctgtctcctgggtttacaccattctcctgcctcagcctcccaagtagctgggactacaggcgcccgccatcatgcccggctaattttttgtacatttagtagagatggggtttcaccttgttagccaggatggtctcgatctcctgacctcctgatccaccctcctcggcctcccaaagtgctgggattacaggcgtgagccactgcgcccagccccccaaatgattttttaatccagttgaactgtctcatatcaattatttcaaagtaatgaagatttaatttatatatgatgcatgtgttttttgtttgtttgtttttgagatggagtctctctctgttgcccaggctggagtgcagtggcacaatcttggctcaggctcgctgcaacctctgcctcccaggttcaagtgattctcctgcctcagcttcctaagtagccgggactacaggcgtgcgccaccacgtccagctaattttggtatttttagtagagacagggtttcaccatgttggccaggctggtctcacacttctgacctcaagtgatctggccacctcggcctcccaaagtgctgggattacaagcatgagccaccgctcccgacctctcatgcatgtgtgtttagggccgcacaacaagcttggctgctactgaaaggacatatcagttacggaggcatggaagtagcccatagtatgtgaagataaagatttgggactgcttcctagagccatgagccctgtcagtttgaagtagttgcacactggaatgaacactatgctctttgggcacctggaacagaaacttctccaggagctctctactgggtaatggtgcattctgtatctggcctctgaaggagaagaccacatgatatgtcacacacttggcaatggggagcagtgggtgcctgatggcatttgttgtggttgtcgctgtgcagaacaggaggcctgccatcggagcctgtcgtgccctggtccccctgtgggaagctctggaatagactgctttctggggcctgacttcatctggccacactgagagatgagagataagaggatcagtattttggggtacccctttaatccatccactttacaggctgagtatccctttttctttcttttttttttttttttttgagacggagtctcactctgttgcccaggctggagtgcagtggtgcgatctcggctcactgcaagctctgccttccgggttcacgccattctcctgcctcagcctccccagtagctgggactacaggcacccgccaccacacctgggtaattttttgcatttttagtagagatgaggtttcaccgtgttagccaggatggtctcgatcttctaacctcttgatctgcctgcctcggcctcccaaagtgctgggattacaggtgtgagccaccgcgcccagccttgagtatccctttttcaaaatacttggtaccagaagtattttggatttctaatttttttggattttgaaatctttgcatatacataatgagatatcttgggaaagggattcaagtctaaacacgaaactcatttatgtttcatataaaccctatagacatagcctgaaggtaattttatgtagtattttaaataatttgtagatgaaacaaagtttctctacatagaaccatcagaaagcaaaaatatcactatgtcagccacccatgaggacaagctggttgtttggcatcagcatcattcctgaccctaaattgataggaattgatattgataagcaatcatcttcttacatttattcacacggaagtacttaccagtaaaaaatatgaagtaccattcatgaagtgaaaaaataatgtgttcaaggtaatgaagcagcacagtggcatcaccagaatacctgtgtcagctgttagcaacagcaaacaccggactttcagtctctgcctgcaatgctgtgttttgattagaaggttactgtatactgtacaggttgagtgacccttatctgaaatgcctgggacctccaaatgttttggttttggagcattttggatttagcattttcagattagggatggttaacttgtattgcaatgtccagtgggtaaggattcctgagttagggtagtcctagatttcagttaaggcattaattattcctgatagatgataatttgaaaaaagagactcgatgatcaagtgactttgggaaatgctgtgttgaacaaagttaagtttcatgattgtagaacattccaaagactttaatatactaatacacactataaatgaccatatagaactacatataaatattatatataaaccataatattcagagttttccagacatttttgatcactgaagccttttattgagaagctctggctgggcgcagtggctcatgcctgtaatcccagcactttgggaggtcacgggaggtggatcacgaggtcaggagttcaagagaagcaccttgaggaatgagtgttaaacagaacacagtttagaaaatatattgataagaagttattaaaaattcatgccttgcaggctgtaaatgcactttaatcagagtgccatttgttttgttcaaatgttttaaattattggaatgcacactttttaaaatatgcaaataaagtttggaaactaaaaaataaagttagtgcctgttctttagagatggaaggataaaattataaattataagttttacctatttcaaaacaaaagtcagcattatacttattggtaaaagactagtgttctagattattaataataataattatatttttataaaatggattattatcactttatgcattaatgttgctttggtagtgctggccagtgccatgagtcatgacagagaaataagatacaataagaagataatacaaaaagtattattagaaaatataaaataatcaactgaaagattttaattaatacatttttcaggaaatatataatcaatagcaaaaattcaatttttacctcaaacacttgaaattacagggctcgaaaaaatatttcatcacaatatctacaaaacccataaaatactcaggcatcatcttcttggaggattgtgtgtgacttacatgacgaacctcaaaatatgtaatatttaatttagagatctataagggatatatatatctaaatatacacctcttagatgtgaaaactattctaaaatgttaattctcaatgtatagctgattgcaatagcaataaaactttcaatggtatttcatttggaatttctaaattgtatatggatttctgtatttcctttggaataataaattggtattgatgaacattcctaaaaagaggctaatagagtggcaataaataaaatgctatggtaatggcacaagactagaaatgcaaatcagaatagaattaacagaatggacaattgatagaattaatctcaatcacataaaagatgataatacacgataaagtgcaaggaatcaagcacctggtaaagtaggaaaagctaatctttcactttgaatcacatcaaaataaacttcagatgaattactcagtgtgttgtccagtgtcaaaaacaaaaaacaaagaacaaacaaacaaaccacagtaaatctatctgtaaattgttgaagaaaatagaattaagtatttgccagacctcgagaaaaagggtgatttttctttgtctctctcttgggcctttcaaaggataagtttctcaactttacagtatgagaagaaatctcaacagatgtgactacctaaaaataaaggataatgtacttttaaaatgaccttaaatttaaaaaccaaacatcagctttgtgcagtggcagtgtcgtaaccagagagattttcccaagatactgttatggctaataagaaccttgctagttcaactgtgttcaactcgttgaatttcagtgagataaggcaaatatacaaaggtgaattgggcaggattgttcaataaagaattgattattgattataataatgaaaaatcagaaactaaacatccacaattggagggttgattaaatacattttgataaagctctataatggaatatcaggcagtcactaaaaataataaggtaatgaatatttattgagaatgaaagatccaatttattgctgagtgagaaattagattagagaacaacattaaaagtagttaactctgggccgggcgcagaggctcacacctgtaatcccagcactttgggaggctgaggcagttggatcatttgaggtcaggagtttgagaccagtctgaccaatatggtgaaaccccgtctctactaaaaatacgaaagtgagcttggcggtagtggtgcacacctgtaatcccagctactccagagactgaggcaggaaaatctcttgagcctgggaggtggaggttgtggtgagtcgagatcatgccactgcactccagcctgggcgacatggcaagactccatctcaaaaaaaaaaaaaaaaaagacaaaaaaaaagaaaaaaagaaaagagtagttaactctgggtagaatttgaagtgattttaacttaaactttcatctgtgtctttttcctccagtaattgtgtatgattttgatcatcagaaaggaaatggagctgttttcattttagaaaaacaagttcaaacaactgacctggaaaattgtttgcagtaacttcgacatagggttaagtctttattattcaaacaggtcatgcaaattgtaaagaaataattgaagatcccagtagggttgagcagagaacatgaatagacaattcataacatagaaaacagagatggtaaacaaacatatggatcattattcagattcatttgtaatcaaagcagtgtaaatttaaataatgaggtaatatttatttgttgttaaattagcaaaagtttattgctgtgttataataaagaaaaaataatatcaataaattatggtgtattattttggtaccattaaaaatggaaggttgtgtaaattatgttgcaacctggaaaaatataacatttacgtgaagtaattaaggagttaagattttatactgtaagtactaacaggtgggatggggtggagtgaggtgaggtggggtggggtgtggggggagaagagcaggattgttcaaatgaggaagatctgagttcagtccagctctgccactcaataactctgtgatcttgggcaaggtgcttagcctctctgagctttggtttctttttttctctacggttgtaaaagtatatacagtacctgacgtagaacctggtgtatagtgtttattcagtacatatttgttgagtgagtgaatggtagttattcaatgccatatataaaagaatatgtatgaagaaagattggaagaaaatacagcaaaatgatgagtagttatgttagggggaagagaatttgactgattttaaaatttcctattttctactattgggtggtattatatttctaattgaaataattacctaaactcatgcctaatctctttctttctgggtgtcctactgtatttactgtttgatacattttgacacctttttcttttctttgagacaaggtctggttctgtcgccaggctggcgtgcagtagtgtgatcatggctcactgcagcctcgacctgctgacctcaagcaatcctcctgcctgggcctaccaaactgctataggcatgagctcccatgcttagcacaatttagagacttaattacattattgtcctttattctttcactcagccaaacaccttggagttggccttaacccttttctttctctctgcacctaacataaaatttatcagcaaatcttgttggctctgctctttagaatatatccagaatctgccgggcgcggtggctcacgcctgtaatcccagcactttgggaggctgaggcgggtggataatgaggttaggagatcgagaccatcctggccaacatggtgaaaccttgtctctactaaaaatacaaaaaattagctgggcatggtggtgtgcgcctgtagtcccagctactcaggaggcagaggcaagagaatcgcttgaacccgggaggtggaggttgcagtgagccgagatcaagccactgcactccaacctgggcaacagagagagactctgtctcaaaaaaaaaaaaaaaagaaagaaagaatatatccagaatgctgacatttctcaccaccttcactgctaccattctggcccacatctctcacctggagtattgcagaggcctcctgactggtctctctgcttccacccttttcataatagccaaagtgatcagcagaccgcatcactgtgctgcctggaaaaacccttcagcggcttctcatctcattcagagtaaaagccgaaatccttaaagtagcctacagggctttttttttttttttttttttttttgagatggagttttgttcttgttgcccaggctggagtgcaatggtgcaatggcgcaatctcggctcactgcaacctccgcctcccaggttcaagcaattctcctgcctcagcctcccaacttgctgggattacagttatgcgccaccatgcctggctaattttgtatttttagtagagacagggtttcaccctgttggccaggctggtctcaaactcctgacctcaggtgaaccaccctcctcggcctcccgaagtgctgggaatacaggtgtgagccaccgcacctagccaaggcctctttacaatcaccctcaaactcatacctttctgatcttatttcttactcttctgcacttactgttctctctgcctgaaaactctgcagttgttcataaggctggttccttcccctccttcaggtgtctgcccaagggtcgccttaccacagaggcaggcctctctaagaccaccgtatcaacccattctcccccacccacgcccagcactcctcgtgtccctaccctgtttattccttcctctatttctcacaccatttgccttactatgtattttatcgaatattacgagcttatatttctttcccaataaaagtagctctatggaggcaggaatttttttctattttgttccttgccataaccttagcacattgtaagtactaggtaactgtttactgaatatatatatgagtgtttcatatatgtaagtcatagtccaaaactagtttgaaagctttttgagtaaatgtcatgttggtttttatgcctttcttcccccaactccacaagcaaagaataaggcaaggtaggcagggaacactgttgataagcaaacagtatctgtttttattggtttcactgtgcctctcaggctacgactctacccaaaggacttgagatagagaggccgctgctggaaatattctgtcaccgtgattggagtggttgagtggttccatgagtatatgcgtatgtaaacacttaattaagctgtgtatttaagatcagtgcacctttaccatatgtatattttgcctcagaaaaaatgtttacaaatacagtgtatcctttgacatctccagaggaagttaaacatgctaaatgatacataaatataaggagagggttcttcatatgcttacttattaagattgctagtctggttattagaatttttgttttgaattcaaagctaaagtaaactaatttttatttactttgtcttttgcagagataatagtagcagaatttcacaaaaaaatcaaagaggcatttgaagtctttgaccatgagtcgaataatacagtggatgtgaggtgtggaaatatttttttttttgttacacttttaaattactgatacaagtcataagatacaagagagctattttctctttttacactgtaccttggatttattatgctcttttaagtatttattttccatgctccgtaaaaggtctttgctagctattgctttgataagtactgtttcttattcttcatactctggtagaaacaatatactgtattctcattgcctgttccaacctataattgtaaactctgtgactgagatgaactctattttagctttagtgcttggcacatagttggtactcaggaaatagtcgttgagtgaaggaacagcatttgctttgtaaaacacataaatatgtattataaggccacaaataggatattgcaaggaaacagtaatgcttatgcgatgacacactccccctgtaaaatagcaaaaagaacccaaacagaagaacataaaaaggcaagagaagacatgaatactggtaggtctgaaatggaggacacagcttgggactgaaacaaaacaaacaaaaaaccccttaagagaagagattagacgctaataagaattgtagggtttgtgccacacacatcaaagaaaagcaatgaagccaggcgtggtggctgacacctgtaatccaagtactttgggaggtcaaggtggacagatcacctaaggtcaggagttcaggaccagcctgaccaacatggtgaaactctgtctctactaaaaatacaaaaactagccgggcacgatggcaggcacctgtaatcccagctactttggaggctgaggcagaagaatcacttgtacccgggaggcagaggttgcagtgagctgagatcatgccactgcactccagcctgggcgacagagcgagactctgtctcaaaaaaaaaaaaaaaaaaaaaggcaatgaaaccatcctttcaggaggccgggctaaatgagggttatttgatgagattgcaatctcaagaccagaacctagtagagaggccagcaaagcagtgggaagtggtttgaaaatggttctggaaaggaactgtttgatgcttataaaccagtgccatcagagctgcagcaccatacagctccggtggctgtggtcacattgcattctgtgggaatgacattgtggaacaccaggccttcctgtgggtatcccagtaggaaatgagtgggcagggtgctggtggtggtggtagggttagggagggggtgcagcaggcagcccggcctgcaatttgaataactaactacatgaatgacaagtgccttgacctcagacctctccttgaagggttctcctcctgggggcgggggacagaggtattgttagagaagtcagggaaagtatggcattatgagagagagggaaaagagagaaaagaaaccagcatctgcttgaggcttgtcatctaacacactacgtgtagttgggtgccagaggcttcacgtggattacctcattttaatctttttatttatgggttaagggttggcatctccggtttccagagacaaggagaaggtaaatcgtttgctccatgtcacaccaggtttctctaacgccaagtctcttgctacactgtgggcatgccacactgcccacactcccactcctactctttagagacatcaggggcttctcttctgccttcaggcttcctgacagtagcagtgaaaagaaaatctcccgatcactgacagcaatgatgccaggccttttttggtaaaagggccaattcagtaaaagaaaacgtgtttatgggctgaatctttttttccattgaaagttaaaataactttaccgaggccctgagggaaagtggatgttcttacaacctaaagagtctgctttgttaattaaagatggttactaagaaaattgttattgtttttagcattaaaatattgctgctgagtatatttgaggaataacaacatggatgaatgtagctttataatttttcctgtgttaatttgtatatcactttaaagtttataatgaatgttctcatgctgctggtatcattaccatccactctttttaaaaaattcgtttaaagatagggtcttactctgtcctccaggctagattatagtggcttgatcataactcactgtatgtaaccttgaactcctgaagtgatcctcctgcctcagcctcccaagcagctaggactaccacgcccagctaattattatttcttgtagtgacaggggtgttgctatgttgcccaggctggtcttgaactcctggcctcaagtgatagaccctccttagcctcccaaagtgttggtattacaggtgtgagccactgcactcggccactctttataaattggaaattaagctttgggaggccaaggtgggtggctcacctgaggtcaggaattcaagaccagcctggccaacatggtgaaacctcatctctcctaaaaataaaaactaaaaactaaaaaataaaaataattagctgggcatggtggtgtgcacctgtagtcccagctgcttgggaggctgaggcattagaatctcttgaacccaggaggtggagattgcagtgagctgagattgcaccactgcactccagcctgggcgactaagtgaggctttgtctaaaaataaaaaagaaagaagtgtctttgaacggagggagagatatgtaatggctcagtgggggcaggacagagagagctgttcctggagacgccccccgcccccaggcactggctgttcctcccctaactgctttatccctcaggtggaggtttggtgttacttcctgtgtagggctgatctaggtcccctgagaggtctaggtcttagaattttgtggtggctactttccctttcccttatctctgctttgcacaaattgaaatatttgatttgaaattgtattgcattagataaagggaaagtctggtattccaaatgctgggcagccaccagcccactgtcaaaagcattatgagctgggctcctgctactgcccttccacctctgaggggcagtcctgaggtctggaatcagacttcctgggttcccatcccagctccgtgactgcgagtcactttgttattctctttgtgcctccatgtacctttgcctcctaggtttcatagtataagtaattagttctcagagtgcccccaagaccctttccggggtctgtgaagtcataactattttcataataaatttaagacagtatttgttcttttcattctcactgtttccacaagtatatactggagtttttctttctttttttttttttttttttttttttagacagggtctcgctctgtcacccaggctggagtgcaatggtgcaatctcagctcactgcaacctccgccttccgggttcaagcaattctcctgcatcagcctcccaagtagctgggattacaggtgcccgccaccacgcccggctaattttcgtatttttttttttttttagtagagacggggtttcaccatgttgtccaggctggtcatgaactcctggcctcaggtgatccacccaccttggcctcccaaagtgctgggattacaggcgtgagccaccacacccagccttatactggagtttttcaaaggctacatgacgtgcagttttacaacagattgaacgcagaactagatatgagaatgcagctgtcctctgtgaagccaggtgttacatatttacattgaacgtatgtaaaacaatgtaaaacaatgccattcttctaaatatactttttgttttggaaaatatagtttaaaaaattaacaactatttatgtaaacatttgggttgatttatgatttttaaatgaattaataaatacatatttttaaaatgtaagctttaatttctaatatgatagtaaatatagatgcatataactcacacaaacatagacgctttgagcgccttgataatttttgatagtttgtaaaaggagttatcagaccaaaaagtttgagaaccactattgtgagtggacatttttaaagctcttagaacaatattagcttgggatttaaagctaagaacagtattagctattataattattctactttatatatatatagtttttattattattattttgagatggcatctcactgtgtggctcaagctggattgtagtggcccaatctcggctcattgtaacctctgcctcctgagttcaagcaattctcctgcattggcctcccaagtagctgggattacaggtgcccaccaccacgcccatctaatttttgtatttttagtagagacagggtcttgctatgttgcccaggctgttctcaaactcctggcctcaagtcatccgcctgcctcagcctcccaaagtgctgggattacagacgtgagccactgtgcctggccccattttatgttcttaaagtaaataactcagacttgttttgcccctgtttaatctggatgagcaatgttatgctgtatgtaacaaaactctcataagaactttaaaatacatattttgttttagagacaagctctctttatgttgcccaggctgaccttgaaaccctgagctcaagcgatcctcctgtctcagcctcccgagctgggactataagcacgtaccacacctggctagaactttttacttatttccgtatgttccatatcgatctcttaagatctgaagcattttattttcctttttcatttccttgttaaatagttttcgaaagctagcgccttgaaaaacattgggcaggttttcaatatcactaattagggacattctgattttgcctcatataaaacacagactttttttttttttttccagacagtctcactctattgcccaggcaggagcgcagtggagtgatctcggctcactgcaacctccacctcctgggttcaagcgattctcctgcctcagcctcccaagtaccaggaatagtgagattacaggtgtgtgccaccacccccggctaatttttttttttttccatacttttagtagagacagggttttgccatgatagctaggctggtctcgaattcctggcctcaagtgacccgcccgcctcagcctcccaaagtactggaattacaggcatgagccaccgcacccagccacattttcatttatatatattttcctgctctgtgtttagaagttaagaagactgattgaaaattaaatttttgaatagatgatatatgtacatgggataaaattctaaaggtagaaataatatatagtgataaataaatctcttttttacctatccagttcccctttctaaaggcaaagtttgttacagttttctctaattcttccagagattctccatgcaaatatgtatgagtatgcatgtgcatgtgcgtgtgcgtgtgtgtgtgtgtgcatgtgtgtattttttactgtggtaaaatatagataacctaaaatttatcattttaagtacagaatgcagtggcattaacattactctacaaccatcaccgctatccattttaggctttttcatcttcccaaactgaaactctgtacccatttaacaataattccatatcccaccctctcgcagcctgtggcaaccaccgttctgctttctgtgtctatgagtttcattatcttaggtgcctcatatatcaatggaagagtacaatatttgtccttcctgtgcttgcttgggcagcacatatactaaaattggaacgctacagagattagcatggcccctgcacgaggatgacatgcaaatttgtgaagcattccatttttaaaatacaaacaaacaatatttgtcttgtgtctggtttatttcacgtagcgtaatgttctcagggttcatccatcttgttgcatgcgtcagaattttattccttttttgaataatattccattgtatttatatcccacattttgttcatccatctgtgtattgatggacatttgggttgttttcatcttctgactgttgtgaataatgctgctatgaatactggtgtatagatatctgttccagtctctgcttttaattcttttgggtgcatatccaggagtggaattgctggatcatgtggtagttctgtgtttgatatttgaggaaccactgtactgttttccacagcggctgcgccatgctgcattcccaccagcaatgcccagagattctgttttctccacatctttgccagcacttgtcatttctgttggttttttggaggggggtgttgttgttattgttgtttctctaataaccatcctactgggtgtgaaatggtatctcactggggctttgatttgcattttcctaatgattagtaatattgaacatcttttcatgtacttattggccatttgtacatcttctttggagaagtgtctagtctttgcccatttttaaaccaggttgttttattttgttggtttttgagttgtaggatatgtgtttatttttaacgtgaatggtatgatactatataaaccattctgcactctgctttttttacttatcaatatatcttgactatttattaatatataaaaattggctgggcgcagtggctcaaacctgtaatcccagcactttgggaggccgaggtgggcagatcacctgaggtcaggagttcaagaccaccctggccaacatggtgaaaccccgtctctactaaaaatacaaaaattagccatgcatgatggcgggtgcctgtaatcccagctacttgggaggctgagacaggagaatcgtttgaacccgggagacggtggttgcagtgagccgagattgtgccactgcactccagcctgtgcggctgagcgagactcttatctcaaaaaaaaaaaattatccttatttcattgtatggatgaatcataatatattgaattaatctccttactaatggacgtttaagttgtttccaggcttttgctataatagctcatgctgcagagaatatcttagcatgcatatcatctcacaaaagtgagaactttttctcggtaaattattggaaatatgtcaaagggcttgacaatttttggtagatgttgctatcttgatgatagagtctctcatcttgtgtgagagtaccagtttcttcagtccttctgaaacaagctttaattatcaagcattgggattttttcccaatctaatatgtgaaaaatagaaactcagtgttaattttctttttcttttcttttctttctcttttttttttttttgagacagagtctcgctctgttgcccaggctggagtgcagtggcacgatctcagctcactgcaacctctgcctcctgggttcatgccattctcctgtctcagcctcctgagaagctgggatcacaggcttgtgtccacctggctaatttttgtatttttagtagagatgggggttcaccatattggtcaggctggtctcgaacccctgacctcaggtgatccacccaccttggcctcccaaagtgctgggattacagacgtgagccaccatgtccagcctaattttcattttctaaattagaacatctttcatatctcttaaaactgtttgtatttccttttgtttgacctgacagtttatgatttttccccatttcttcccactgaattattgatctttttctatatgaaaggtctcagccttagtcatgatgtgtctgtcatctatcttttcactctacttttactttctggcatgcagatttttttttttaatttagtcaaattacacacctttggagtatggatttaatttttggaaacaaacgaatgtcatttcgagtagttttagtagaataaatttaggttcccctaaataaagctaatttggtggggacaaaatacacccacaaggagtgcctctaaggtaaagaagataatttttccatgtagctgataaatttaatttgaaaatgactctaatcttattcacaaacaaatccagtttttttgtaatctaatggaataaaagtacaccacaagtccgtagagacagttgctggctctatcatgcattttctatgtgtcaccctctttttatttcattttccttatctataaaattgaaataaaaatgccagcaccacttaagccacaagagtataagaatatcaaataaaaaatatcaacttactttttttaacactccattctaatcaatttcagaacaggttgatactcaagaatttggtgagctaaaatgagatggggcccaatcctggaataaaagtgccaatctttcccctttcccaagccacacccatctgtcctgttcctatgcttcaatgcctttacagtgcgaccttatttttagtattccagactattctgtgtgatatggtttcactgtgtccccacccagatctcatcttgaattgtcgctgccattatccccacatgttgtgggagggacccggtaagaggtaattgaatcataggggcaggtttttcccatgctgttcttgtggtagtgaatcagatgattttataaagggcagctcccctgcagacggtctctttcctgccgccatgtaagatgtgcctctgctcctccttcgccttccaccatgattgtgaggcctccccagccatgtggaactgtgaatccatgaagcctctttttctttataaattacccagtctcgggtatttcttcatagcagtattagtggtatgagaatggactagtacactgtgtttactttatacctgccctatctataggagattttccctaatattttcttaatctttagacaaattttgcagtccagcagcaccaagtatccacttgctaatacagtgagtctcttttttcattgcttccatcttcaactcagtataagtctctgaggctcttggtatccaatatttatttcttttactgatagggagacttcagcttcgttagcaattggcaggaaccttgagtgtactaggtcctgtctaaaattctgtaagaaatagtaacaataacttatttgtaatggattagaaataacttttcctaggagcactggaggtaccataaatattacttttacttcttcacatatagtgctgttttgaagagatattaaaataacatttcgcaattcatgtttatcaggtagtagaaagtgtgagcaatgtggagagattgcatggacagttcccccaagacagttattatctgagaaagctggaagctactcagagagctttataaaaactgttatcgatactgggtctgcatttgtgcaatggaaaaacatggaagaggaatgggaattgctgggtccacacacccctcaataagaaatgaattgtaaaaacaggtttattcatgcagtgattgttcacatgtatgaatgaagtgaatgatgaactaagactacatgtgtaacttggataaatctcaaaaaacaacgttgaatttaaaaaattacaaaaggacggaaacatagtaccatatatatacactttaaatacacaaaataatagtaaatattgtttatgaatacaaatatatgcatggaaatgataaggattatcctcagaatagtggtgtgattgcatctgaagatgaaaggagaagggatgaggagtggaatgttagctgtttctgcaatgctttcttgtcaggaaaaaaattctgaagaaaatgtggcaagatgttaacatctgttaaatcttggtattggctgtcgtattttctcctgtacttttctctgaaatactgtacaactacacataaaaataaatatttttaaaagagtgatttatatcttatctctttaccatctcactttgtagttgctttgttaaaaattggtttcttatcatggtccttttgatgaactgggattaaagaaaagagtcaaagagaattttttaaagtcattccaaattctacttcctgaaataataatttttaatgttagactactattattctagagctctttctatccctgtgtaataaaataagtggatagaagggtgggaaattaatgagaaaggaagaaggaggaaaggaaaggaaggaaaaagatattgaagaaaaaatctaggatataatcttcatgtgggaaggacttactttaattttacttgactgggacaaaagaaaaaaaattaagttgaagaaattgtggaatctcaaatgtttgttagccataagagacgatatttattttaagttcagaaaagattttgagaaaaacattaagagactgtagtccttgtgtgtttttttaaactatctatttcgaatataaaaagtgtcagttgattccttgctgtgaaagataaggacattagcacttccaaaattctgtctacgttttctctcccaacccccaatttatcttaggtatatttttatttttacactgacaaggtagaatgttcatactttgtttagtattcacacatattttagtagttttgtatatttgaatgaaattaccactaaccacattttctcatttttttctccatccttgaattctttgatttatttttgtgtgttgattctcttgtcagtttttttttttttttcaggaagtgctcatggatgtttttgagactgggtctccgtctgtcacccaggcaggaatgcagtggtgccatcacggctaactgcagcctcgacctcctgggctcacacgatcctcctgcctcagcctcctgagtagctgggaccacaggtacacgctaccacacccagctaaattttagtttttgtagagacagggtctccctatgttgcccaggctgggcttgaacttccgggctcaagcaatctgcctgctcagcctcccaaagtgttgggattagaggcgtcagccaccatgctgagcctcttttatcttttacatgttttttttgtgcttgaatactttttacttgaatgacatcttataaatttacacaatcatttctcatggctaagaagtgttccaatgtgtaactatactagaatttaacatatttcctaattttagaaatgtaggttgtttgtaatatgatgctgctgtaattgtgactgggctagaattattagtgtggaacttttcaaagatcttatttctctcctgcactgccaaaaaataaaccctggatgcccaatttattttatctttaccttttcttaaagaggaatattttttttcttgttgggagaagagatatgtcaatcattatagttacgttctgagagtgggatggtgtgcaggataaagaagaaacccactctgaccgagactggaagaggagtttgttaaagatgtgggggaagtaagatttgagagagaggagtggaacttgagcagttacagaatatgaaggagcaatcaggaaaggggattacagcttaaaagtttttgaatagataatatgttcacatgtttaaatccaaagagaataaaattcaaagaaaagtccctgtaactcttttccaccagtcacccagttccctctaaaatattggcaaccagaatactagtttctagggatcactccagattctagccatacacaaggaaatgcaggtatattattttcttataccctgtttttactgaaatggttacttactttcatactatggtatgattcccatggagtggggtcatatctgtgatgaagcttgcttttatggcttttctgtagcgttcggggatctggaatggaggtagctctccagttcaagcttaggctaagtggcataaatgccataagggttaatgtattggaggacatcacaaagggcatggggtcggtcctagatatcccagtaggctatgttccaggctttacagatgggagttaataggaatggcattgtgacaagaaaaataacatttggattcaggcttccctcttcagggcccattactggctgttttaataaagaaggccatttctgtatctttggaggccaactttggttgactgtggattacaggtatctgtctgtttttgtttttgagatggagcctcactctgtcacccaggctggagtgcagtggcctgatctcagctcactgcaacctccacctccccggttcaagcaattctcttgcctcagcctcccaagtagctgggattacaggcacccgccaccatgctcagctaatttttgtgtttttagtagagaaggggtttcactatgttggccaggctggtctggaactcctgacctcaggtcatctgcccatctcagccctcccaaagtgttgggattacaggtgtgagccactgtgcccagccctgtttttttttttggaaaaggaatctcgctctgtcacccggactggagtgcaatgatgtgacctcagctcactgcaaccttcatctcctgggttcaagtgattctcctgcctcagcctcccaagtagctggcattacaggcaggagccaccacgcctggccaatttttgtatttttagtagagatggggtttcaccatgttggccaggctggtctcgaactcctggcctcaagtgatccgcctgcctcagcctcccaaaatgctgggatcacaagcatgagccactgtgcccagcctattgttcttattggactgtcttgatcaagtgcaaattttgctgtatgatttcaaaagtggggagccagaggctgtctgaggattggtggtttcagagagtgtacttcctgaggcctctgggtgtgtaccctctgtggcttccagattcattcgtcctgcagcctcaacctattctccttaacagaggaaatctaatattagattcactcgaaaagtgtggaagacttaatgcaaatgcaccacaaagaacagctcatggtagtttctttattagctttgaaatatagaatggacacaagccagaaagtgttactgtgtattcctgtggccccacacttgtttggaaacggggctcctttttatcattctgttggtcatgctctgtcaggttggatgggaccaaatattctttaagttttctcagttcgagcaagtttcttgtaaggacgtatttggaaataagtataagtgatagaaggtgttataagtaatccagagaggatttaaagtatatggaaggatgtgcttaggttatatgcaaatactatgccatttaatacaaggaattcatttgtataaggaatagcaaaaagtcccctcagcagcattccagcctctcagtgtactggaaggacatttattgccattagggtaacacaggggctctcgtatttcaagtcactctggtgactccacatcacctggtaatctaacatgctggtgattctactcacctgcttttatttcttcttttccagattcttcctattttgctcccgactgatttgatcctgctgtgtgtctcctactcctttgcgtctacctcctcatgggttcagatgctttgtgattctgcacctgccttctctctctgtgccgttcctcttccatctctcttccatctgtatgtcttgctttaaaactcccaaggaaaaaagaagaaaagtcggctttggtcatttgtcaatattcagtagtgtgtgcctttgttgagcagagctcaactgcatcagcccctctcttgcacacctatagagggacgccttattttggttaagtagccatctctggttcaagtatctgtgcctagggaggcaggtccaatggtacaaagcatagcaacctatacattcagaaactctggggagggaagtgtggatttggcagagaccttactgctcatctgatatagttaccccaaatcctaatgaggttgtttgagcctagtgttaggccattccaacacagtttctaggccaacagttggaactctgtggtaaactcaccggtttattaccatccccctccctggtagtgctagtgattcatgtcatggtggtcggctgtggtggagattgcatagtctaattctgtttcctctcctcctgagcacatagctatactgtaattcccagattctcttgcagatagaggggagctgggaattatggtctagctagaccatgtgacctagtttttaccaatgaaatgtggatggaggtaatgggtgctacttctaggcccggtccatggaaacctcccacgtgggaggtgcttttccctttacagcttgatatatacagtatagtgacattggaagccatatgttgaaaattatggaaccacaagatggaaggagctgggtccctgaatgagttgtcggaggaaagccatccaccgatcaggaaaatccattttggattttatgtgagccgtctccatgactattgtgttaagccactggaggctggagtttgttacagcagtggctgttatcctcacatagtggcattattgattttgctccacagggacccaaggaaggctttgggctccttaggtatcttggtgagcactgtcccaggcggaagttggttaacaggatggcccccttcagggagggctgatggggtatgggagagcgaccatcgctttgctactcctgataagcatgacataaagaatgtctctctttaagccttcctccccgaatcccaagctgtggatatcaatacatttgtatagattcatgcgagagttccagagtattctgaaactgcctctgaatttatttgcagaaaggtaggggttagtaactagtgataccactttatgcacagagcaagtaaactccatctttaccatggccaactgtagcaatagagttcagtgttttctatatcacagatagaagaagtaacaaaacttcatccatttcatcttcatatatagtaaggcgaggtgtctgagaggcaggggtgagaaagacaagactggcatgcatggtattgaaatggctgtgaaagggagaagatttgcttatagtagcagggcccaggtagcatgggaattcattacttttatctttaaaggggttagaaacaagtgttcagaggtgccatgcagtaatgaaaccagtccaggagccaggctgtaagtgctgtaattcaagtaagcttttggttaatttaaagggatggtagttacaccagctcctaacccatcgccatcttctgtttcatgtttttgattactgagaagtgacactcaaatgtttattttttcttaaaactactgagtacattttgtaacagctccagtttctactgagagctcatttatgccatatttcctttgctcacataactctaagagtacttctgttttttactgaaagcttgtatttctgtctctgctaagttataaacttactgatgacaaaatgtatttattatttgagttctgtaacgcatacaacattgccttttctctatatacagtgtgataatattagctgggggtatgtaactagttgtgtggtgttattaggaaatgaatctgtaaaggtgggctggggccattcagtgaatgatcttgtctgttgctctaggatcctggatttcattgtgtaagcaatacaaatccataaatgctgagaagggataagatgagatttgggcttttagaaagaaaaccctagccaggtgtggtggtgcacgcctgctgtcccagctacccaggaggctgagacggaagattgcttgagcttgggagttcgagaccagcctgagcaacatttcaggattaaaaaaaaaaaaacaaaaacccaaaaaagaaagcaaactctagctttaggatggtagatccattggcgtgcggaccagagcagtagttcttaatcctgggtgagcttcagagcggcctcacagcacggctagtccggtactgcatgcgaaggagcagcacagagctggcacacggcgggctctccaacccaactggacctggtgacctttatgaacccgcagcccaaagccaggcagaatcaaggaggtctccacaggtgccggtgtgggtagcttatgggccttagccacaccctggcaagtaactatcccttttcataacaaagctttcctgggcacttaccctgccaactgtattctgccgagttctcctctcccggaggcagtgagcatggaatgcccttgtctacgttgggaaaaggatataaaggattatggatgaaataccttctcccacaaacgccttctatataaaacaaaactaaaaaatttccacccactaaaacccctggctaaggccctatgattatctttctctttacagctaagaatcttaaaaaagagtttgctctttattgagcactctgttccttcttcaacgtgcaatttgtaatttcacttctatctctccgtcccatcctgttcaaactgtttttcctgaggttgttgtctcttactttatttttcatatgattgtcttttgttttcttttcttttctctcttcctttcctttcctttctttctttcttttttcttttttttgacagagtctcacttgcccaggctggagtgcagtggcgcaatctcggctcactgtagcctctgcttcctgggttcaagtgattctcctgcctcagcctcccaagtagctggaattacaggcgtgcaccaccatgcccggctaattttttatttttagtagagatggggtttcaccatgttggccaggccggtcttgaattcctgacctcaaatgacccacctgcctcagcctcccaaagtgctgggattacaggcatgagccaccacagccggcatcttttgttttcatccaacacctctgactcttttttctcagcctctgctttgggacgattatctttctatctggactattaatgtctgctagagtttcatctccatccttcttttcatttacaccctttctgggaaatctcttccatacctaaatctgtatcttaacctggaaaacatttttaaagtctatataaaaaaagcccttcttagttcaaaggtaaaattttaggaaaattaaattgaaaacttataagaaaataacaataatggaaactagatttgaaaacagaaatgacaggatgggcgcagtggctcatgcctgtaatcccagcattttgggaggccaaggcaggcgaatcttttgaggtcaggagttcaagaccagcctggccaacatggcgaaaccctgtctctaataaaaataccaaaattagccaggcatggtggcatgcacctgtaatcccatctacttgggaggctgaggcaggagaattgcttgaacctaggaggcagaggttgcagtgagccatcattgtgccattccactccagcctgggtaacagaatgagactccatctcaaaaaaaaaaaaaaaaaaaaaaaaaaagaaaagaaaatggaaatgatgttagaatctatgagatacaaccaaattaagactcattaaatgcctatataaagaaaaatgaaagcatgaagaaaatgaacagaacatccaactcaaaaaagctagggaaaataggtaaactgaaagaaagcagaaaggagaaattaatgaagataaaaacagaattaatggggttgggaaacagtgtaacagtaggaaccaataaatgaaagttttttttttttttttgcaaaagtttaatagaaagataaatcactagcagtgtcttatttgggaaaggacaaatgcaagataacttgggagacagaatgattaaaacataggaaaatttcaaatctaatgagagtcatttgtacaactctatacaagtgaatttgaacacctagctaaaatggtcaactttctagtaaaatacaatttgccagaaccagtcctagtcatatgtatatagattggaagagttaatattgttatgattgcaatactccccaaattgattaacagattcattgcaatctctatcaaaatcctggttgcctttttttttttttaaacaaattgacagttaattctaaaattcatatagaaatgtaagggacctagaatagccaaaacaatcttgaaaaaggataacaaagttggactcccatttcccgatctcaaaatttactgaaaagctacagtaattaagactgtgatactggcatgatgatgtaaggctagacacatgcatcagtggaatagaattgagtctggaaataaacccttacacttatggtcaattgatcttcaataaaggcggcaagacaattcgatagaaaaaagaatagtctttacaacacatgatgctaggatgactgaatatccacatgcaaatgaatgaagttggaccctaccacacaccatatatgaaaattaactcaaaatggataaaagggctgggcacagtggctcacgcctgtaattccagcactttgggaggccaaggcaggcagatcacctgaggtcaggagttcaagaccagcctggccaacgtggtgaaaccccatttctactaaacatacaaaaattagctgggcacggtggtacacacctgtaatcccagctacttgggaggctgaggcaggagaatcgctggaacctggaaggcgggggttgcagtgagccgagatcacaccactgcactccagtctgggcaacagagcgagactctgtctcaaaaaaaaaaaaaaagaagaagaagaagaagataaaagatctcaataaagagctaaaatcgtaagacccttagaagaaaacattgatgtgaatgtttgtgactttggattaggcagtggtttcttagctatgatacctaaaacaagcaacccaagacaaaaatagataaattgaatttcaccaaaattaaaaactttgtgcttcaaaggacactgtcaggaagataaagagacaagccacagagtgggagaaaatatttgcaaatcatatatctgataaggggtctagtacctgtaatatataaaaaactgacaacaataaaaagacaacccaattaaaatgtggacaaagtatttgaatagacatttctccaaggaagattatttaatggccaaaacatcacatgaaaatatgctaagcatcattagtcatcagggaaatgcaaatcaaaaccatagtgaaatactactttagatccactaggatggctgtaattttaaaaatgaaagatagcaaatgttggtggaaatataaaatggtgcagccactttagaaaacagtttagtagttcttgggaaagttaaatgtagagttaccatatgacccagcaaattcattcctaggcgtatactgacgagaaatgaaaaaatatgtccatacaaaaacctgtggatgaatgatcatagtagcattatttatactagccaaaaaatagaaacaactcatgtcaatcaggtgatgaatggataaatgaaacgtgatgtatttataaaatagaatattgttcagctataaaaggaatgaagtactgatgtgtgttacaacgcggatgaacctaggaaacattctgctaagtgaaagaagctggacacagaaggccacatgtgtatgacatttatatgaaatgtctagagcaggcaaatctgtagacacacagatcagtggttgtgaggaggtaaggggagggagggatggacgtagctgctaacaggtatggggattctttatggggtgattaaaatgttctgggattagatggtggtgatggtagctcaaccttgtgaatatactaaagccactggattacacacttaaaaaatcaattgatgaaaaagcaaaacaaactgatctcacaaagatagaaactctaaacacaccaatttacatagaatcattaggcaagttttcagagttctctcaccaaaaggcttcaatccagatagtttcacaggataattctatcaaagaagaacattttagctctagtgctacttcatctctttcagagaatacaaagtaagtataatgttgacaccaaaaacttaaaaaagactgcattaaaaaatcttacaaaacaatcttatgaatatctgtacaaaaattgtagataaaatgttagcaacaaaattcagtggcacacataagcaaatggagtttattccagaaatgtaaaaatagttctgtgttgggaagtttattaatgtaattcatcatataaacagatctgtgaagaaaaatcataggatcatctctatagaggcatttgacagaattcacacattcataattttgaagactcgataaagtagaaattaaggacatgatttcttagcataaaatatgtgtgtttcagcccaaaatctagtttcttacttaataaagaaggcacaaacagcattttcattaatgtcaggaataagataaagatatccgcatttgctgttattatttagtattgactagaggtattaagcaatataattatataggtgataacagacacgtaagtatttgacgttaaatggtagaaggtagaaaagatagaagaaagaactatctttattcacagatatatgattaaatatctggaaacctcaagaaaataaatggaaaaactacaaagaaaaataatatttgctaaagtatagtagggaataaaattaatacatagaaatcaagagcgttcacctatacaaacaatgcccagttggatgatataatggaaaataagactcatttacaatagcaacaaaaaagctaaaatttatagacaaaaatataacaaaaaccatataaatgctacataattcagataacttgaaatatataaaaatagatgaacaaatagacataccatgttgttggataagaggacttgaaattataaagatgccaaataattctaaattaacttattaagttaacacagtctcaattaaaatatcaccagatcttttctggacctagataagtgaattttaattttcatatgagaaataagttagcaagaataggcaagaaaactctgataaagagtaaggtggcccagcgtggtggctcacacctgtaatcccagcactttgggaggccgaggcaagcagatcacgaggtcaggagatcgagaccaccctggctaacatggtgaaaccttgtctctacgaaaaatacaaaaaattagctgggcatggtggcaggcgcctgtagtcccagctactcaggaggctgaggcaggagaaaggcatgaacctgggaggcggagcttgcagtgagctgagaccgtgccactgcactccagcctgggtgacagagtgagactccgtctcaaaaaaaaaagtagggtggtgagtttagctttgtttgatattaaaacatactacaaatcctctattgttaaaacagtatggcataatggatcaatgaaatagaaaatccagaaattgttccaagtgcatatggaaagttaatataggatataaatagcatctctgatgtgtgaggaaaacatagatttaactggatagctatttagaaaaatataaaattgggtctgtacttcatgctgtatagtaagataaagtttgtgtgcaacaagtatctaggtttaaaacaaaaccttgttaagtatttaaaaatatgaatgaattccattataaacttggagtaggaaaaataactcaaaacaaaagccagaagtagaaagattttaaaatttaataaaattttacataataaaatttcaagccaaaaaagaattataaaatcaagagataaataacaccttgagaaaaatcttacattgtaaatggctaatatccctgatattgtgtaaaagtggtaactcttttaaaaatatttgattaaccagaaatttccatttcttgaccacagagaaaaaaggaatctagtatgccattattttgaaatttaatcttttcagtgcacccccttatttactgcattattcacaatagccaatatagggaattaacctaagtgtccaaacgaatgaatggataaggaaaatgtgatatgtttacacagtgaaatactatccagtattttaaaaaacattttattttgaaataattttagagttatataaatgcaaaaacatagtacccaggatgggcaacataatgaaaccttgtctctacaaaaaaaaaaaaaaaaaaaaaaaaaaaaaaaaagccaagtgtggtggcacagtgcttccagctgctcaggaggttgaggtggttggattgcttgaacccaggagctcgaggctgcagtgagctatgatggcatcactgcacttcagagtgcaacagagtgagacgctgcctcttaaaaaaaaaaaaaaagagtttgtgtatccttcaccccattcacatcttacataactacactacaatgatcaaaaccaataaattaacgttggttcagtaccatcaactgaactagagatgtactggagtttcaccaatttcccacgaattccctcctctctcccaggatccgtgcagaacgctgtcctgcgctgttgtcttgtctctttagccctccagtctgtgacagttcctctttcatcaccttgatacttttgaaaaatcctgctgaattcttttttagaatgtccctcagtttgggtttgccagatattttcctgtgattagattgagccagtatatttttggcgagaatactacacacaagtgagtttgtgcccttctcagagcatcatgtcagggaatacatgatgttgctctgctttagtactgatgatgttaaccttaattgcttgcttaagatagtgtctgccaggtttccccacagcaaagttatgaattttccttttgtatttggtaaataccttggaggagatactttaagactgtgcaaatattgattcccctcaaactctggcccacaagtagcatccgttggtcaatcttgcctgtgaatgttattactgtggtttttgccaagcggcgttttggtgttatttttaaaaaggaaattccaggacagtgggcttgttctcattttgttgggcagtcggcagccattgggcaatgtggaatttagaattacttaggcctttcccaacacagaaaaatgccatagtctattaattcagtaaacatttatggaacccttgttatgaccaaggcctcttggtgaaatatgcagacagcataggatctggtctgcacctgagtctttttctctgccactacttttcaccttgaatcacactcgccatcaagatttgttctaagatgttattgcaaaaagtgctgagagacaagtccaggagtcagaggataggaccaatttccaattttgccccagactagctacgttactagcagggcgagtcagatatcgtctcaaagttctagtctccttatttttaaaatagggaatataatatagattgacattagaattaaatgagtggatatatatgaaagtactgtttaagtgaaaggcatttttcaagctataaagtgttctacaaattaattattgtctgggcacggtggctcatgcctgtaatcccagcactttgggaggttgaggcgggaggatcgattgagcccatgagttcaggaccagcctggccaacatagtgaggccctgtctataaaaaacaaacacacaaacatgaattactcaacaaatatttgatttcttattaagtgtgagctttttctaggtgttagaatatagcaatgaaagccaaagcctctgccctccaggaacttatattttagaggaaaaaggtggataatagaaaagtaaacaagtaataaatacaatttcaaatagtaataaatgctacactgtaaataaaacaggatgatgtaacaaaatgtgctataaagaaaataaagtaggataatacattagagaattggggtgtgtttaggtgggatggaatagtttagacgttctggtcagggagtgcgtctctggaagtaattttcgagataagaactttaagattaggagtcagctgtgtgaagcaggggagagcaaatataaaggccctttgaaggggaaaggattaggatgctggagaaaagcaaagaggatagtgtacctgtgaggtcgctagagagtggtgtaagatcaagccaaaaacgttggcagggccaaatgacgtagagcattacatgctgtgaaaaagaagtttctcggtgcagttgatcaggaagaagttgaccagaaagccattgaagggttttaagcagggcattacatgttatgattttcattttaaaaagattgttctggctgctgtgagaatggattgagatggccatcaagagcagaagcagaatgacagcctgtggtctattgcagtggtgcaggcaagagggaatggtggccaggcaagcttggtggtggcagtaagttgtaagatgtcattattgttattgttatgggctgaattacgtcccctccaaattcgtgttttaaagtcttaacctccagtatacctcagaatgaaaccttagttggagataaggtctttaaagaggtgattaagttaaaaagcccaaacaaaagggaggtgattaagttaaaatgaggccattggggtgggccctaatccaatctgacttgtgtcctcctaagaagaggaagtttggacacccagagagacagtgggatgctcgcgcacagaggggtgaccaggtgagggcacagggagaaaaagtggcgcctacaaattgaggaaggccccagaagcagccgacctgctgacacctttatctgggacctctggcctccggaaccgagaaaatcaatttctgtggtttaagtcacacagtctatggtaatttgttatggcagccctagcaaactgatagagctatgacaatcatgggtatggtgctgatctcttcattgtatttatcactacctaaaattcgcttagatttatttatgtttactctttcactcccttgattgtaagttccattacagcagggattttgtctaattcatagtaatcgcaatgctgcggagtgcctgcgccatggcacatgaaaagtgaccgtgtggttaaattgtttctcagtcactctgtaatatccagtattttgtagagcttttgtttttaatgatatacaggagatccagagttttttagggggctacaaactctagcacataggactatataagaaataacactgcagcaagttagaaccaggtgttcaggaagcatatcttagcagtggagacacgatctcttgattagagggaccttggataaaagaggccttttttgaacagaatagctctgctgaagaaagagatttcgtcattattttaccttcatttcatggcttttccaaaataaggtacatgtgtgaaaaatgccctccgtaagggcgaggtctttattttgttctctgctgttctgtaaacgataccagcacatcatagggttcaaatatttgttaaatgaatgaaaacattttcagatcctgctttgtccttagacatttttggattgctttaaatgttctcttatccttagcataatattagctatttaatagagcaggtaaaatgttttgcctatttttttttgtctcttataattgtgtgaaatattctgaatctggtcttcactttggtgtttttgaccttaggctgcccttaaactgaagtcacagcctagctcaatggcactggctcccccttgtgtcaggaacttgatactacacccactaaatgccagcctgccaagaaccaagcttccccgggtcaaacattttaagtggtccaaatgctatacataattaaatgatgacaccacgattgggccaccttattggggctcatttgctccaaatagtcttactcctatgcccactactatatatatagcacaggtacagaaaaacatttttaatacttgtaaccataaaggcttttggagttagtttgtacttcttatcaatataagacatctacgttgacaaaagaaatcgaatgttgactgagtgcggtggctcacgcctgcaataccagcactttgggagacctaggcgggcggatcacttgaagtcaggagtttgagatcagcctggccagcatggtgaaactctgtctctactaaaaacacaaaaaattagctgggcatggtggtgggcacctgtaatcccagctacttgggaggctgaggcaggagaattgcttgaacctgggaagcggaggttgcagtgagccgagattatgccactgcactccagcctgggcgacagagcgagactctgtctcaaaggaaaaaaaaaaagaaagaaagaaaaagaaatcaaatgtctcagcatattttaaatactttatatggaacagttgattttcactttctttcaaaagcctaccaaaattgaggagttagcgtttttttaatcccatgaaatcgatttaaaaggaagaaaattatttttcaaagggacaacattttattttcaagagtagtatttgatttctgttttgtgtacatggtagaatactgagtgagttgctcctggccactctcgctgttgaggagatgaacccgtgcagggacggccccaggaaggcctctttagctgtctgaatgaagtgattttgactctcagcgtcagtggtgtgctggagccagaccgtgccgacttatcccagctcacaagagctaatggctaaatttcaggagttctgcaaactattgttaaagctagtttatattagaaataaattatatagacaattcagttatattaaaaaacaagggtgctttcttcagcagcacttatctaagatcagaacaacatcgagaagatgagcgtggcacctacacaggctggcacacacatttgtgaagcgttccatattttttcaggttattctgtattaaatgcaaaataaatgcttttattaacaatgacaaaaagaaaggtaattgtaataaatacaatttaccacttcgtaattactttattatattttactcatactttgaggttatttgtgtctagtgtatgtgtggtggatgtaccatataatggtatgctattgtcatttcttccagactccacctttagtgatttcatgtttgtaattggcagcttgaaatcgatcttggaacaatggaaataaaaccacaatggaaataaaaaaggatccaaatcaggactttttgcctatgaggagccagtgataaccagcccattactatatgcaaaacgagtttatatgttttttctctactccaaaaacttaacaaaagaaggaattattaaactttaaaaaacgattttaattttattttactacattggtttcagttttttattttattttatcatttatttatttatttttgagacggagtctcactctgtcgcccaggctggatttatttatttatttatttatttatttatttatttactttttttgagacggagtctcgttctgttgcccaggctggagtgcagtggcaccatctcggctctacctcccgggttcaagggattctcctgcctcagcctccttagtaggtgggattacaggcgcctgccaccacgcctggctatttgtgtgtgtgtgtttgtgtatttttagtagagatggcatttcaccatgttggtcaggctggtcttgaactcctgacctcaagtgatccacctacctcggtaccccctcccccgacccagccccaacaaagtgctgggattacaggtgtgagccaccatggctggcttggtttcagttttttaaatagttttttgaaaagataacttcaataatttaaattctttaataattttaataatgttaaaaatggttttaaaaggttgctttaatttaattgaatttatttatgttgagacagagtcttgttctgtcacccaggctgccgtgtgatggcagcatcacagagctcactgcagcttcaacctcacctgctcaagtcatcctcccatctcagcctccagggtagctggaactacagccacacaccaccatgcctggctaattttacatttttttgtagaaacaggttcttactgtattgctcagggtggtcttgaactcctggacacaggtggtcctcccgcctcagccttccacagtgctgggatcacaggtgtgagccaccttgccttgtcactggtcgagggttgtgactgcaagttgtccaggttcttggcattttgaacaaagaattggacaaaatgcccagcaaagcaaagcaaagtatgaagcaacaaaagaacaaaagcagggattcattgaaaatgaaagtacactccacagtgtgggagtgggccagagcagcagctccagggtccagatgcagaatcttcttgggtccaaatacccgctagcagttttccattggccacttcacgtccatctcatgtaaatgaagtgctagcccacagtcagtctgaatggttgcagaaagcagccaaccagaggctgaagtgaagttacaaaggtcacacccctgtgcaaacaggagttggttttcgcagccaatcagaggctagggtgaagttacaaagttatacctctgtgcaaacagacttggcaggccattagtctgactggttgtggacagcagccatcggtctgactggttgtggacagcaaccattcagaggccggagtgaacaaagatgcaaacgaagactcaacccgcagtcagtctggtttgttgcagacagccaatttcccatctgcctaccagaaaaggtagtgagtttgcaaagggagtagcctctggtccttttgttacttaggctggaaagttagggttttcctttcaatttagttctaggaagtcagtgtgaaatagccttaggatccctgcctccagaccctattgccctgcctcagcctggcctaaaagctttacttgaatcttcaatcaattcacttaattcaaagtttcatttagtagaaataggttaaccaaccttaatattatatatgattttatcaattatgttatatttttgtttcattttctagttcctgtctaatgtcttgttttcttatttctaaacttctttcttttattttcatcattaagctatgaatttttttcctatctcctgtaactttcttttcacttatttcagtgtttttacatttttctcttcagctgtctccctttgcagacagacctcgatctctttctcagaattaatggcctcatattttcctgacctgtgctccttctcgctgtctcttttattcttagctcacctttaggatcctcactactcctgaggctgaactgttagcaatacggtttcctccactgtggccaggatcccagctccatccggataccatctggacatgtgcagggctcacctggccccttctgctgttttcccatgtctttggcaccagaaatacgatgcgaggatagtgcataggatcattcggtcatttttgcctctagccccgtatttcagaacatgggaggacaagagaagctctgagtcgtttttgcttctgctgtaatttgtttttattctcatctcaaggaatttggaagtccttttgaaataaatgcatctcatttcattatcatttgaggaaagagacatttgagaggaaagggcgattaatatttaaacaccacctcccttcccctacctcatttgcccttgtatttttttcttctcactcgctctcttatattgcctttactgggcaactatgtcaacaaattgccactgaaaggcacctgactggtgagctgccttgagctgaggtcagtgtgatccttcagctgggagccgctgctccgttttagagggcgagccattgctaccgctgatgagctgagcctggggctcaacgagtccatctgaaaagccatctctcttccagcagcagggagccactcgcagtgctgctttcatcagccttcgtgaaggatgaaaagggcttcgtcttttccacacacacttgactccagcagcgtgggggtttggagcactgatctcccctaccgttgaaaacccacgtgtaacttttgactctcccaaaacacaactaacagcctgctgtggactgaaaaccttactgataacataaatgtcaattaacacatattttatatgttatatggattatctactgtattcttacactaaagtaaactaatgttactttaataagagagaacattaggccaggcgcagtggctcacgcctgtaatcctagcactttgggaggctaaggcaggtggatcacttgaggccaagagttcaagaccagcctggccaacatggtaaaaccccatctccactaaaaatacaaaacttagccaggcgtggtggcgggcgcctgtaattccagctacttaggaggctgaggcaggagaatcgcttgaacctgggaggtggaggttgtagagagctgagatggtgccacggcactccagcctggtcgagagagctagactccatctccaaaaaaaaaaaaaaacgaaaaagaaaatgttattaagaaaatcataaggggctggtgcagtggctcatgcctgcaatcccagcactggcactttggaaggccaaagcaggtggatcacttgaggtcaggagtttgagactagcttggccaacatggtgaaacctcgtctctactaaaaataaaaaaataaacttagtggaacatggtgacacgtacctgtaatctcttatttgagaggctgcggcaggggaatcgcttgaaccccagaggcggaggttgcagtgagctgagatggtgccactgcactccagcctgggtgagagagctggactctgtctcaaaaaaaaaaaaaaaaaaaggaagagaaaatatatttactcctccttaagaggaggtggatcatcataaaggtcttgattatcatcttcacatggaggaggctgaggaggaggaggaggaggaagaggggttggtcttgtttcgagtggcagaggcaggagaaaatccacatctaagtgggcttgtgttgttcacaccatgttgttgaagggtccactgtgcctttcttttacctgcaaggaatggtaggctgatacacagcctcatctcaacttttacttcaggaaacaatattttaggtctatccagggtctccaagtttctgaagtactgagtgaaaatgttgtaactaatatattttgttatgaaactgaggattaagacatccttcataaccagcttctgaagccaaagtgatacagatagtataacaccagagtaaattgttgtataagtagtttatgtatatgaggcagggtttctgttatcctttgttattactgtggttttgatggatgagagtgaaatgtgcttatcttgttttttttttaaataaaatctttttatttaaaaaatttcaaacttctaaacggtaagagtgttgccctgaactcctgcacacttttacttagattcgccaatccctcatgatctgccacatttgtttttgcctcctctttctccttctccctctctcccccgtttctctctatatatgcacaaacacacatacctatttatacattttattattattgttattttcatcatcaccattttgctagactatttgagagtaaactgtaaacattgtaacctttccctgaaatgcttcactgtggatcttctttctttctttctttctttttggagaaaggtgtcttgctatattgtccaggtgggaaatggacatgaactcctgggctcaagtggtcctcccaccccagtttcccaagtagctgggactataggtgtgcaccgctggggtcttcctttctttctttttcttttctttttttttttttttttgagacagagtcccactccatcacccagatgggagtgcagtagctcgatctcgactcacgcaacctccacctcccaggttcaagtgattctcatgcctcagcctctcgagtagctggacttacaggtgtgtaccactacagctggctaatttttgtatttctagtagagacaaagttttgccatgtgggccaggctggtctccaactcctggcctcaagtgatccacccacctcggcctcccagagtgctgggattacaggcatgagccaccgtgcccagcctcagtgtaggtcttctaagacaagaacattctcttacataagccacagtgtctgtgtgtgctcttaaaaataaccttagagtcagatcacttgggttaaggtgtcatttggctcattcctctgcttcttgcaggtgcatttctaaacagtacaaaactgatattttctgggagtgatagaccgaaattcttatgggggccagcctgtgatataaaagtgagaatctgacagagttcatactgtactcatgacatgtatgtatgccccacctaaacaaataaacacgccaatcctagactaaaaaaaaactgtaataagaaaaaatcatcaacaacaacaacaacaaaaatacccgatggccaaatttgtcacttgggtcaacaatttgcggccctggatctacggtcaaagctcccgtggggtggaatatccacagctttctttggaagcactgtggtatagttcagaagttctcctttaagtccaagtgcttgactgagatttgtgagaggcagcagtcgcagtggcaggtagcatgagagctaggctgtgtgtgtgaatcccgtttccaccatttgctaccggtgtgatcttgggaaaatgtcttaacctttctgtggttcacttttcctcatctgtaaaatagtacctttcacacaaagctgtcatgaggaagaagtgaggaagaatatttaaagcaccttacaccagagtctggcacgcgtaataagtcactgtagaactggattctgcgaagacgaacctgatggctagaggccatcacatccatgcagatcatgatcctggtataaggggagagggatgtgaggactgttcctcctggaagacctagagaagatgttcattcttgagccagaaagctacttaatctacttttctcccattgggagtgactttcttttgttcttatccccgttgtcttttttttcttttttcttttccctttttttattagacggattttcgctcttgttagtagagatggggtttcaccatgctggccaggctggtctcgaactcctgacctcaggtgatctgcccaccttggcttcccaaactcctgggataacaggcgtgacccaccgcgcccagccctcatccccgttttctactcatccttcttgtcagacttctccccagctctctcctatatttccctagtgctgagggggtcactgcttgaatattaactctacgtgatccctgacaagttatttaatgtctttgagctttagttttctatctgtaaagtggggacaataatagtacctacctcctagttgttgtgagggttcagtgagttaatgtagggattactgtgtcaggacagtccctggcacacagtaagtgctgtggaactctcagctattgggtaggatgtgcatcattctctttaatagccatattcctccacggtgtactctatacttgtgatctcaattttctttttgctggctcttttttggagttttttcttcctctttttctcctctgcaagtgctcttattgaggtcagtcctcttctttttgtccagatctaagattctgcttattctcttagccttctgaaatattttatttttttactttgagacagggtttcactctgttgcctaggctggagtgcagtgccacgatctcggttcactgcagcctcaacctcctgggctcaagcaatcctcccccaagtagctgggactacaggcatgcgccaccataccccaataatttttaaaaaatttttggtagagatggggacttgccatgttgtccaggccaccttctgtaatactttaaactgtagcaacctggccaggctcatgcctgtaatcccactactttgggaggctgaggtaggaggattgcttgatcccaggagttcaagaccagcctgggcaacatagcaagactctgtctctattaagaaaaaaaaaaaatcagctgggcatgatggtgtgtacttgtagtctcagttgctcggaaggctgaagcaggagaatcgcttgagcccaggagtttgagtatgtagtgagtgtgatcgtgccacttctccagcctgggtaacagagcagaccccatctcctcaatcccccccacccaaaaggaagacaaaaccatcgatattattttgcagccagaagcttgggggtaggggacagtaaggaggttattggagaaagggaagtggagatgaggagggaagggagggagtgggagggagacactggctgattggctgagcagtggagagctaccgatggcaggattctgcagcgcggtgaggcatggggtggatgttgcgaaatgaagctggcggttacaagataagccatttagaagaagtgttgtgattagtgaaaggaagccgggaaatagaatagagtggcgaagcacctatcaagttttttcaagataaggaagatacctgaatattttaaggcaaaagaggaaacagctaataaagaaaataatgaagatgctgagagggagaggtaattgtgtgaagaacaagagctgagtgtggaaacgaaaaactaagagggagatttgcttctttgaggaggagcactttttatttctccaaggctacgagcacgaggcaagagctataggacattcctctaaagtggtacaaagtcagcgactgtaaaggtgacgtgaggattaataatagcacccagtgatcgtgcagttcacatctgttgagtgcagtgggtgataaggacgttttctgagatgaagggagggaagtgggtgataaggacgttttctgagatgaagggagggagtactttggagcttgaggcaagagatgctgcagaatagctgttttgagggagtttgccaggaagtcaacagacgactgagcggattgttaggcaacacccaggacagatttgatgttggatgggggtgaatttgtcataggccacgcttttttattttattatttattgcagcagtgctttgcaggaacaaagaaagtgaaaattgagatgttcaggattatggactaacagcaggcaggatggagggtgaagggcccagagttcagggtggtgacagtggccattttgagtggctgagtgtagaggactgagcagccgtgtgtagattaactgccaagcacagctgcgtgagtgagcctaggccaagctagcggaggaaccacgcagccaacccgcaggatggcggaaaagaataagccgtggttgattccatcactctgtggcgggcagcttgttacacagcagtagaagatgcatgccatgccttgtgttgactgcgcacagcagggagcctgaggcaagggagcctggcacagaagcagaggtcagtcggctggagaagctgggcaggtggagaagaatagagggggcctctggggagcacccagaaatacccagcagctctggagaagtgcaggttttagaatgtgagagtgagaaggaggcttgccatcttgagagatacacacctggtggcaagttgtggtgacggtaagtgctggagggagcgcagccacagctcagactgtctcttttcttccgtgccattcactctcagcagaggaccttgccttgtactacacagaggacagagaagtctttttatgtgagtttcttcatcatcccatttccaaagacaaactagggatacagatatgaattgtatgataaaacttgagataacagataagtcacattacttttctaagtctgattaaatcttgtgcccctacttgtcaagaccaataaaaagttagtagttttcgtggcttctttttggctcttatattgtacagtaagtcttctcttaacctttcaatcagttgttggaaactgcgactttaaatgaaatgatgtacagcaagtctttgaataatgttgttacaaagttgatgagaaaaaaaaatggttttgttatatgtccttttgcttacggttgtagtttccaagaacccatcaatgatactcagagaagacttgctgttctgggactccaaggcttagtgcagtctctgggggaaactggagagaggaaaagcattgtgctcatgagctgtctaggcctgagacagggacagcatccgtgtcgtctgcaccaggctcagccacagggagccttagcacagcttccagggccccagagctcaatggagagattagctttccataagaggaaggaacctcatccagtgcagtagaggaaaagagaagaacataggtgagatataggtgggctagtggagcagtttgtaggtgtacagggagagttcttgaggaagccgtggtattgttcttcaggccactgtggcctcatcagcaaaagaatctttgcctttttttcttatatcatcaggcctttgtgattcgagactagagagaaagaagttgcttaatgcctgcaagatgtcaatcacgtgggctttgttttctggggtctacccgggcaggtgagaccatagcagattcgctcagcagagaagaggatggtgatgggttcctcaaggggatgtgaaagagggagagggaaatttcctatgatagggaagaacttgccattctctcacatgtagcaccttgcaggcggcaggacctaggatgggggtggctggaagaacactgagcgctaagtgcctggccaaggccctcccaccctctcaggaaacccacccacccagtgaacaacgcccgcatcagccttctttgcacgggctctttcccagtagcattaaaatatgctcacatcattcaggtcttcagtatcaaaaaagaaaaaacatcctctttaacaccatgttcctctccagacaccccttccctcccctttacttctgtttgttttttggggtttttgtttgtttgttttttgatgtgggggtctgtgtatgttgcccacgctggagtgccaagtcagtgtctgttcacatcacgatctctgctcactgcaaccttcgcccccacttcctctgggctcaagtgatcctcacgcctcagcctcatgagtagctgggactaccggcatctgtcaccatgcctgacttctccctttcacttcttagatcctccttgacccactgcaatctaatttctcctccaccttcaacggagagtgcccttgtcaaaatcatagctgatctccttttttactaactccagtggctgtttctcagaatttacctccctcgacctctcagcagcatcggaaagccaaggatgactttccattttttttctccttagcctccacgccccggccctctcctggatgttcacttccctctctggctgctctgctccatctctcatgcgggttcctctttcttggatcgttccttgaatgtgggtactcctcagacctcttccttctctttcccagccaatacattctacgtagaggagctcttctgctcctgtggcttcatgaccggatccacgtctccagccagatccttctcctgcacttcgcactcttatgagtatcaagtctgtggtttgattttaccccacttgtaagctagcaagttagcttgttactgtctcatggatgttggcacaagacttgagactcctgagtcagtgacaaaggacttcattcctcttggcacagcaggcaacatgagcatcagcttgtgggtgacagttactcctgccctcaccttttcctggtgatgggcccagctggatgcctgcacaggaaatgggtggcatcacagaaagggaacagagctttcagaacagagaatttcagggaacagaacaggggatatctactgcttttatagcaagcaggaagcaagcctgctctttggcctggagggagacattatgtcatctctcgaggctgctcactgcggcatagccctgagagatggtcagggttttcatggcataaccagcaagaacaagcatgttggaaattcaacatgtcccagattgaactcttcatttcccttcacctaaacttttttacttcctttttaaaaatttatttttatttattttgcacatttattggtatttcttttagagacacgatctcactctgtcacccaggctggagtacaattgcaggatcatagtccactgcagccttgaactcctcggctcaaccgatcctgccatctctgtctcctgagtagctgggactacaggcacgtgccaccacactcgactaatttttaaaattttttgtagacatggcagtcttgctgtgttgcccaggctggtcttgaaatcctggcctcaagtgatcctcccacccacagcctcccagagtgctgggattacagatgtgagccaccgcgcctggcctgtttctccttctattttctgaactcagtgattgatgcagtcctcgatatttgtaactcattaccaactgataagaaattcttaactcttttgactttcctctccctcatgaagtctgatgactccttcgaactctctcttaggtttatttgctcttcttgccgctcgctgcctatccctgggtcagactgtgcttctcttatgtgtttaagacaattacagccttttatcatccagctagaatattcattttatgaagttgtaagttgttttattacgaaatgtttttagagacagggtcttgctgtgctgcccaggtggagtgcagtggccatttacaggtgtgtaatagctcactgcagccttgaacccctggcctccagccgtcctcctgccccagccttcctagtagctgagactaagttacttaatttaaaatgtatgtattcatttgtttgtaattcaaaagattcaaaaggtagatgctgaaaagacttcctccagcctttgcccctgccacctgctctcctccaaggcattctccaccctccagttaatgttaccagctcctcctgtatcctgttaatactgtacccaaggtagacattttatactcaggttactcaagtaccgtatgtgagattgtgacacaaatttccataccttacatttgcttaatacttttttttttgagacagattctcactctgttgcccaggctggagagcagtggtgccatctcagctcactgcaacctccgcctcctgcgttcaagcgattctcctgcctcagcctcctgagtagctgggagtgtcccagagaggaacatggaggcttctgttgctgacacagcacagtggaattctcactttctccttatctgctctcttctcagtctgactccagatggaagctcttccctagaaaagccctgtccagaaggagtttgcatagtctatcattttccattttctgttagccacattttttcaagtaaaaaagaaacaggtgttggaagaaaaactttagacaaggccgggtgtggtggctcacgcctgtaatcccagcactttgggaggctgaggtgggtggatcacgaggtcaagaaatcaagaccatcctggccaacatggtgagaccccatctctactaaaaatacaaaaaattagctgggcgtggcggcccatgcctgtagtcccagctactcaggaggctgaggcaggagaattgcttgaacccgggagatggaggttgcagtgagccgagattgtgccactgcactccagcctggagatagagcaagactccatctcaaaaaaaaaaagaaaaaggaaaactttagacaaattgaatttaacagaatttaattgagcaaagaaccatctgagaatcagctcacccttccaaaaaaagggaagtgatgtacggaaaatggaagtgaggtgcagaaacagctggtgtagttacagctcgaagttggcctcctttgaacaaggtttgaaccgttggctgtgattggccgaaactctgtgattggggcatgagtaggttatgtctgttgtaacatccggttaggttgcagttcactatatatgcggaaacctctaggtcaagcttaaaacatgtaaggaggcagctttaggcgaaacttatataggttggtgcaaaagtaattgcagtttttgcccttttaatggcaaaacccacaattttgcacgagcctaataatttaacacaagtaaaattaattttaacaacgtatcttatttaacccaatgtgtctaaagtgttatcatttcaacatgtaaccaatattaaaaattattaatgagctattttgcattttctttttcatactaagcttttggaatcagtgtgtattttacactgacagtacatttccatttgcagtagtcacatttcaaatgcataatagccagatgtagttggtggctgctgtttggtctagcacgggcctagaatttgtcttttcccaatcttgtctccttcaaaaatctttttttttttttggtaattaaaaagtcgatatatcatggttgtacatatttatgaggtccgtgggctattttgatacctgcatacaatgtgtaatgatcaagtcagggcaattgggatatccatcacctcaaacgtttatctttgtgttgggaacattataattcttctcttcttgctattttgaaaatagaataaattgttcactctaattttcctactgtactatcaaatactggaacttactccttctatctaactaatatatttgttcctattaacccaatatctctttgtcctccttctcctcttcccttcccagcctctggtaaccatcattctactctctacctccctgagaccaacttatttagctccagtaagtgtgagaatgtgcgatttgtgttgccctccttcaaaactcttgcctgcaataagagtgagaatgtgcgattagccgtgcatggtggtgcacatctgtagtcccagctacttgggaggctgaggtgggaggatcacctgagttttgggaagtcaaggctgcagtgagctgagattgcatcactgcactccagcctggacaacaaaagcaagaccctttctaaaaataataataataataataatatctttgctatatgaaagaaaaaaaacaagaaaatgggaaaaaaggaaatatacttgacatgaggatagtacatgttttgttggcccttcatttattaagaaggaagatgagtaagtgaaaagaatcctatattccacagttactgactttaggtttcacttttaagttgatacttattctgcaacctctttcagtgaagaaatttaaaattcttatttaaaacgttttctttgtaaatagggagtaaatataataccactaaaattatccagagtggtaaagaaattaactactctagttaagtgaatatttgcgaaattaaattaacattcaaacattacaactttaattttgataattttgaatggaagtatttcgtaatcaattacacatccctgtcttaatattcagagagtattgaatagcatttatacttttcttaggttatttgtggaattgaactacgttatgatgggggcagggagaggtgaataactcatatttattgagtcgctgctctgccaggagatgtgctttgtattatgatagctcttcttatttaacccttagtgtatcccccttcctggttcttagtgtttgaaggaagtcactgtgttttacctaccaggtaggcttatgcacacattgattaggtaggtgatctctccaatctagtaagtcacagagctgggatttgaaccctagtggtttggcgctagaggccatgcttttaacactctgatactaatgtcaacttcaccacaaaactctgcggtagacattatcatccccattttacaggtgtggaaactgaggctcaaaagagttaagtaacacttaacgtcagttggtacatggccaatgtttctttttctttctagaacttttttatattggcccaggcaaggcatttgccagtcaatgaaaccatttctttcatctttctttggttcacttatcctcctttttctttccccagaaaacatcttttataatcatgaggcaatatcggagtgatttggtttcctacattacaaaatatgctctgagataatttggagaaacctggccttttcggagtttatattctaaaaccattgaaaacttttttttttccagagagattggaacaattatcaggtcattaggatgctgtcctacggaaggagagctgcatgatctgattgcagaggtgagtacggcgaaaaggtttcattcagccagctctctgtgtgagagctactccttgtaattaaaaacaatccttaccggaaactaaaaaaaagtgccccaaactactgaatgtgctcagtggaaatattaggataactattcatattagccaaccaacaaaatctgaaagaattgagcagatcttgaagaaatgactatgaacaagtaacacaactgatcaaataaagaacccactgtagaaatgatcctctctgtaaaattagttgaaaagaggccagtagatgcaaggggctgaccgtatgcagaaaggctattgacagagacagtaaggaatttttatttatttggggaaataaaactaacttttagaacaagtagtaaacagaataaaatatcaagaatgaactttacattgaccagagagtctaagaagtttaaaaacgagtcatgtgtaatagtggaggtgaatgatcccataaggcagtggatgagcagcccacgatgagagtgcttcatgctctgtttgactttccagaaaggtctctgatctcatttcaaatgcagcattcggttcaacaacagagactttaagggaaaaaagctacctggccaggagaagaatcttttcagaattgcttatctaggcacaaagattttagtggagtctggggatggcaaaggggataacaggagacaggtgaggaggtggaattttatctctttattttgcacctagcgcagtacctgcttgttcaacattaagttggagagaaggaattgtgaccgtggtgagtcacttaacccctgttgagtgtcagtttctccataataataactacttcaaagtttgcttcaaagataaatgaaagaaggtacaagaatgcatgttttgaatcctaaagcattatgtaaagttaaggaagggaagattagaaagatgagtctgctgcacagatattagcaccttggtgaccaaaaagcagtagcaattttttgaagcatttggaaatattcagtaaaggaatctaagttgtaagaacacattgtttttaccttttgggattcaataaagctatttttaccaagagtaagaggaaaagcttgtttttcctgaattgatgctcacattaaaaaaagatactgattactgccttaaagtgtttctgcacaaagctggaattagtgttagggaaaagcaagctggaagtgtggaagaggtaagaactagaggacgaatttacagcgaaatcatcatcatcacatgctcaggatagtaagtgaagcaataatgaaaaatacctccgaaggtcagaaaaggaggatctctagagtctagtccctttatggtttgtttgtatgttttaatctctatcaggagttagcaaatcatggcccctggccaaatcctgcccaccgcctgtgcatgtaaataaagtttcactgaaacacagctaaactcatttatttgtatattatctatggttgtttcctgactacaagggcagagttcagtagttgccacagagacctacagcttggaaagcttaagatatttaccatctggcctttgcagaaaaaggttgccaactcctgatctatgggcttctgtgccaaagtagaacaaataccacatctagtactagaagatctgagttcaaactccacagctaccacttatagccatgtggccttcaatgagccacttaatccttcaaagcttcgtttcacatctgcaaaaggagtataataacatgaaaatgtttttatgaggattaaatttaataaccgaggaatcaactgttacttggtgggcatgcagtacatacttgagtttgcttgcactgctggtggctctctaggataataatccccactggtttgggcagttagccacagtgggtgcttaggtcctaaagttttattttatttttacccttttttagggacatgacacaacctttgaaaattacagatatttagaatacttatgtaccagtaggggtcactgagctattaagctctgtaaatatttttctatatttgtatacgaacacaatttactctaattaaattctactgataaacagctttgggtataactaccttttaagaacttttccaaataaatgggtgggaaaaaagcacataaaaaaagcacaaatttgaattgataaatacaagtatgtatttgtacatatttaaatacatttaatagtgaatacatgtaaacacatttagaaaatcaaagccccgtaaaagtcaacatctaggggtaaatgtcatattgctaaatgttctataatagtttcagagatcaaactatttaaatgtatgtgtgtatatgctttaaaattgctctataaggctgggcacagcagctcacgcctgcaatcccagcacttggggaggctgaagcaggtggatcactcgaggtcaggagtttgagaccagcctggccaacatggtgaagtcctgtctctactaaaaatagaaaaaatagctgggtgtggtggtacacacttgtaatcccagctagttgggaggctgagggaggaggatcacttgaacctgggaggcagaggttgcaatgagctgaggtcataccactacactccagcctgcgtgacagagcaagactctgtctcaaaaaaacgaacaaacaaaaaatagtcctataaaaagttgaaacctttgtaaaattctctggttgtcatgtacttgaactttagtgtagacacattcttttctctttaatttttataactttcagccctttgcttcctgaagatcaatttcaaatatggtgtttctcttgaaatagatcattttaaaaatcatttaactttgatccatgcagtttatattctataaatagcaacttcctgcaaatactttctgccttttggaatatcacaaaaactggcaactgtgagaaggattagtgaaaaatcttaccgacatataggctaccaaataatccttcttttaatattaagttagcgccttctaggatcttcagggtatgggagctgggaggagataatggcattttcatacaaatggaaaggttatttagaggtctatgtcttctgaagttccaacctaagtggaattatggagaacttcaactaattacaaaggaaaactaaaagatgatttaaaagtaagacctatgtttgtcagattattgactcaggcttaggcactaagcacggattatgactttttattggggtgaccatctgcatcctccccttccccatccttgcccttttttggttgtagatgttaggcagcacctttgttggctccacatctgttttgctcctaagcgtgctatgttctattaaccatctccacctttccccgtgactccctcttcaatctgtctgctcattatatgaggcctcttaacttctgtgctcaaacaactctgcttggcctctgttacctgggtgtaggagagctggctagcaaatcattacatggatttaacaaacccaggtctacaattacctaatctagtcaaccctggcttgcagaagacaccatcacagaacttagtgacaccagtgcctttctcaccagcctgatacccttggtgagcagtgcatctgagccctcccatggaacagaatcctccagtgagtcttctgactcattagatgcccattctgccctcccacttccgtcagcttggtttgccacttcactcagggtttggtgtcgcttgttccaggtctccacttcactcagggtttggtgtcacttgttccaggtctcaccctcgcagcaagggtgccccatctcctagggtccttgccagagtgttaagtctgtgtcctgagaaagtgcctgaagtcgatgaattcttgcttatccagttttatattccagacctcttggtcaagcactctcatccaatctcaggggtactcccctagctcctagttcaggagccaattcctatctaattccttttgcgattttagtgtatagtctttttctttccttattaggcccagcacttcctcagccagattatgctgggatttaacacttcattattgcctggagcagcccattggatggatggccttggctcaaatatgatggctaggatcatcattcaattacatttcctgcaactgtagatttaagaggtgcatttcattgggaggctgaggtgagaggattgcttgagctcaggaatgaggcacaatggtggcccactgctctgcagcctgggtaacagagccagatctcaactcttttttttgagatggagtctgactctgtcgcccgggctggagtgcagtggcacaatctcggctcactgcaacctctgcctcctggcttcaggtgattctcctgcctcagcctcccgagtagctgggggttacaggcacgcaccaccacacccggctaatttttatatttttagtagagacggggtttcaccatgtcggccaggctggtctcgaactcctgacctcaggtgatccgccctcctcggcctcccaaagtgctgggattacaggcgtgaccaaccacgcccggcccagatctcaacttttttttaaaaaaagagaaagaaaattgaattttcatggctgccatagttgtcgtctggaagagctgtaatgcgaatcaggtgttaagtgtccagtagaatatgaccaaaaggagttggctgctctatatattttatttctaaactcactagggcctacccctggctttcaggattagatcaaagcataaaactacttaggaatgaaatgaaggtcctcatcagatccaaggagtggggcaagagtgagcagaaacttgaccagcacatagtaaagataggtcagtgataagaactgggccaggcttatcctggaattctgttcttggatcaaaagaggataccatggcagggagaccatggtaatgatagttcttaacaaaactgtccctttacatatgatggttgacctcgacatctgtgcacagccatcattctgggatctttgtgatatttctgggagtcactgttttccttctgggttggacttctttctatcccaagttttcctctttctagttcctctagcattttaacatattatttgataacttcttgggaaagagtgccttgggggtaaaatttttgagatttgtatgtttgaaagtgattatgctaatctttggctggaaatagaattctacattcaatggatttttcttcattaaatggatttggatttttcaggtcttcagtaagagttctgaaggcactgctcatcttcatgttcctggtaatgctattgagatagtgcaaatccattctggttcccaatcctttgtatataaacattaattttttttttcctgaaactctggacagttttttttccccagagtttgaaatttcacaaagatttacgttggtgtaaacacatatctaatgtgttaggtacctggtgggccttttcaaactagtgacttgtattttttggttccaggaagttttcttgcaattattttgttttcttttttctgttttttggaactcctattattcatttttgtgtttctggactggactagtctttaacattcttcttttttttttttttttttttttttgtatttttagtagagacagggtttttaccatgtttgccaggctggtcttgaacacctgacctcaaatgatctacctgccttggcctcccaaattacaggcgcatgccatcacgcccggctaatttttgtattttcagtagagatggcatttcaccatgttggccaggctggtcttgaacgcctgacctcaagtgatctgcccgcctcggcctcccaaagtgctcggattataggtatgagccaccgcgcccagcctaatattcttatttttcacttattttccatctctgtctctgtgttctctctggtagatttcttgaactttgtcttccaatatttttattgagtttctcatttctgttgtgttttaaatttccagtagcttgtttttgttctttgaatgttcttttttaaatagcatcctgttcttgtttcagatctctgaagataatagtgttactttatttgaagttttcttctctttgcataatctgttttctccaagttgatacctgtgtctgttctggtctttgtttttgttagtagctttcctcagtgtctgataaaccttggctgtcagttcctaacaaacacatgcatggaacttgtcaactttaaacttcatcactgggtaatctgggaatcacccgcatcggagtgttggggatttttctgtcgtgcaggcttgattctttggaatagagtgttcagtcttctgcttgggaggcaaaagcgtctagctgccagttcggacaccttctgtttacactctttagaaggtaaatctcgaaactcctgcagggatggagggcaggcagtcacttagtggggaaaactgagagggaatttacagcttttcaaacatattttaccctagttcccctaattttagttcctggtccctcatcctcatttccagaagcaaccaatgctttttgaggattctttactcactactgtcttgggttcagttttctagatctactagattattgccactcatccatctacttctcagcttccaaaattttattcccattatattttttcctattcttcctaagtaggtgtatgattattttaacaaatgtttctttactgcaattttaataaggtttgagagagagtaaagttagatgcagatatacagtttgcctccttaacacagaagtttcattgatatttgattagtcagaaaatagcaacagtactcctgagaaaagtattaataatgtaaatctagatgagacattgtaatagtctttagaaagagagcattagtaaatgttgggactaaagcactgataattatagcatataagatgtaatacattggagtgaattaagtatgcatgtgtaaatattaagtgtaactacaaaagagtataaagtgaatgcataacttccaaactgatatagaggataaaagaattagagggcattctgtcagtccaaaaagacagaaaagaagcatagaataatcagagtatctagaaaacataagataatggtacttataatcataataggccaggcatggtggctcacacctgtaatcccagcactttgggaggccgaggtgggcggatcataaggtcaggagactgagaccatcctggctaacatggtgaaaccccatctctactaaaagtagaaaaaattagccgggcttggtggcgggcacctgtagtcccagctactcgggaggctgaggcaggagaatggcgtgaacccgggaggcggagcttgcagtgagccgagattgcgccagtgcactccagcctgggtgacagagtgagactccatctcaaaaagaaaaaaaaatcataataaatgcaactggattaaactcaccagtgacaagaaattgaaattggacttctggaaaaatccgatattataatacatcaacacatttctgccatctctaccttcacattataaatttaactttctcatcatttccacatccatcaccttagtccaagccttgtcatttctccatgaatgactgcaatggcatttatttacttatttacttatttttcagacagagtctcactttgtcgcccaggttggagtgcagtggcatgatctcggctcactgcaacctccacctcccaggttcaagtgattctcttgcctcagccacctgagtagctgggattacaggtgccggccaacatgaccacgcctggcccaatacatgcatttttaaatatttgagatggtattcagtccctactcatttcgctaagtgaggaaacccataaacaaatgttacagttttttttatatctgtggtcagtggtttaatgttacatttatagtgttgagacaactatgatgtcaaagtgtgataaatactccccagtaaccagttaaaataatgtaatgacactagtgaatcatttcctacacttttcatcttggatggaaagtatcatactactccaggcataccacaagccccggaggtcccaaatctccatctttcattattcttaattggttaagtatccttggattttttttctttgaaacttcggaattggcttttgagttagtagaacaagatccacgtaatctacaccctggtgaagtgggaatttctatcagcctgtgcctggactctatcattgagcttctggaagagccctgggactttacatcgtttggaatttgactgtatcaagtttctcagagaatgagaaagggtgggagtaattatgttcttattttgaagtagttggtgatatgaaatgttttatctgttattgttcctacacatcctgcctttgggagatgggggagaatggaattgatctgctctaatttttatttatgttagatgctggaatttaattatagagctgatggtactttgcagattagttagtaatggctaccatccagccattacttcgagtagcatcaggtaaatttggggcaatgaggagaatatattgtaaaaagcatatactgagagtattgcttatttgtaattggtaggaaaacatttaacgatgccaaagccatgatcagcagcgggaaaacgtgacccagggaaatcttcaaaagtggttttttctttattagataaataaaacgtgtttttatatagaacagaaacaatcacggcaatagactaataaatacggttttattccagatttcttattgtataggtaatatccagattacaaaaaattttaaataaataggaacttcctttccaacaatgccatcaccttaatataatcattgttaatattttggtacacttccttacatattatttttctgtgtaggtttttaactggactgtaattttttttgttgctatcgtattcttttttttagagactgggtctcactctgttacccaggctggagtactatggcaagatcatagctcactgcagcctggaactcctggactaaagtggtcctctcatctcagccttccaaatagctggtactacaggtatatgccaccactcccagctaattttttttttttttttagagacggggccttgaaatgttgactaggctggtcttgaactcctggcctcaagtgatcctcccacctcagcctcccaaagtgcagggattacaggtgtgagcatgtgagccaccatacctggcagaactataatcttatagtataattcagtaggtaaaattctgaatcttgcttttttccacctaattatatcacaaattatatctccatgttattacaaagctttcattataaaaatgcatgctgattaaattgcacaagaaaaaaaaggaagggaatgatctctcttctgtgcatcactcagacacaaccagaatattttacctttttcactcactattacatcaaaatgatttttcccttctgttatctagtttttagaaaccaacgctttaagaaagaaatcctgttctactataacatggatgaaacttaaggatattatgctaagcaaaacaagctacagttgacccttaaacaacatgggggttcaaggcaccgacccccgtgcagttgaaaatccaagtataattttgcctcccccaaaacttaaactaatagtctaccattgactggaagccatatcaataacatacacaatcaattaacaaagattttgtatgttatatgtattatttactgaattcttacaataaagtaagccagagtaaagaaaatactattaagaaaatcataaggaagcaaaaatatagttactatccaacaagtggaagtgggtcatcataaaggtctcgtcctcattgtcttcacactgagtaggctggggaggacgaggagaggaggggtttggtcttgctgttccagggtaacagaggcagaagaaaatccatggagaagtggacccatggatttcaaacccatgtttgagggtcacctgtagttataagtattaatgcacaaatactgcatgtgaggtatccaaaatagcccaactcctagaaacagaaaatagagcagtagtggccggggaatggcggaggggaaaggggagctgctgttcaatgagtacagaatttcagttttgcaagatgaagacgttctagagagctgttacacaacaatgtacatgtagttaacactgctgtactgtacacttaaaaatggtgaagatgggctgggcatgggggtgcaccccaatagtttcagctactcgggaggctgaggcttgaggattgcttgaagccaggagttcgggaccagcctgggcaacattgtgagaccctgtctctacaaaaaaatttttaaaaattagccaggcttggtggtgtgtgcctatagtcccagctacttgggaagctgagacaggagggtcacttttgcccaggagttcaaggctgtagtgagctatcgtggcaccaccacactccagcctgggcaacagagtaagaccctgtctctaaataaaaaataaaccaataaagtatacagaaggatgtgcataggttatatgcaaataatgtgccattttatatgaggaagttgagtatttgcagattttggtatccatgaggagtccgggaaccaatccaccatggatacagagggacacctatactaatatcattaatattttccatgccaatattctactataataggagtgcaatcgcttcctaatatttaattatatggcaatgaccatattaataaatagaaacataatattccattaaatgaatattccatattacatatccattcatctattggtaaaggttgctaacaatttttaatatcatggatcctgcatgataaacattatttgaataaagtataggcccttttcagatgccagagggccttgtgaagcaagccaaggcagtgatgggttactgaagggttttaaatgagaataacatgatgagatttgcattttattttattttaattcgtatttgtttttattgaaggaggttgtactttagacaaaccagtctgatggtagtaagcagttagattggaataatttatagtcatcctttccctgggtcatatctgacagcttggagccctttgtacattttgggtaattttttcctaaatggttttatttatctcttttattcagtaaaacttaattgccatgtttctatgatgctgtggtcagaatgtatgtgccccttcaaaattcatatgttggagcttaaaccccaatgagatagtattaagaggtggagtcttcagggggcaattaagtcgagagagtagatccctcacgaacgggattagcaatgttataaaagggctggagagaattagctagtttttgcccttgcatccctctgccatgttaggacacagtgctcatcccctctgggggccacagcattcaaggccccatcttggaagcagagaccaggccttcaccagacaccaaggctgctggtaccctgatctgggacttcccaacctccataactgcaagctgttaggtatgctgtttatacattacccagtctaaggtacttcgtcatagcagcacaattggactaagaccgaaattgatcttcgtgggactatttctataacaaatacctgacaatgtggaagtggctttggaactgggggtcaaggctggaagactttgaggtgtatgctagaaaagcctggattgctgtgaacagagcactaatggtgattctgatgagggctcagagaagagatctgtagagagagcctcaatcttcttagagattatctaagtagacaagaacagaatgttggtagaaatatggatggcaaaggcaattctgttgaggtcacagacataaatgagggatgaggtattggaatccggaagaaaggacgtcgttgctataacatggcaaggaacttgtctgaattgtgtccgtgtccatgctttatggaaggcagaacttagaaataatgaaccttggatattgaaattggcaaagagtttctaaaagtggtaagttcctggcattgacacttttgcacattgctaatagcagtagaaaatggtggtattcatactcccttcctggacggcattttagcaatacttatcaataagctaaaaaaaatatacaagctcattgatcagtttctggaggagatactgtatggagaacaaacagaaagattttacttcaaagatgttagtcacacggttgtttgtaacaacaactggaaacaacctgagtgtccattaacacaaaaatggttcaacaaatcttggtctgtctgtggaatggaatgctgtgcagtcattacaagtatgtcgtgaaagactgatgccaccacacacctatgagagtggataaaatccaaagcaccgacaacaacaaatgctgacaagaaagtggagcagcaggaactctccttcaccattggtgaggacagtgcagcactctcttagaaaacgaaacatcctcttaccacataacccagcactcttctccttttatttatgcaaaggaattgaaaatttatggccacacagaaacctgcacacagatgcttatagcagcttcattcataattggcaaaacttggaagcaaccaagatgtcctttagtgggtgaatggataaataaatgtggtacatccagacaatggaatattattcagcactaaaatgagttatcaagccatgaaaattcattgaagaaaccttttttcttttttcttttttttgagacagggtctcactctgtcacccaggctggagtgccagttctcccacctcagcttcccaagcagctggggttacaggcacatgccatgcccagctaatttttaaaaatttttgtagagatgaggtttcgccatgttgcccaagctgagctcaaactcctggcctcaagtgatccacccaccttgccctcccaaagtgtgggattacaggcatgagccaccacgcctggcctcagaggagtttgagggcagtgaaactactctgtgtgatactatcatggtgaagacttgttgttatgcatttgtccacacccattgaatgtacaacaccaaaagcgatatagtttgaatatttgtccccgcccaaatctcatgttaaaatgtaatcctcggtgtcagagatgggacctggtgggaggcgtttgaatcatgggggaagatccctcaggcatggctcgggccgtcccttggtgataaatgacttcacacaagctctgagttcacacaagctctggtcatttaaaactgcgtggctcctccctccgcactctctcttgctcctgttctggccatgtgatgtgcctgttgcctcttcaccttccaccatgattggaagctccctgaggcctcccaagaaaccaagcagatgtcagcaccatgcttcctgtacagcctgcagaactgtgagccaattcaacctcttttctttataaattacccagtctcaagtgtttatagcaatacaagaacagcctaatacaaagaattaaacctaatgaaaactatgaactttgggtaataaagaggtatcaatgtagctctattaattttttttgtttgtttgtttttgagacagagtctcactctgttgcccaggctggagtgcagtggcatgatcttggttcactgtaacctctgcctcccaggttcaagtgtttcttctgcctcagcctcccgagtagctgggactacaggcatgcaccaccacacccagctaatttttgtagttttagtagaggtgtggtttcaccatgttggccaggctggtctcaaactcctggcctcaggtgatctggccacctcggcctcccaaagtgctgggattacaggcatgagctactgcgcccggccagcttcattaatttttaacacatataccactctcgtggggatgctgattgtaggggaggctgaggatggggagagcaatccaggggacggggcgtggcatatgggaactgtctggacattccacttaattttgctgtgacataaaactactcttaacaaactcaaatttattaattaaaaaaagactaatggcttgataagatgttcacagtgttaagtaaataaaaaaagacgctagaattctatttcttgctaaaatatatatatacatgtatatataatacatacacaaatataatatgtggatatagcattgtattaatgaatataaaactaaaacaaagctctccagcactgtatatacagaagtgatctgtagatgacaggatcgaatccctgcgtgatttgtattctttgtgctcgtctctatttttcactgttccacaaagaacatgtattatctctgtaacaagaaaaagaagaaaagaaaactgcattatatcattcaaaaagttgtctagtggtcacaaagacactattgaagatgcatgttgaaagtttgaataaagttggtttttaaaatgcaaaaataaagagcaatatttttaaattaacgtcgttacatacatgatctgaaacatagctgtggacgtagtaaagtttatatatttaacttgaccaaaactcctttaggggattttcttattagggaaaggagggtcactttttgttcatcagtatattcagatatttattgtgttaaccactgctcctttgcttaatcacaaccaagaataaagcttttcctccaatcatattgcaacacaactttaaatcattgtttttggtctgagtggggttgaagagtatcttagtgagatgattgctgcaacacttgctgcaatcaccatctctatcaaatacaataaaactacttggcgtgggagcggcactcacccttaagtagagaaactggaactggagaggatgaaacaattagtgtagctggtgctcctgaagccccaccctcagaggattaaaacagggaaattaatggtctgacaggcactgctgcagcctttcccccatctcttcaaattggagaaactctcggttggaagtgatcttactaagtaccggatttagccacctgttgattcttagactctctggtgattcatctgtttttaacacttgcacttaaataggaaaggaatttataacccagaagactcgtgcagcctcgtggttgcacagcagcctctggaatctttagaataaataatttttctaaagtaagtggctttaaaatttttgtttttaaagacaacatttttggtagatgccaattaattattgtgattttgttctattcaaggtagagaaatattttctaaattgtgtttatgttttggttttgaaacatagtttatgtcaaaatttgtatctatactatttagagcctaatgtgaactatctcatggtttttatattttttactacaaacagtttttaaacattcacatgtgtatctgatttggtgacctggaactagctgaaatgcagatgctttataaaccatcttaactactgacattatcttgttttttgtgaagcatgaaatggttcagtttattgactgattgttatgtcactggggagaaaggaattttcacggtgtgttttattgtgcctatttagtgggttcagcattaaaataaataatgcttttatgagaaaagagatggcctgatgatttctcgatgcaagtggaagttaagaactccaggctgtgatcccgtcaaaacacctgccggaccctgacgccctcagataggcacttaacctctctgtgcctgtatttcctcaaatccaaaatggattaagaaaattgatttagaccaaagtagagtgagaagcacagtatttgccacatgctttgaggctgagataaatgttgatattattaaaaagtcccacagtatttattgagatggctccatattggggaagaggaggagagagactgtggagtgccggaaggcactgtgttagcctccagaatttgggcccctttgtgtggcaatgaaggcagtatattttcttcaggtcacctactccaccttaattctttgcaggaggagaagccaggcgtatcagggccttggttttccaggtgagcatctgctggcacactgttaagatgaattccctgcgaatggtacttttagcaggctacactcgagggatcttctggcaaagacgtttttcctgtacattcacaaacgctgcccggcttacttttaaattattactccacgttagcccttcccatagaagaaacaaactagacttaacttactttgcctcattcatgtttgcagtaacaagatgtatttgttttgtgagttgcttctgtcttttgaagggagggatgtggagtttggtggatatttgttactctcgcctttttttcagtccaaagaggccatgtggggaaacagcagaggtggaggcatcaccgctaacccacatagcctgccctctagacatggggcgaggcaacaagcggggagggagaaggtgttgaatgcgcctagcaattccgtgcgctatcttatttaattgccacattccacgtggcattttacggataggcggcagaggcaaacttctgtataaacaggtgggtctacactgtgggtcggggaggatgtgcctgaaatttcagcaccagcgattgagtcttttaggaaaaagtgccattgcatgtcatagaaccagaagtgtgtacactgctggtacaaatcatcatcatcatcgtcatgattgactctcagagttcacaaagcaccttcatatctcatggaaccttcacaaccatcctttaggttactggtccccctgttagacatgagcatgctgaagctagaggatgaattttaataacattcttaactattattggtctaacatggggaatatattgtgatttttctctgtaagaaaggtaatgtcttttttatttacttttcatacctagtactgtagaacatctgttttttaaaaaagactctgaccaatacagaaagaagtcaagtggattttcccaacacgactttgctttaagtgaagaaatgcaatgactttgtagtcttttcaaacatgtctgatataatatatggaatctttcttgaattcatttcagtataattgagttttctcctggagaaaataggtcccaattgcaccattttttctgcatttctgcatcaactctgtgaaatacatttttttttttggtttgtttgtgtttttttggagacagaatcttgctctggagtgtagtggtgcgatcttggttcactgcaccctccatctcctgggttcaagagatcctcctgcctcagcctcccgagtagctgggactacaggtgcacaccaccatgtccagctaatttttgtatttttagtagagatggggtttcgccgtgttggccaggatggtctcgatctcctgacctcgtgatccgcccaccttagcctcccaaagtgctgggattacaggcgtgaaatacagttctgaattctgaatatctgctctgcttgatgatagtgattcaaacttgatcagacttctgcttgatgatagtgattcaaagtctttggctaaaaatatgtcatatacacttagaatatatgttagttataatgtttgctagagccgctttgatagtgcaccacacagagtggcttaaacaatagaaatttattgtctcacagttctaaaggctgaaagtttaagatcaaggtatcagcatgattaaacatctaccctattcttcttgttcttttttatgacattggaatataccatatttgaaaaatgcattttagaaaaactaatggaatccaaataaagtttggaatttagtgactaataatatattaatattgattcattagttatgacaagtgtaccataataatgtaagagttaacaatagaggaattgtatcacaaatgaaattacaaattatgttacaaagcaaaagtaatcaaaacagtgtggtactggcacaaaaacagtcatatagactattggaacagaatagaaagcctataaatgaagccatgcataaatggccagctaatcctcagcaagagtgccaagaatacacgatagggaaaggatagtgtcttcaatgaatgatgatgggaaaactgttatttacatggagaagaatgaaattggatccgtatctcacaccatacacagaaatcaactcaagctggattaaagatttaaatgtgagacttggagccataaaactagaagaaaacatagggaaaatgctctttgacattggtctgggcaatgattttttggatatgatactaagagcacaggcaacaaaagcaaaaataaacaagtggcactacatcaaactaaaaagtttctgcatgcaaaagaaacaaggagcaacctatggaatgggagaaaatgttgcaaaccatacatttgacaagggattaatattccaatacatataaggaactcagacaactcaattgcaaaaacaaaaacgacctaattaaaaaaaacggaaaaaaggacctgacattttttcaaaggtgatgtacaaatgtccaacaggtatatgaacatcattgttcatcaaggaaatgcaaaccaaaaccacaatgggatgtcacctcacccctattgtaatggctactatcaaaaagacaaaagtgttggtgagggtgtggagaaaaaggaacctgttggtgggagtgtaaattggcacagccactacggaaaacagtacgggggtttctcaagaaactaaaaatagaattaccatatcatccaacaatcccacttatgggtataagtcccaaaagaaataaaatcagaatctctaagagctatctgtattgccatgtttattgcagcattattcacagtagctaagatatggaaacaacgtgtctataaacaaatgagtggatagtatatgtacacacacacacacgtatgtaatggaatattattcagccttaaaaaaggaggtcctgctatttgcaacaacatggatgaacttggaggacattatgctaagtgaaataagccagacacacagaaagacaaatactgcatgatctctgttacattttcaaaagtcaaactcatggaaacagagagtagatgggtagttaaccgggggtgggggtagaggaaatgggaaaatgttggtcaaagagtacaaacttttagtgataagaaaaacaatttctgatgtacagtgtggtaactatggttaataattattctatacttgaaatttactaagagagtagttctcaagtattctcaccacacatacaaaaaaggtaactagtgagtcggtggataagttaattagcctgtgtggtaatcattccacaaggtatatgtatatcaaaacatcgtgtggcacaccttaaatatatgcaatttttatttgtccatcatacctcagtaagactggaaaaaaatagaggaaactgagtgagagaggtatatgggaactctgtattatatttggaacttttctgtatatctaaaactattctaaaatccaaaggttattcaaatataaaatccttttataatataaaatagtgtctatattaaacattccatgaattctgtacttagaattattgtataattttattgtttttaatgccattgcttatacatgtttttgtactcaagaacaaattggatacggcctctagaggacagtgttgggtcatagaaagattttacaatttctgcccaagttgaagatggtcataatcatttttcttcttcttttctaaccacaagtcctgtttattcgttgtccctctgtaaaaacaacaataacaaagaacacttatgacccctctgctgttctgactagttggctgttttgttttaacttattttcgtataattttggttccacaaacatctattaggcaagaaagatctgcggagttggcaccataatgttcacatccctgagggtttgtgaaagttgtgagggaacccggggaagcgatatgaggcgtatattatgtgtcatttgtgagttcttccacgatggagacggaattatagagttgaacttcctttggaaaaacaaaccacggttcgtagcttgatcagggtgcatgtaagctaaagaggggttttggtcttttaaaggttgagactgcctgctctacagtggtttgttggtggtgggaggaaaggaaaaaaaccattgctcttgcttctggagcaaatttctggagtaatcagaatagcaactcaacattttaattttaaaattcctcctccggagataacctcgtaggattgccattgtatttgcccggggctcctgaggtggggagttgcagagtgctgctcaagtgcgtcagagccatatgaacattcacctgcaaaatgctcgccttggacttagaggcagctgaagacaattgttcatgaatggatgggctcagaaattctgaaacacacaattctgtcattgaatgcgctgaattttctgccgagagtggagtctgagggttctaccttgctaggtgtgaatctagtataaacattaaaaaataggagtcatttggatgatggtgtgttccacttagcagcaacctatagtttttcgtttgtttgtttttgctcgaagaataaatctgtccaaagctcatctgctgaattgggatctttgagccttttaataggagtcttgagagggagtggaaaatgtacagctccttatagatagcccgacatgaaagttaaggtcaatggtgttttgttcagccactccatccaagtcgaacccacgggcagggatctgttttgttctcatttactagtgctaagtgccaaacattctctttctcaggtatagtcttctaatttagtggtggtgtgacaaagttctatttaccatataggtacttaatacgtattatgatgatttaagatgtagttggtccttgagatcgtgattggtcccctcagctggtccctcactcaggattccttatctcagggaaaagcatcaccttatcccagtggtataagtcagaatcttgggagtcatccttgaatcctctgttttttccatccttactcataatgaatgcaggaccaggtcctaccaatttcacttcttaaatattttttgaagccatccatttctctctccatggccgccactccaatctaagcccttgtcatatctgcttagactactgaagaagctgcctcaccctcaagcagtgtgctcttccaaaacatgcatctatgagaccgtcactgatttcccattgttctcaggctagcaaccttatcactgtcatggacaagaaggccctgccgtcgggcccctgtctctctttctagcctcatcttgaagccttctccctgctccttgtactccagcctcctagccgccaatgtgtcagcagagagtcttcgcgtattcagtttcctctaggtgactgtctctcccctgctgtctctgtctcattaccttctactcatactctctaaatcagctggagtgttatttcctcatggatgacttccctggtctcctggtctaagaagtgttctttatttttttatttttattttattttattattttatttattttttatttttttatttatctatatatatatattttttgagacggagtctcgctctgtcacgcaggctggaatgcagtggcctgatctcggctcactgcaagctctgcctcctgggttcacgtgattctcctgcctcagcctcctgagtagctgggactacaggcgcccaccaccatgcctggctaattttttgtagttttagtagagacagggtttcaccgtgttagccaggatggtctccatctgctgacctcgtgatccacccacctcggcctcccaaagttctgggattacaggcgtgagccatcgcacccggcaatttttttattttttatttttttattgagatggagtctcgctctgttgcccatactggagtacagtggtgcgatctcggctcactgcaacctccatctcccgggttcaagtggttctcctgcttcagcctcccgtgtagcttggattacaggtgtgcgccactacgcccatataatttttgtatttttagtagagacggggtttcaccatgttggccaagctgatcttgaactcctgacctcaagtaatctgcctgccttggcctcctcaagtgctgggattacaggcgtgagccaccacgcccggccgagtgttctttattggctgttcttacagacccatgctccttcccctcactgtacttacatcagttcacagtgtctttggttgctgtttcttgattaatgtctgtctccctgatcagagtatcagctgtgctccagttgaatgatgaaggtaaatcttaaaaagataaagtaaaggaccatctctgtgagcaggggtcacgcccaagtgtgctcaccatccagagtctctagcacttggcacagtgcttggaacaactagttgctgaatacatttgttgaatgactaaatggctatttacttattgaatgtttaggtagaggaagaagaacccactggatacattcgattcgaaaaatttcttccggtgatgacagaaatactactagaaagaaagtaagtaagtaaatgcaattgttaaggcaaagtaatggtcagaattatgaatccattcatttcaggacgcttggctttttcactttgtgtgttatactcaagcagtgtgtcctaaggtggcctccctctaacctttcaagctacttctgaactggcagttggtacctgcttagaaatatcaaccacactagtgttatcctaagcaaagcataattagagggtaaataagctataaagatcgtaaatcaacattcttagtatcttctgttttgaattatcaatgataaataagaatcctaatatttttctagcaaaaatatagcattagcttaccatagttggttcatcatagaagtcttgtgcccagataaattgatgtccaaaaagctaatagataacctcaaacatgtcagtgattttgcactaaatatttcctgtggggctgaggtattttcaactttcatatccagaaatccaaaaagatttcaatgaggcaagtattatcatcccagtatgttagcagcttttattttattttattttattttattttatttttgagatggactttcgcttttgtcacccaggctggaatgcagtggcaccatcttggctcactgcaacctccacctcctgggttcaagcaattctcctgcctcagcctcccgagtagctgggattacaggcacgtgcatgccaccatgcctggctaatttttgtatttttagtagagacagagtttcactatgttggccaggctggtctcgaactcctgacctcagatgatctgcccacctcagcctcccaaagtgctgggattacaggcatgagccaccatacccagccctattttgttttatgtggtcatttattacggggatccccaaccaccaggccaggtactggtgccagtccctggcctgttaggacccctgggccacacagcaggaggtgagcagcaagagagtgagcattactgcccgaactccgcctcctgtctgagaagcattggcattagattatcataggaatgcgaaccctattgtgaactgtgcgtgttagggatctaagttgcatgctccttatgagaatctaatgcctgatgatctgaggtggagcagtttcatccccaaaccatccctcccctcccctggtctgtggaagaattgtcttccatgaaactggtccctggtgccaaaagggttggagactgctgatttattatgtaaagactgcggtaaataccacggcatttactcattttattgcataattatagatacagaccaattccagaagatgtccttcttcgagcttttgaggtatgtaaactccagcttatatgcatatacatatatataaatacatttatttacatacacacatatatgaaaaatttatcatgtagaacttattcaccaaatgaaaaatataatatctatcttttcttttcccctaggttttagattcagctaaacgtgggtttcttactaaggacgagctgatcaagtatatgactgaagaaggtaagtgtgatttattacttatcacaatgacttatgtgaggaattaataatttgttaacagttatgcgaaagttataggggatactttaaaatcagtcattctggtgaaagttatttactgttcctgctattttggcttggggatggtttctgttctgtgggggttaagaggacaaagagtagggaaaggggagatgggttgttgtctcgtagaattttgtgaagcacagtgattacttctataatttcaggcattgcattcagagcatttccagaataaaagatatgccatctggaaaacatgaactatcgatcactgtaaatgaaggcctcttcctagattgaagatttgaataaagaatataaaaattccgccccccccccggcgccccggcttttttttttttgagacggatccggtcttgctctgtcacccaggctggagtgcagtggcgcgatcttagctcactgcaacctccgcctcctgggttcaagtgattctcctgcctcagcctcccgagtagctgggattacaggcacaggccactgcgcccagctaattttttgtatttttagtagagatgggtttcaccatgttggccaggctggtctcgaacttctgacctcaggtgatccacccatcttggcttcccacagtgctggtaaaaattcccttttaaagagcttttctgtcagtgaagttacagataatgtagcctcaattgaatactgaggtcatttttaacactaaaaatgtccttttttaatgttaattgaaccatatatatttgttttgaacatggcccatcatacatatatgcatacacacacataaaacctgcacacttatatatatatgccaacatatttcctttaggaattctctctgctaggctgatgtgtaaatttgtttacactgaaggtcagtagcctgatggacagtctcctgaaaccatcctcatattggtccccttgccttctcccatacaaagctagagctctctggttcacagactgggtcctgaatgactcagagttgctaatcacttgaggcagaatgaaaagcgcaagtgattttgagtagggaagactaagactgcatctacacgcacaactggtttgaccattccagcttcatccaccttaaggcggaatacagagagtgagggtcagaatggcaaggccgtcacagctgccacccaagaactctgacgccattgttaaaattaccttcgggattaattctgatggggatgttacgactttcaaagcatcagcttcttcatcctgaggattagtctaaagaaagtaaatcctaggttatatatcaggcaacatgaatttagtcaaaatggcccaaacagttagattttcctactgttgtgtgcctactatatgtttaatatttagtaagtgtagtaaggtataatgatacttaaatctacttcctctctcaaggatattacaatcttatttgggaaataaaactaacataaaataattcacaatacaagacaatagaaagctaaatatcagaagatcaactagggctggcccagcctggaaaacttggtttgggaagacttaaagagaaaataggttttttgagatggtagaatgtatatggttaaattgttgagggcaaaggtaaactcttgtgcattataattctgtcacacatggtagatatcaacaaatgtttgttgaatgaatgagtgaatgagtagatgatgaagaccaggtgaaggggctaatgagagggagacattatcgatgtgtaaaacagtctgaacaaaaatggggaggtaggaatgaacatgctatttcagagagaaaataagcctagctggcccagagggtaatgttggcaaacagcaggaaattaacttcagtagacttactgggactaaattgtggagtcccaggctcaggagtttggaattcatcctgtgggcgatggagaagtattacaggcttttgagcagatgactcacatggtgtgtgagtgattgtgagaaggtttttctggtgctggtcggtttgttagatgcataagaaagaggttggactagggaggccacttagaaggttatttcagcattttgagggcacccaaataagggcctgacctggcagtgggaatggcaatgggaagaagggattggtacaataggactgtctgtggcaggatccatgggtcatgatgagtaacagagtgtaggcgacaaagctgagagctgaatccaaagtaccaccaaggctttgccctcgatggcgagtatgatggtaatgagactgactcaaacagaaaggtcagaacagaccgcagtgtatacagagacagtgcgaccacgtggtttacttggaggtgctgtgtgataatttcgaaaatggtatgtttacagagagttcatggtacttaaagatcaactattgagtatctcagcggactaagcataggacaggtatggtcaaataagaatacatatgttttcaattattcactcagcaagtattattacaaaccttccacatatatgaaccaatatgtttggaagtaatatgtaagatgtaaatctatacaaatctaagttacgatttaatataacagacccatcagctaagtgtaatagcagttgactagtttggtaaaataggagcttaagaattgctgctttgagagtctcagaattctacaaattgtttttaagtacatttatgctatataacaatatggattcaagctacttgcacattcatcctaatatccacaaagtatcaaacacactagtttgagaatatgcattcctacagccctggatgtcatatgataaaataaatcacactgaatcaagttcctacaagatagaagtccctaagtgtccaggaatgtgtattgcatcagacagtgtttagcagccgggaagatctcagaacaattttttaaacaaacacttgcatgttgctgcttctatgccaggtactgttctaagtcccattcaaatcataacacgtttcattctcatgacaaccctatgtgacaggtggtgtcgttatcacccccattctagagacaggtaagctaaggtggggagctgtgaagtgacttgctcaagatctcagagctcgtgagaggcagccagcatgtggatccaaacttgtgctttaaccactcagttatcttccttccatctttcatcaaatactggggcttcaagttaatcctctggtaatttcaaaagttttaatctaaataaataaccttgttcatgatgtctgtatgtcttcctactgttttgcctgaaatgacgtgttctagaggttgcttgatctatgacatctgcaggctaaaagaagtccagaatctaccagggtgtacaatagccttgtctttgaacctctggactgtcgtgatgtcctggctctacagctccagggagcgtaactagtggcactgtgggagcttgtggggctccatggctattaagctggctagtggaaagagaaaaaaatcagatgatcctaaatgataaattttcctttttgtctctctgaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataaattactatttatttaaaaactattcttaaaacattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaatttatttttttatgagtgccaattacaaatatcatttgggataataataacttagtgtaaacatttatatttgctgatccagcatgtcaccatttatggagtagctaaaggagttgagatcattggaactagagaaaagaaggttgagtggaagttgatagtgtaaggtagtggcaattctccctttgtctttagaattctcacccactccgcatatctgtcatgggagcattgtcctgaatactgagtaagaatactgagaaatgttatggtgtgcaaatgtacagctcctgaaagagcagaatgaagcacaagcagtcacaatggaaaaatatatggcatggccactgcctcctccttgcaattctctccgatcttggcatcttatatggcaactatatggcaacttacaagcaaaggggaagataaagtaaagggaagtgaacaattttccaaacttagatattctgttataacaagacacacacacacacacacacacacacacacacacgggtctctatttgaagatggcttcaccactatatgtgtgtatctacatagatgtaaacatttagagttgctgtgagccttcctcaggcatgtagtcttgcccccaaaagaggcggctgctacccaagagactgtcgctgttcattcattcatgaaacactgaaggagtaccatgagatgatgtgctgggaaccggagtccctaacgaatccaggtcacagtttagtgagggaagcctgcaaggcagtcagcagccacatttcagataggggcatgttcagggtcccgtgcaagtgccgaagagaggcagctactcagccttgcagggagagagctttctggaagatgaaaggtgctagtgagcggagaaggcttcccaggacaggaagctcctgactttaaaacgagtagtttagtaagtgggtggcggggcacagggcatttcagcaggtgagcagcaagtccagaaaccctagaggtgtcatgaaacatggaaccacctgggaattgaaagcagctcagtatatttggaatgtgggagatttgggggtcatgatgagaggtgaaattggagtggtaaacaggagcggtatcattaaggatatcgggttaggtgctgagttaaggtttcagtgtgagagtttggactttattctgaagatcacagagaaagatcatttgtaagcagcatggaaaatagatttgaaaggtcaagactagaagtgagaccagtttgtaggctatttggttggtgggaggggatagactgggaaaagtcaagcatgaatcccaggtttctggctcggacgatgggtaaaagtgccattcattcagataagaagtccaaggagcaagtggggcatttggtaagcaaaatgatgaggttgggtgcagacaccttgggacacccaaagggtgacattcaataatcaattggatataggagggagatctggctggagacctggattttggaactgtcagcatgtaagtagtattaatgccttgaaagtagaagagaagacagtctagaacaaaaccatgggggatatcagcatttacgggaaggcagaggaagaagagcccacaaaagagactgggaaggagaagcctgagaagagggaaagctggaaagaagcatcttggatgccaagatcggagagaattgcaaggaggaggcagtggccatgccagatgtagtggagaggagagggaagttaaagacggaaaaaacgtccattggtgttagcaatggagagttcattgagggcctctcccacagcagatgtggggaagcaacagggtatggagttgagtggatggagtaaggaatggatgtgagaaggttgcagcctggaggacaagttattcggcagtgaagaggaggaaacggacaacaggctcggggagtgatttttggaagatgggtggatgtagcaagttcatttctagtccaagggctgagagcccacagagaaggtgaagggaggggccagcttccagagcaataaagagatttaggaacaatgaaccaacgcttgtggtccctacctcatggcctctgctgccttttggagaggaaggtagtaggttatagagtttcaagagaatggtgtaattttggaatatctcttgtgggaaatgggagaaagagttgagaaagagcccatgtaaggattttcaagaaaccctggaagattttgtgctcaggagcaaaaaagaaaagaaaaaggtagattgttgtaccagggttaaggttttgtcatgtgcgtgaggtggaaggaatcaaaggccgaggaatctgggagaaagcagttccgatggtgtccgtggggctaacgcatgagggaaagacccaggtaggaggagtgggtaacaggtaggaggagtgggtgacagatgggagggggtgagagggctcggggccctaaaagggcaagtggctggtgttggtagcaaggggtggtctttcctgcctgagtgataattcctgagtgataatatgtttcccttgaaatttcgcttcgatgtgttcttagagtgtttcttttcttctcctgtgttattatgtgaataaatagtaagagtggctgacgtttgttgactgttccctgcgttgcaggcactgtcctaagtgcttgacgtacatgaactcatttcatcctcacatccacccatcggtgcaggtgctattaagttatccccattttagaaaggtgacaatcaagaagttacacagcagtaagtggctgtatcagctttttctaggttatattgtgataacaaaactcccacgtgtcagaggtttgcaagaatgaagcttatttctgtttacgttttttttttttggtcagctggggtcatcctggactctggcctacgtgtctttgtcctactcatggcctagagaggtaggatgaccgtctgtcctgctttgcccgtggtagttccagactatacctgtcccagtgtaattattaataggtctcctttgtactcttagaaatgttccagtttagatgattaatatgtggtcatcccattcaaaaaatagtgagtaaaaacggtggtgaggaatcgtcacttctggaaggcttcctgacagataattccagcagtggtaagaatggaaggcatttcttccttctctagtttcccaagatcatttttttccccaggataacctgagattttcccaaggtaaaatccaaatagagacctgatgtgccactggctcggccgtgcatgctagaatcaccagccagagatgaggatgaaccgcgtgccttcaggacagggcggagacggaggaggaaaggagtgtggtgatcctcggaacatcagcagacaggctgttgatgataggaacacattgcagcggggaaggaggatggctgagatatgaaatacccttcaaggtggacgcatacccaggggcatgtcattcggtggcaggggccagcacggacatgcagcactgaggcgtgtgctagcgcccagtgcgtcgacccaggcacggacttgtttggagcatacaggacagctctgcgttaagacctgtaagccattaaagaagtacagtctggtgaatgaaccctaatctcttgatgatcaagtgatgacatcatattctgtctccgaggagacaccctcttgcacagaaggcagtagaggaagcttgcgtcgagattgcctacctccccagccccaccttcgagggttctttcaaaagttcggactgatgttcaacttcacatcttgtctcaaggcaatcctctctgtttagtctcatagagttggctttgtggaatgtaattcatttttatctttagcacaaatttgtctgtttcttttaaggccaccagaaagcacaacatagactccccacagaaatctcattttatctcctaagttgcagaataaacgtaccttgtttgcaaagggaacattttcctttacactcaaatcacttcaatgtgtattttgcctcttcagctcactgacctcgcccgcagcatctgatgtaagtcaccatatgccatttcccgactaggagagtgcttggcctcttgtgcaggaagtttgcttaccctcatgactcctggcttccgcagagcctgccataccccacagcttggccgggccctgtggaaagccatctctattctcacactgctggggaaggtgcatgactcaggacccgacacacaggcctgagagtctggcgatcttgtgctctgatcccagcttcatgtgtgactcactctggatcaggcgcttcacttcctgtgcacctctgtctgtaaaatagagagcccagctctagtccttctccctcctgagaagcaatgcagagatttagtcccctttgcagtcacccagtgtctaagtaccaaatgcccaagagacaaaaaagagtccaagatagcaggctagttgggattacgactgttcgttaagggcaggagtattttctgtgggatggaatgtgtttagatctctctctcctagtttcctgtcttccttcctttcgcttttctaaatccttccatgtaagaaagtaccctgtttatacagacagttccttgaagatcagtgtcactaccttaccctcctgggctgcttaaataaacggagagcctcatgggtgccaggcatggtggctgcctcctaggcctgcctatttctgaaagcatggttgccaatcatctgcttcaggagcatctggaaggagggtgttagaaatgggaggtgtgccccattccagacccctgaaacagaatctctggaggtagggtccaggaaacttatatttttaatattctcaggggatccttatgcacgcttgtgtgtaaaaagcactacctggggctctgatattgaatgaaagtgtgggatttggagttaggctctgctgcttactgattacgtaattggcccagacatttaatattgctgagcttccccggaggtcgaggctacagtgagccatgattgtaccactgcactcagcctgggtgacagagagagaccttgtctcaaaaaaataaaaaaatattgctgagcttctgcatcttaatttgtaaagtggaaaaaacacttttcggggctggtgtgaaaattaaatgaaataataaaagtgaaaatgtttaaaaagctgtaagctatgacacaaataattatttacagaaagccagctaggcagagagggagagagaaaaagagagagggaggggcagggatggagatctgctgcctgggtgtggacagggaggtggggaagtaggtaaataatagaaaactaattggagagaacgtgcgcatacctgggctgctggtggggagatagccgaggtttgctgtcatggtgctattaattataaggcgttaagtttatttctagaatgtgaaaacaggaggccttaagaggtttctttttttcttcttttaaaaatgtgctatcagtcatggtacttttagagcagcaggaattatttacctcatctagtggagaaaacactcttaatcatttgaagaaactgttatttttcttaaaaaagaaaaatcaggccaagcacagtggctcatgcctgtaatcccagcactttgggaggctgaggtgagcggttcacttaaggtcaggagtatgagaccagcccaggcaacatggtgaaaccccgtctccacaaaagtacaaaaattagccaggcgtggtggtgcacttataatcccagctactcgggaggctgaggcaggagaattgcttgaacccgggagatagaggttgcagtgagccgagatggtgccactgcactccagcctgggcgacagagcaagactccatctcacaaaaaaaaaaaaaaagaaagaaaaagaaaagaaaagaaaaatcacaagttgaaaaattgaggccaaacctagttctgtggagaaggagataagataaaatagcacactatgaaaatcgggccatggttttatatgtgtggcaggtcaaaatgccaaatatatcttgctggctccccccacacgccccggcattaagttttcagctattagtaagaaatctcaaaagaggcttctaagcatttatcaccaaacttaggaaatgtactgaagtataggtgagtattgcatgactttaaatacagcttttaaacatgtcaagatgtgtttccatgctctgaatgcctagttttaaactgtcttgctggctggtaaccattcctggttactaactcaaggtatgatccgcacttaggcaaagctcactgttaatgagaatagaggtaagtctattttccaactagtcttgataatgtttaagttttcttagttcttctttatcaaatccgattagcctgtctttgttcttacacaacatgatgaagagctcatcctggtggaattgtcggccccactgttctcggaaaacccccctgtgcttaggtgttgggatatcttcaattcgaggttactttttaggaactttttaagcctcttatcagtttttgaggactggtgtcattaaaaccaaataacatctgcaaatccttcactcagttggccacctgtacggttagtgattgcacggaaataagcaaggtggaatgagtacacgagcgaaggctccccgagcttccttcaggacagccgcctgccttcctgatacgtgcattcctggtacatgcatttctgctgtatggaccccaggaagatgtcaatgagatttaactctaacacagaacataaatataaattaaaacaaatcctggttttcttcctgcaccctgaggagttatcttgcgttccctgcaggggcacctcactgtgagatggctacgttagagaatcttctcaggaagggctcttttggaaaaacaatgtaaagtgtaaaatactctaaaaattactagagtggctcccaagcaataaagagaaattggaaaatgccagtaaacaaaaaagaagaggaaaaccccttaattccacagaagttaaccaccattactaatgctttgcttcatctcttctgaaagctttttccaaggatgtgtctctctatagaacttctttagaataatatcactgtggaacctatcagttagggtccttgaccataaggacagaaagcaggactcactggaaggcacctgggctgaggaaagagtgctcacagagcctactggagactggggcaccaggctcaggccaacaggagccaagggggcatctgagggcaaggaagcatggtgcaagaggatagcaaacatcacacaaccggaacagcccgtgcagggccgctgctgcaggggatggctttgcactggctcaggttcaaggcctgcaagacacagcccactgagctgagctccgtctggcctgggcaggcaaggaaggaccttgcttctaggcagccatgtggaaggcaggaatcctccaaccaccagctacaccccgctggagggagaaaatactctggtgagaaatcagggtactattggggaagagaaataaataaataataaacacgacaatactacaggatcagaccatatatgctattatgtaatctgctattttaaatgaatacataaggaacaatctttccatgatagtgtgtactcacctaaaacataactttgagtgactggatagtatcttattgtttggagataccttaattaattaattaatttagagacaggtctcactgtgtcaccctggctggagtgcagaggcacgatcatagctcactccagcctcgaactcctggcctcaagcaatcctcccaccttggcctcccaaagaaccgggattagagccaccacacctggcctatttaattagttcctcatacttcataatttaaataattttcagttttcactattataataaattgtgaccaatatcctagtagttaaatcttaatttaattgttcacttagaatacattccgaaaagcagaactgttgggtcacctttaaagtgatggggacctatttttaagtcttttgctaatgtgttttcaatctgtcctgcagaaagattgttcccacattctaaaccctcctcagcatatttttgctttttattttgcaattagatagggaaaaatagtatctcattgatcttttaaaaatttgcattccattgataagtggagctttctaaaggcccacagcaatgtactgaaagattcaattggattagctccaggaagcaccaaattggagcctcacagattgttttttcagatagaaacaacaaacccctcggctgctatgaaatggagcccacaaagcacaacatgacagacagaatctgaattccagagacacagtttctttcagaacaaatattatttgcaggaggcaattagaatgagccactattgcacagtagacttagcaggaaatgcacaaatattcaagcaacaaaataggaactggggaaataagcctgcaaaagaagtgaagaatgtccaacacaggcgggacgaggggccaactggcctcccgcgctcacaccaaaatgccagcttcttaggctgtgacagtgtttcctaatgcaattcatttgctcattcagtcagcattcattggattctcaccatgtgccagacactgtgctgggtaccagagatgccaaaatgagtatgaaacatagcccttgtccttgagagatttcagcctcatgggagagacaggaagaccaataatgacactgagcaagagttgttcagcaatgttagcaaagtgcattggggtcaatgacagcagctggctctgcctgtgggactcacagaggacttcatagaggaagtggcaggatgaactgcaaatgttttatgtgttcacattggcaattctgctgccaatactggggggtgagaatgttctagaatgagatggcttgaggctaatgctgaagtagctttttaatagcatggcttagggaaaagagtgctgaattccagctgtgtcaggtataggatatgtgacctggggaaagtcacgtgatgtgtctgtcctctgttgcccatctgtaagtgacagaaatcatagctaccttgtaggcttactctgagcatgatgggctgtctgcacacagggcttagtaagtggtatctgtcattacaaagtgttcagtaaatatctgctgaatgaatgaatataaatattttctctatatagtaaatatcttcaattatataacgaggttgggtacaggtatttataggatgtccgggagtagggaagtccattttcctaaacttgtgacctcagggacttcatggaaagggtgtacatgtcattttaacttcattcattcaataaaatatttaattagtgatattctatgctagaaacaattctagtaaactggtcgggtgtggtggctcacgcctgtaatcctagcactttgggaggccaaggtgggtggatcacttgaggtcaggagttcgagaccagcttgggcaacatggcaaaaccccatctctaaaaatgcaaaaattagctgggcatggtggcgggcgcctgtagtcccagctacttggaaggctgaggcaggagaattgcttcaacccaggaggcagaggctgcagtgagctgagattatgccactgtactccagcctgggagacaaagcaagattccctctcaaaaaaaaaaaaagaaagaaagaaagaaaagaaacagcgctagcaaacaaaacaaagtccctgtccttaaggaacttgaattctggctgtgaggttgacagtaggaggcagataatacatcaataaacatatgtcatgtcgggattaacactatgaagaaaaatgaagcaggataaggggtgagagtgatggggtactgtcctatctagaatgacatggaagtcccctctaaggaggggatcttgagcagtggcctgaaggaaatgaaggggcatggggaaagggcattccttgtagaggaacatcaagcaccacgtgtttggcagccagcaggatcagcaaggagcaccccaggcctttgtggcctgagtgaagagagagaagcagatgaggacggagaggtgggcagggccccgagcatgaagggccttgtgggccaggaaaggatttggagctaaatgtggagagaagaagagatgccattgaatggtgctgagccagttaggggacattaccagggagatggtgtctcaggccggggagataatggtggatagtgaaaggcggttggatttgggatctatttggaaggtagaagcaacaggatttcccagtggatgggatggaagtagagaaaaagacaccaagaatgatcacaaggtttaggtctcagcaacgacatactattcgttaaggttgagggggaagatcgagagtgtggtttgagacgtgttcccactgagaagccaaccagacatccaggctgtctatataagtctggagctccggagagcctggggttggagtggtcagtgcaccgaagatgtttaaaaccgtggggctggatgggatcccctaaagagggagggtgagtagggaagagaagggctccgagggctgaacctgggggcaacccaaagttagagatagggaaggagaaagatcagcaaaagatacaaggcaaacatagtatcagggcaatcccaggtcctattccgtcccccatcctgtgtccccagggcctccatcacccagttgtttctcttcagtgtccttcggagtccctgaggcaagctggactcacatagactagaaaattctagtgtattttgtgtgcaacccagtggtagcgccgcgtttttcagttgctttgaaatctacgaatatcccttctcatcacagtccgagtgaactgtcctgatgctgtggtttctcagtgtctctgaaattcttgtgaccttcagtcctgaggaccattcttctctgagtagggaggccgggggtcaaggccgggcctgactgccattgttctgactgcagaactgaacggagttcgatccagcggagcccgtgtggcggctgtcgaaagtaagcccttcacaaaaatggtgtgcctaaaggtaactgcagaggcactggggttcttaattttaaactatcagaaaagaatgaacgggcaacatgtgatcctcaggtgtgaaatgcaaccatcacacccttgtcccagaaacaccgtttcattttttctaaatcaagtgtgactccagtcccttactggccagtcataataagaggaggcctgggggtttatgtggtgcctctgaaacctaacaatacggaccaagaacatgacaactgttgaacaccaaaactggctccgtcacctacatcatcgcctgagcagccctgtcccctccccagtccactgctccggaaactggaatgacccttgtgaggaaaccagtgagaagcttgagcagttctctcaagggggggctttttcaacagattgttgaagggactatatcgacatgacgtttggcaaaagcccatagtgagactagaggagagaaagctgagtgacagccagaccctaggacaagggaagttcttccctccagtttgcccgccagccaacagcacagccaccagccctgcccacccttctgatgctgggacgcagccccgccctgccccgacaccaggccacaggccacaggccctgtcaacagccttcccattcctggcccagagaccctacctgctctctccagacagttcagctgtttgttcatgcaaagcctttctgaaaacaaaggcctattaattctgccccgtttgcaagtgaagccccagttctgtgggactcaaagcacacgctgatcgcttgagggggtggtgagaagacgatgtgaggaaggatgacttatttttttctcttttaacagcagaaggaaaaaacaaaaaatagtaactccataaatcatcctgccaggcagagaggaatctcccatttttaagctacaatacacgtttttgtaaaatgttttactatagagagttagtagacaatggtacagtgtatctccatgtaacatcaccctccccgccggccatcaactcgaggccaatcctgtccccatctccagaggtcacctccctcataattttgaagcaaatgtaaggcattattttattttattcataatttttttcagtaggtatatttaaaagatacttaaaaataaaggctcttaaaaattacctataatactataatcgtccctttaaaataatgatggtttggccgggcacggtggctcacgcctgtaatcccagcactttgggaggccgaggcgggtggatcacctgaggtcaggagttcgagaccagcctgaccaatatggtgaaacccagtctctactaaaaatacaaaaattagctggacatagcggcatgtgcctgtggtcccagctactcgggatgctgagacaggagaattgcttgaaccccggaggcggaggttgcagtgagccaagatcatgccactgcactccagcctgggtgacagagtgagactccatctcaaaagtagtagtaataataataataataattgtttaatgttatcatatatccagtgtcgaaaagatcagttttcccgtaaatgaataaatgaccttaaaaaaatactatacagaggcctggcacagtggcttatgcctgtaatctcagcactttgagaggctgaggctggtggattgcctcagctcaggagttcgagaccagcctgggcaacatggtgaaaccctgtctctaccaaaaatacaaaaattagccaggtgtggtggtgcacgcctgtagtcccagctactcagggggctgagtcaggaggatcacctgatccttgggaggttgaggctgcagtgaacagtgatcggtctactgcactccagcctgggcaatagagtgagaccctgtctcaacaaaataaataataataataataataataataaatacttcacagtttgaattaggagtcaagattcaaactgtgaatcttgtgattggctaacatgggttttttgtttgtttgttttttgagatggaattttgctctgtcacccaggctggagtgcaatggcgcaatcttggctcactgcaacctccgcctcccgggttccagcgattctcctgcctcagcctcccaagttgctgggattacaggcacccaccaccacgcccgactaacttttgtatttttagcagagatggggtttcaccatgttggccaggctggtctcgaactcctgacctcaggtgatccacctgcctcggcctcccaaagcgctgggattacaggcatgagccacggcgcctggcctggctaacatgtttttaaagtttcttttaatgtgtagtttttactcccaatctttcttttatccttgcagtttaattattggaggaaccaacttgtttgtcctgtagaatttcccacatcctggttttgctggttgcatcatcatggtatatataattaatgtatttgtctgtcttctctacttgataaattggcaattggatctagagcaaattcaggtttgatttggcgggaccagattactttacaggtgttgtatccttctatcaggaagtacatgatatctgattgtctctctatgacgtcagtactattgttgatgaacactaggtctatattaatacattatggactgcaaaatggtgataatctaattctatcattcttcatttactagtatttccttgatttataagtattttcctttatcagttttcaatattttcaaggtttctcaatattccttaacagcaaccaagtagtttttaaaattattttttaaaattgatacataatagatgtacatgctttcagggtacatgtgataatttaatatatttatatcaagtattttttgctttttagtattataataaagtcatgaatatttggtatatttcaatccattgtcgtcattattcttattgatgttcacagtatcccatttttgaacagtgggagctgcttcaggttggattctaaaagcttcctggatatatggcataagacgatttaggttcatcttgtacctattggtttccaatgacgttatcaatcttttgtgacacgagatcagggccaacagtgggtttttgctaatgatgtgttattaggcaataagtagaggaagagtttggtttgtgttagagatttacagatcattttacttgcttttgcaccgtgcttctacacaatagtgcacagacacacaactcactggttaaatggagaccacagaaatctctgggacactttatgagcagcctaatatctcctgattctacaagctagattggagaatgcgtctggagcctgaggccaaactgtggtcctactagttctcaaatcaagacaggattcacctgtggggaaaacgatgtgtacagaacctctgaatccattgtaataatcagtgtcattaggaactttatttatttatttatttatttatttatttatttttgagatggagtctcattctgtcgcccaggctggagtggaattatgtgatctcagctcactgcagcctccacctcctaggttcaagcgatcctcctgcctcagcctcccaagtagttgggactccaggcatgcactagcactcctggctagtttttgtatctttagtagagacggggtttcgccatgatggccaggctggtctcaaactcctgacctcaggtgatccacccgccttggcctcccaaagtgctgggattacaggcgtcagccactgcacccggccacttttaaatcccagtggcaggagtacttatagatttgccttaaattcccatttgttgggagaacaaaaaacatacaaaacagagtaggaggcaggtccaatacagactttcgaaaagtgataaaatgtggtaaaagcaaagcttcacacatccaatcagatgtcttcctcataagggaaagaacaagtaaccagctggagaggcccagcattgtttatttcagtcctccaccctgtgaggctgacgaggatgagaggtggtcctctatggtcaggaggggggaccagagaggccaagcattgtttatttcagtcctccaccctgtgaggctgaggaggatgagaggtggtcctctatggtcaggaggggggaccagagaggccaagcattgtttatttcagtcctccaccctgtgaggctgacgaggatgagaggtggtcctctatggtcaggagggagaccagagaggccaagcattgtttatttcagtcctccaccctgtgaggctgacgaggatcagaggtggtcctctatggtcaggagggagaccagagaggccaagcattgtttatttcagtcctccaccctgtgaggctgaggaggatcagaggtggtcctctatggtcaggaggggggaccagagaggccaagcattgtttatttcagtcctccaccctgtgaggctgaggaggatcagaggtggtcctctatggtcaggagggagaccagagaggccaagcattgtttatttcagtcctccaccctgtgaggctgaggaggatcagaggtggtcctctatggtcaggaggggggaccagagaggccaagcattgtttatttcagtcctccaccctgtgaggctgaggaggatcagaggtggtcctctatggtcaggagggagaccagagaggccaagcattgtttatttcagtcctccaccctgtgaggctgaggaggatcagaggtggtcctctatggtcaggaggggggaccagagaggccaagcattgtttatttcagtcctccaccctgtgaggctgacgaggatcagaggtggtcctctgtggtcaggagaggggaccggaggagggtggtctgggaagcactgcttgactcagagcttcctagtaccaagcactggatccactaaagaaaaggtggggagaggaagagtggctgcttgtggagtgggctatggctggaaactggtgagaaggtgatgacaaaagaaggcccattctcggtctaaaatctgtaaacaagatcctaagaagggagagtgggcttagggataagacagagtaaaaagaggcggggaagttgcagacggaatacgccgagccagcgacaatgactgggtggttcaaactttctttcctgggacagtggaaataagaagaggtgctcactttgatggggatgtggggatataggagaagagcctgtggatggagcacaaccaaactgaggttattgtgcagctggttttgcaagacactgatcaccagcataggtgattaaaaaaggactttctattaagaaatgttaacccttaaagagtaggatcaatgggccgggtgtggtggctcaggcctgtaatcccagcaccttgggaggcccaggcgggcagatcacctgaggttaggagtttgagaacagcctgaccaacatggcaaaacctcgtctctactaaaaatacaaagagcagccgggtgtggtggcgcatgcctgtaatcccagctactcgggcagctgaggcaggagaatcacttgaacctgggaggcggaggttccagtgagcggagattgcgccactgcactccagcctgggggacagatcgagactctgtcataaaaaaaaaaaaaaagaaaagaaaaaagaataggctaaatggacccccgtgtatttattaggcattgccattaacatatggccaatcttgcttcacctattctccctcaacagtttccctcacctccatcctcacccctgctcgttatttcaaaacaaattctagacatcacatcatttcacctataaatgctttgatgttatctttaccagaaaaggtagagataaggacctccttccccttttccccacacaaccattaaaccacgatcatatcttaaaaagctaacaataattctgtaatgtccgatatgcaatactttcaaatttccgctcttgtctcataaatatgcttttaccattggtttattccaatcaggatccaaacaaggtcctcgtgttgcatttggttgatgcgtatctaaatctttaactttccctccccttttgttcttgtctttcatttgttgaagagcctggtctttggtcctgtagaattgtccgcacgttggacttgtccgattgcatttctgtggttgtgtttaacacgtccctctattccctgtatttcccgtagaccaatttttatatctagaggctcgatcaatgtcaagttcagttttgtttttgttttttctttccttgcaaatcaacttcattggaagtggtgaatttttattgccttccttcaggaggtaacataatgtctggattgtctctttttgtcactcctcatactcagtagctgtcagcctgatctaggctgtatgaagctctccatcaacctgtcacctaatggttgccattaacattattttagtaggagttgcaaaatggtgatttttttttaaaaagattctatcattccttcttcatttatgcagtggaattcctctattaaagataattttctgaagaccagcctgggcaacatggagaaagcccatctctactaaaaatagaaaaattagccaggcatggtggtgtgtgcctgtagtcccagctactcagggggctcagggctcagggagtataacctgagcccaggacatggcggttgcagtgagccatgatcacaccattgcgcttcagcctgggccacagagcaagaccccatctcaaaaaaaaaaaaaaaacaaaaaacaaaaacaaaaacccaagataatattctgccatcaactattcggcttctttgaaatactgtttgttcagaaaaggcacagcagtttgcttcttttctttaatttttcaagcaaaatatttcttgatttctcttgaaaacatgcatttttggctggatgctgtggctcacgcccataatcccaacactttgggaggccaaggcaggaagttcacctgaggccaggagtttgagagacgcctgggcaacaaagtgagaccccatctctacaaaaatttttaaaaaattagctgggtatggtggcacatgcctgtagtcccagctactgaggaggccgaggcaggaggatcacttgagcccaggagttcgaggctgcagtattgcactccagcctggacaacagagcaagaccctgtctctggaaaacaaacagaaatatgcattttactttcgtaagtgtgtgtgtgtcataggtgggccttaaaattgcctgtatcccttatgagacgtataagcctccctttggcttgtgtgctagccaaaccacacttggtaacattcttcttcccttattagtttctggtgatttacagtgtttgcattagcagttacactgctctttctgtcacagtgaatctctctgggaggaagtgaagtgtttggacttgatttaatgaagctatcacagactgataaaacaggtttcaaatatcatagggttataaggaaaaagatgatttagaataattatttagataaatgataacagtacaccatgaattccataataattctgaatataactcttccctatgttaaataattaacatttacaaccatttaaatatatttcaatatttaatatatttaaattgtatatttaaaataatgtatatttaaaaataagaaaaatgttcacacaactcaaacttgcaccttgttatatctatgtttcttccattttaaattttgtcattcatcgatatgaactggttaccaataaatttggatttgtaagctaggtagaaagttggggaaatttctgcaggaataaccaggattaaccagataatttcaagattttcttgatctaggaattaagaattcatatgatatggtggcctggtgcagtggttcacccctgtaatctcagcactttgggaggctgaggctgacggatcacctgaggtgtttgagaccagcctggctggccaacatggcaaaaccccgtctctactaaaaatacaaaaattagctgggtgtggtggcgggtgcctgtaatcccagccactcgggaggctgaggcaggagaatcgctggaacccgggaggcggaggttgcagtgagccaagattgcgccattgcactccagcctgggtgacaagagtgaaactctgtctcaacacaaacaaaacaaaaaacaaacaaaaaggaattcatatgacatgggaactagaactatttccaaacagttgtaatccgattccaaagaaaccctgcacttctggtttcctgatgatgtcacccacataaatggctacgtcaaggagtcggtcctgagagcagcgaggcaggagtgaggtcgagtgggcaggcgtgagagccgagcacaggggcagaaaggaagactctgcacccagaaagcggaaaggaggcaagtgggggacaggggtggggtcactggcccaggcactatgggactgcacatcgcacacaacactaacttcccttaataaacactaagttaatctttacaactcttcagcaaggccgtgcaccccgggtccttctgttctgatcggaggacctcgcctcttattcagcagagagcgtagaacctttggcctctaacaccgccaaatctccctttcacagaccaactggcatctaagagctctaggggcagaagtgccgctgtggggcactgatggggcagggactgtggcgcaggtcacctcctgcctttgctgtctgacgcagcctcccagggctgcttgcatttggcaggggctcctcctccacgctgccctctcctggttctcagtcctgctcggtttccaggcaatcacagccccctgtgcaccactccaggcaccgggctcctaaagcagcccctttttcagagctaccctttagttggtgacactctccactaccaaccccagcccagcccagattccctccaagcacagttgtgctgggcacaatagtcatcatctctaagcttacctgtgatttcatccatcctcacctcgtcaccgctctcagaagctccgcgtcctcctggaggctaactcctcctctgctgttgttcccactccgggctacctcctcactgcccttcctccaccagagattccctccatgctctccccttgactttgtcaccatccctgtgcttatcgctttcagaccacagtcttagtcaagtccaccccgtcttttcaaagaacaccttcctttcctttagacgtctctccccgtcacccacccgtcacccagtctctctttccctccctccaccgccaagcattctgaagaaatgttcccctcaccctgagcttgctgcccctcccttccatttcccagcctcctgcagtctcactctgtctccagtacttactgagactgctgaggtcctcagcgacatgcccattgccaatcccagcagcctgtgtccagttcttcacgttttttgaattcactgcaacattgaatgcttgccagtgatgcctccttgctgaaattcttccttggatgaaaagacacattgtttccgggttatcccttttctctttgactattgcttctatgtcttactgaggcctctttctatttccacccttaaccattagtgttcccaggattctagcctcagctcaacttctttcatctctcccagtagcctcattcatccccgtgaccccagctacacttgcaaggactcccagatccaaacctttgatccagcctttcactgagacattctccagctgaatgttgtgctggtctctcatatgcagcagagtctattcctcctcctctcagctctcttttctgtccaacctagaccacaggcatcagtctctaggacttgcctcagcgtctctggggtccctccttccactctactcctataatacgagatgattccagccctcatcccctccttccttgacagttgccatagcctcctaactctgcctctaggctcagccccatccgatccattattcctctgcttttagaagtatttttctaaatagatatggccatggcttgtacctcagtatgggttttgtcaaaagcagaacctgaaacgaggattctggtgtagttgttgtatttgggaggaaacaatagtatgtgagtagggaaggaagacaggaaagggaagcaggccagtaaagggtgtgttgtcgagccagttacctctgcacgtaactggagctgaatcttgctgggcaactctaggagtctcgtagaatacatgcctcagagatatcctgcctgaggggcgagagagctcggttatttatactccgactctcatcaggcaatgagaggtgtcaattctgtagcagttcattcccctcctgcatgtacttggaggcagggggctcatgaaccccttaggcagtagaagtcaagccagctattgcaatggaaaggctcaaagggctagagaggggcacagatggaaggacagggacaatctctgtctcattaccctcctgcttaataatccccagaggtccccactgcccacagctggcctttctggcctcctcccctgcactgcttccctccattcacacaagggttctgaggtctttcctgaagaagacaagcaccctcatgccggtacgcctgggtgtgcatcgctctttcctccacatcacccttcgcttttaggttaactgataatactggccgcacgtactgggcacctgctacctgcagagtcatttatgtatgttagttgatttaatgtaacccctataatagcatatgagttgactagctaaaaagaatgatcacttccattctacaggtaaggaaatcacagctcggagaggttatctcaatgcctctggcacaaagctagcaagtggcagggccatgttgggagacccggctctctgctacaaagcctgtgcgaggcactaaccactgggctgaactacctcagacttcctgcctcagctcggcggtggcctgtccttgctccttctcacctaaatagatgtgctatcagctctgtcttcccatagcctatggtactttttttatgtggatgtctttattaagcgtgtgttatcttgtagtgtaagtatttatcatctgacttcccttttaaaccataagtccctcccattttaatcttcaatgcttggccaattgcgtaactggagtaaagacttcgttaacttttaaaagagcattaagttgaattctgctgggcacagtggctcacgcttgtaatcccagcactttgggaggcggaggcaggcggatcacttgaggtcaggagttcgagaccagcctggccaacatggtgaaacctcatctctattaaaaatacaaaaaatcagtcgagcatggtgatgcacgcctgtagtcccagctactcagagagctgaggcaggagaatcacttgaacccaggaggtggaggttgctgtgagccgagattgcaccactgcattctaacctgggcgacagaatgaggttccttctcaaaaaacaaaacaaaacaaaacaaaacaaaacaaagaattaagttgaatgaatgttgactttgtttcaataccatgcacacaaatactgaagaatgagacttcttaaataagacaggacctagttttgacttttctgggcatattctgctgggcaggaaagaaataagaacattaactctaatggaccacagacagatggcctgccagccagacagcgccccgctgagggccagagcagggcctttgcccaaatcaaggaggagcctattgtttcttccagtttgtgtatggaaggcaaaaacatacaaacaaaaattctttgaaagctcttcaggctctgcaatttgggacatgtttatagggcatgtgtaagtcacagtggtcagtggctctgtggccacagaaggcattaagaggaaatgttagtggcctcctcaccctttgttccttaaagggcttctgcattgacaccaacagccagaagggtttgctagcttttagtgtggttatagtgtggacttagacactataaaatgggaggaaagaaagctcctttttgggaagaaacttctacctatgtcagctatggtataccagctcacagagtgctaagaaaaaataaattttttaattaaaaaaaaactacatgtgcatgtttatgaaaacctggtttcacaatcagaatactgaacctgctaataaatttataccagaaaagcatgcatgctttgctgttaaaaattaactttataatttactttttggcaataggggataatgagaaagagcagcaaagatatctttaaaaggcagcagggagtcagacctcctcctcctttcttcacccaggtctgcactcgtgggcactgagtcgagaccaccaaatgcatgtgggtgggtctgatacccggtgacctgcagggacagcagcactcccagcctctgcccacctgctgaccgcagggcaaagtgtctagttgtaaaaggaaagtatggctccttctcccctcaacctggccgaatcttccaaagtcatttgcagaatattgactgcacagagcgaagaacactttgtttacaatgcagttggtgcaaaatgaatagactaatgaaggtgacgtgaatgtctttgactcatatttatagattttggcttctttgtttcctcttgaacgtattcgcagtgcctcctttctttgtctgtcttctcttcactttcatcaaaggcagcctgttccttctgaccttgaaatttcttttgtaaacatcatgcctgttggcacctgaacccacctaaagtttaaggggtccaggggtaaggggacttttagaaaaccctgctgtcctatggccaacatcagataactggggtgggacatagtagctcatgtctgtaatcccagcattttgggaggctgaggcaggaggatgacttgagcccaagagttcaagaccagcctgggaaatgtagtgagactccgtgtctatacaaataaaaaaaaattagctgggtgtggcacgcacctgtagtaccagctactctgcaggctgaggccagaggattgcttgagcctaggaagttgaggctgcagtgggaagtgtttgcgccactgcactccagcctgggtgacagagcaagatcctgtctcaggaaaaaagataatctggaagacgttattatttgtttttgtttgtttgtttgttttttagacagagtttcgctcttgttgcccaggctggcgtgcaatggcacaatttccgctcactgcaacctccgcctcccgggttcaagcgatgctcctgcctcagcctctcaagtagctgggattacaggcgcacgccaccacacccggctaattttgtatttttactagagatggggtttctccatgttggtcaggctggtcttgaactgccgacctcaggcgatctgcctgcctcggcctcccaaagtgctgggattacaggtgtgagctactgcacccggccttatttgtttttatggatgatccttattcctttacttatttcatttaaagttacctttaagattattggagcttaaaaaagaaatatgcagctgagtgagaaaaggttattgaaaattttactatatatgtgtgttcatatgcttagagacattgtgaaagcaggtaacttttaaacttctttatacttttacttaactgtggtggaatatacataacatcaagtttaccattttaaccacttccatgcatatagtccagggggattaaataaattcacattgtcgtgcagccatcaccctgatccttctctagaactttcttattccaaatggaaattccatactcctcaaacagtaactcccgttcttccttcatgttacctttttttttttttttgagatggagtctctctctgtcacccaggctggagtgcagtggcacggtcttggctcactgcagcctccgcctcctgagttcaagcagttctcctgcctcagcctcccaagtagctgggattacaggtgtctgccaccacgcccagctaattttttaattttggtagagacagtggtttcaccatgttggccaggttggtctcgaactcctgacctcaagtgatccacctgcctcggcctcccaaagtgttgggattacaggcgtgagccactgcacctggcccctgatactattttgagtgtgattcttacagtagtatcttatattttaaaaaacaggatacaccttaccttggtccttaaagaatatgtttgcttattctgctgtggttccaagattatttttcctataaagtttcccccctaagagcttatcaccgtgtcttacaggcgagtcagccaagtaagacatgatgaaaatgccagtgttatgaggttcccaggcgctccttcataaagatcctgagaaaagcttttaagaatgtatctaagagttgctttcagggatcttaactcaattagtggaggttgctgaccacaggccatgtctagagcacagactatatcgtcacgttactctgttgtcttctcattgttcaattcagcagcattttagaaggcccgctgtgtgctctgcactgtgctaagtactgcgagaaacagaaaagttgaagacgtggttattgtctgaaatggcagctcctgggaaaaagtgccgtagaaagaggagctggctatagaaaatatggtaatttctaacctaaaattaatatgccacttatgatcatacaatacgaacattaacgtgttcaaatatgagaacaggaacgaatgctggaaatatattaaagtaataacaaacaataataatattaacacctaacagtcactaagcatctgtcatgtgccaaacgccacactcgacactttacgcgctttatctcatttaatcccaccaagaacaagaagcttacggtgatggctcttgtccccagtttagttagaaaagctgacacacacagagattaagggcatggtactagcaagtgatgacgtggggctcccaactcagacctgcccgactccacggtccaaggctggtgtttgtcattgttgggacaaccattggtacactgtgatgtccagtctggaaataaaagagagtggattttgttctgttacattttatttttcacagaagtgaaaaggaaaaggaagcaattcattttaaaagcatccaaaagcaggatgttgtttctgtcacgccattgcttgggatctgctaccaactcccttactggtagcttaggcctcactggttgggattcttttttttaaaaattgtctgcctgggccgggtgtggtggctcacacctgtaatcccagcactttgggaggccgaggcaggcgggtcacaagttcaggagttcaagagcagcctggccgatatggtgaaaccctgtttctgctaaaaatacaaaaaaattagccaggtgtggtggcaggtgcctgtaatcccagctgcttgggaggctgaggcagaagaattgcttgaaacccggaggcagaggttgcagtgagctgaggtcacgccactgcactccagcctgggcgacagagtgagactccatctaaaaaaaaaaaaaaaattgtcttcctaagatgtccctagattccttcatgtacaacatccatggggacaccaccatgcaaagccaagtggttggccagcagccggttcctgccagtcttcctgtcaggctgaggactcgttcaagaggaaattcaccgatgcgtgaacagcctgcctgttcgtttggtgaaatagggcagattttttatttcataaaagtgtagtaaagggagaggctattaatcaaggatttaaattatgatcattattatttattatttttgagacagagtcttgctctgttgcccaagctggagggcacagtgatcttggctcggtgcaacctctgccttctgggtttaagcgattctcttgcctcagcctcccgagtagctgggactagaggcacatgccaccatgcccaactaatttttgtatttttagtagagatggggttctgccatgttggtcaggatggtctcgatctcgtgaccttgtgatccacccgcctcagcctcccaaagtgctgggattacaggcgtgagccaccgtccccagctgagatttaaattatttattttattatttattcatttatttattttgagacagggtctcgctctgtcatccaggctggagtgcagtggcacgatctcggctcatgcagcctcgacctccccagttcaagcagttctcctgcctcagcctcccaagtagctaagactataggcacgccacttcacctggctaatttttgtattttttgtagagatggggtttcaccatgttgcccagactgatctcaaactcctgagttcaagcaatctgcctgcctcagcctcccaaagtgttgggattacaggcgtgagccaccctgcctggctttaagttacttatttaaaaaaattattgcccactctttagcaatggggagggaatagtgtttcttcctggatcttcaggagtggctgtcccttctgggaaggtgcactttttagttgagaagtgaagttcagggaacctggtgacagtgggttaatagtttctcaacttacctctttttgccaactctgacatgtaggactcattcattctttcagtcactgtcattcatttatttattcatcagtaagtgccttccttgagcatggcacaccaaactatgtagcagggctcaaagaaccatcgtgcacagtgcctgccctcatagggctggctgtctagtgagggaggtgggcgtgtgaacaggcaaatcacacaccagtggccaacaccagggcagaatgatggacaaagcactgctgatgggcaaagagcacagaaaacaaaatgaccacctgggcctggtgccgtggctcggcaggaggattctttgaggccaggagtttgagaccagcttgggcaacagagtgagatcctatctctttttttttttttttttgagacagggtctcactctgtcgcctaggctggagtgcagtggcgtgatctcaggtcactgtagcctctgcctcccgggttcaagcaattctcttgcctcagcctcctgagtagctgggattacaggtaccatcgccatgcctggctagtgtttttgtatttttagtagagacggggctttaccatgttggccaggctggtctcgaactcctggcctcaagtgatccgcctgcctcagtctctcaaagtgctaggattatagacatgagccactgtgcctggcctaaagatcctatctgtaccaggaaaaaaaaaagaaagaaaattagccaggtgtggttactcacacctatatcccaattacttgggaggcggaagtgaaggctgcttgggaggatcgcttgaggccaagagttagaggctgcagcgagccttgactgagtcactgcactccagcctgggcaatggagtgagaccttgcctcttaaaaacaaaacaaaacaaaacaaaaaaaactttggcttgaggagtctagaaattaggaggtgacatctgagctgtgtcttaaaggacaaataggaagtttcgggtggagctggcatctgcaagagcacaaagccccaagagctagctagtgtccacctcgtcaaacagaggtggcgtcagaacaagaaactctccagggcaagaggaaagtgcctagatttcttgtttgtattttataccatatagataaaattgttatttgttttttgtaaggctttcagtcaccttgagtatctggctaaaacctattttttatcttaaactatagacacaaagattaatgttgtcaaagtagcataaaagctggtcttgtagaaatattttatcaactaaatacacggaagagctgtataataaaatcctgtctccttagctttttcttgtgtgctgtgtagtacaaaatattttgtttttatcttccttctgtggttaatacttataaagccagcaacgattttatctgacattcagaaatatcaatgtaaaagcctgtaagccctgcaaagaaaattgtttttcttcattcttttcaccaatactgggaagctcccaaagatatccaaggttaagcaatttgcattcagattgttgttattaagtctggtttccttctcttttttgtgagacagagtcttgctctgttgccaggctggagggcagtggtacaatctctgctcactgcaacctctgcttcccgggttccagtgattctcctgcctcagcctcctgagtagctgggatgacaggcactcaccaccacacccggctaatttctttgtattttagtagagacagggtttcaccatgttggccaggctggtctcgaactcctgacctcaagtgatccacctgcctcagcctcccaaagtgctaggattacaggcatgagccaccgtgcccggcctggtttccttcttttgataaatgataacagagaaaataaagcacatccacttatttttattttaattttattttatttatttatttttgagatgaagtttccctcttgttgcccaggctggactgcagtggtgcaatcttgactcagtgcaacttcgcctcccaggttcaagcgattctctttcctcagcctcccaaggagctgggattacaggcgtgcaccaccatgcccagctaattctgtatttttagtagagatgaagtttcaccatgttggtcaggctggtctctaactcctgacctcacacatccacttagttttaaatatgcttcagggcaggcacggtggctcatgtctataatcccagcactttgggaggccaaggcaagcggatcgcttgaggccaggagttcaagaccagcctggccaacgtggcaaaacctcatctctactaaaaatacacaaattagctgagtgtggtggtgtgcacctgtagtcccagctgcttgggaggctgaggcatgagacttgcttgaacccagaggtggaggttgcagtgagccaagattgtgccactgcactccagcctgggtgacagagtgagactctgtctccaataaataaataaatacgcttaaaatgggaaatgatgacttccaggctgtgggatgtttacttaagcaaaaacctctattacgctacctgagaattccattactcaagtttgaataattacaaaactacgtgatgggcctgccctgtctgacttcctgcacacttagaccgagaactgaaagaccctagtgtcaaaaatatttaagatctgccatgagaaatagatgagggagaattagagcaaaccctggccctagggtgcattttgagattgaaatcgcagcctagtctcttccattacaccatcagtaaatcttgaaggacagaagagtagccaagaacaacacagggacaggtgcgctgggcttggctggggagggagccaggtgaggttgtggcttcctgaaggccctcgaagtttgcccctgcagctttcttcggagaactgggagaacaccatgtgtcaccttgtggagcattttaaaaacgagtgagaaacctttatcgggaagatactacgtgctgtaaaacaatgacagtaagccgggcgcagtggctcacgcctgtaatcccagcactttgggaggctgaggcaggcagactgcctaaggtcgggagtacgagatcagcctgaccaacagggagaaaccccgtctctactaaaaatacaaaattagcctggcgtggtggtgcatgcctgtaatcccagctactcaggaggctgaggcaggagaatcgcttgagccccaggaggcggaggttgtggtaagccaagatcgcaccactgcactccagcctgggcaacaagagcaaaacgccatctcaaaaaaagaaaagaaaagaaaagaaaagaaaagaaaagaaaagaaaaaaataatgataacaacagttgatgaaatgctttgatttccagaagacattatataaggagagaactttacttgcatgggacagctgatgagctcctcagctagggagaggggagggattgactcattcttgatgatggggcagggccaaggctgtagggaattgggcattgtctggttgctggtggtatgagatgctggcggagcccaacccatgcctctggctgttatgcgagggtgggaaaattccagtttgctagaaccattaataacacaagtggaaatcatgggtaagtttacagtttattcaagcaagtacttctaattaaacagaaaaaaagagtgtgaactcttgaccaaggcatattcatgattttcagtaaaataatttctcacttctagtggtcaaaataataatgaagtgcgaatatgaagtgaaatgcaacattaagggttggttaaccccaaattctttcatcaaagagcaatatacaagaaattggagagtttttttttttttcatactaaaagtaaccattaagggtaaagaactgagcctggcacagtggctcatgcctgtaatctcagcattttgggaggccgaggcaggaggccaggagttggagaccagtctcggcaacaaagcgaggccctgtctctacaaaaaaaatttaaaagtaactgggcatggtgatgcatgcctgtagtcccagctacatgggaggctaaggcaggaggctgaagtgagccatgatcacgccactgtgctccagcctgggcaacagagcaagaccctgtctaaaaaaaaaaaggaggctgggcacggtggctcacgcctgtaatcccaacactttgggaggccgaggcatgcggatcacaaggtcaggagatcaagaccatcctggctaacatggtgaagccccgtctctactaaaaatagaacgaattagccacacgtggtggcaggtgcctgtagtcccagctactcgggaggctgaggcaggagaatggcgtgaacccaggaggtggagcttgcagtgagcctagatcatgcaactgcactccagcctgggcaacagagcgagaccccgtctcaaaaaaaaataaaaaataagtaaataagtaaataaataaaagagcaaggaactgaacccagtggataatgctggggcatcagatagaggctgttggccatttagttaaaataagatggatgaccataatctgaaagatgtaaaaaaagaaactgacctaatttatttttttgaatgaataaaatatatgtggtacaaaattcaaaaggtatgaaggctcatagagtaaaaactaatttttttttataaatgtgtcccaaaaccactcggatccctctcccctgagtgcaccgattccagggaatccttgtgtgaacaggcaggtagcatccttatgcgcccttcacgcatctctacacatcacacttttctcactaagcaacaggtcccatacgctcagttcctaattgtataaatacccacctcatcgatctcaatgtctgtgtagtattctattgcgtgaatgtgccatattttatttaaccagttcccttctcaagaatatggaagcagttttccatctttcagaaactctgatttatttgtttattatttgtatttttttcctgacaaaaatgctgttcagaacagaaattcgagtttaaattgcagtggctgttctggttcatgtagaactagacttcagccttttcctcattttcttttgcctggtagacttttgcttatccttttattttcagcatttttcaaacattttattttgggtgtgtctcttgtatacccaagcagtgattgcaacattttcagcaattgctataatttccattttagatacagagacacctgtcacttcgcaccttaaatgaagagcttctgagctaatttcttcaatgggaaggcacctcgggggtgatacatgaataacgtggaataatgcaatttgggcagattaccagttaaaagcaatgttaggtttggcccactttgccttgcaggccgctaaagcctcaaacaatatgacacctggccttttacaaagaccggacagtggaggtgttgacaggaatggtgttaagccaggttcatctgggtttgtcaagcatagacttctacttttaaaatatttagggcaaatacagttcaaaattaatttggtcaactacatttttcttaagtttctttagttttgaaacctttgtatatttttattaattatgaaactcatacaaatgttatgtaggcagaattttcaggaagttttatgcccctttttataaacctgtaacaaagaaataagtgatataatagggaaatacggaggtgtatttgcagtctttgtattttacaaaattatcatttgaccatagatgtgatcgttgctgttccaagtaacagaaagctcaacccataaaaggaattaactggcttatatgtaacggaagagtccaaaagcagacatagcttcagatgcagcttgatccagggctcagatgccatgatcagaatccaattcttgcatctgtttctttgggttggcttcattttcaggcagcccccttcctcatatcctcaagatggcagagacagcccatggtctttcccttgcagagacagatcaccaggaaacaatacctctatccctagccatgaaacagtcttgaactttattctgacttgatcagccaagtccctgttggaaccatcactgcctagcttaggcctgagacagtgctgcacctctactaccaaaggccgggctggccttccctaaagtgtatgtgctgcgtgggggagaggtacggatctgaaccaaaacgagggctgtccagcgtcagcaaatatctcccgcagtcccagtgcctccagcaggaggcaaagcatcaacccctccgtctggctcctctactgaaaattccctcagcagcctcacaggccttaggcttgtcttagctacttcttcatctacttttttgctttcttaattatttttcttttcttttttcttattttattttattttattttagatggagtttcgctccgtcgcccaggctgaagtgcagtggcgtgatcttggctcgttgcaacctccacctcccgggttcaagagattctcctgcctcagcctcctgagcagctgggatgacaggcacacaccaccacgcctggctaatttctgtatttttagtagagacggggtttcaccatggtctggtgacctcctggtctcgaactcctgacctcaagtgatcctcccgcctcagcctcccaaagttctgggattacaggcatgagccaccgcacccggctgcttccttaactcttgatctcctctctgtatcttgctttgtctagctgttctcttctctccatattcatccaaacatttgcttagaagtacccagaagcatggcgttgaatgtggtacaccttgaacgaagggtgaagaaacgaggcagagtgacttagtagcaagtgacagcacacagtttaaattttaatattagcccatttacaaacaacagcttatataatagtcattcacatacctcaacactcaccatcccctccccactttttttctggagacagggtttcactgtcaccccagctggaatgcaggtggcatgatcacagctcactgtagcatcgacctcctggactcaaggggtcctcgcgcctcagcctcctgagtagctgggaccacaggtgcatgccaccacgcccagctaatgtttttttttattttttgtagagacagggtctggctatgttgcttaggctggtctcaaactcctgggttcaagcgatcctgccacctcagcctcccaaagtgttaggattacagatgtgagccactgtgcccagccaacattcaccccattcaagtgtgcaattcaatggattctagtatcttcacagtgctgtgcaactatcactcctatctacttacaaagcatttccatcatcttaaaaagaatccccatgtccaatagcagttccccttcccccaccgtcatcctcgggcaaccgctaatcttcctgtgtgtctgtggatttgcctcttcagggcatttcacataaacacaatcatacaatatgtggccttctgtgtctggcttctttcatttagtgtaaggcttttgaggttcatccatgttgtaatgtatatccttagttcattcttttttgttaagctcacaaataaaaagcctcactttttatttgaggcaaggagactggctacagggattacagttccagcagtcaaaacgcaactccaagtggcactatttggaccgtaggttttgcttcattttggctggaaaagggtattcaggatgtacttctcccagccggacaagaaaaagggcaaagaaaactggaagagacgtctcgtctacacaaactgctctttggacacagcatcaacctgaccacacccgtgctggccagtctgcaggttgctgacccgccgttaagggacacaggccatactacacttgctagaaaaactgaggcaggaaaaagaggtgcaaggcactgggggaagagcaggtacctatagctttaaagctcagtgttgaaggggtaatccttgcaggaggcacagctcaccaagacacagaccctcccgttcctgttgtagctgactacagtggtcacatcaggctgctcagttgaaagtcgaagtcctccaagttttcagcagtgcgttccagcatcaccaccgaaatgatgataggaattaccaccaaattcctatgcatgggaaaccagatcagaacctgggctgcgtttttatttgtttattttttttactgtgcttggctgtgattgctttggtgctgggatcccccagacctgtcacgagagctgaggggactacaggcagtcaccaccttgcctttggattggcagccctggattaacttctcctgaggtgggtgcaggtggcactcactgtggttaaccactgtttttaagccaggtttctttttttctgtctgtcatatatatatatatatatttagagacagggtctcactctatcactcaggcctggagtgtagtggcatgatcataactcactgcagcctcgagttcctgggctcaagtgatcctcccgccttggcctcccaaagtgctgggattacaggctgagacaccacacctggtcttaagccaggtttctttaccatctcttggagatggctgcagttggagattccaaaagctttcagagcccttcatccaccagctcctccatgtggccacccatgtgacatgaagttggtgtcactaggtaccacgttgtctgtcccatccaacaggaaaaatagcctgttggccagtgaataaggtaggaatccaggtggtcccctgagggtcttctgacaggctcctttatcaggctcttctcatggtatgagcaccgcagcttgctgacagtggcaacgttctcaagcttcacagactccgtcacttggcctggaggggaattctaggtgtccagccccaggacaggcattttggcaccatgattgagcacgatatggtgagccatcctcacaggattaagaagaattctggacagaaatatagttgtaagtaagcatcagtcagcctgcactttgacccacttccttgtaaccaacagtgacgtagcactaggtaacatttgcatccccgttgttcctatagatacaatttctgaccttagaatcacaaggcttttgtttaaaatagatgggatctctgacattagaatcataagatttttgtttaagacttgcttaagatgtttttcagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttaccgtggctggccaagcctgctgtgcttcacagaccccactcaggatcacaccacttcgttccactgtttggagatgccatgtttgcttatcccttcatcagctgatgagcatttgtgctgttttcactttttggctattacgaaaatgttgctacgagcatccatgatattcgcccatttaaaaaagtgtttttcaccatt

SEQ ID NO: 2229 - DNA, 154901 bp, Homo sapiens; identical to SEQ ID NO: 2228

SEQ ID NO: 2230 - DNA, 155248 bp, Homo sapiens
tgcagttaacaacaaaaatcgagcaacgccacgtcgcacaaacaggacaggagggggcgaggggtgtgtgcgcgcgcgtgctgtccccaaatggatgagaaataagggaaaggaggggttggggaccgtgtgatgaagcaacatgctaggcccgggacaagtccggctccggcctcgggtctggagggacaaggccgggggccgggtggcagacggggcctctggtcttcccccagcgcgagggtcgtggcgcgaaacggggacagggcgcgcgctcggagcctcctccccgccccgccccgcccaagggtcttcctcccccgggattcagagcggcccctcctccaggccaggctcgccgcggggcgctgagcaggccgggacaccgcggccgaggttatcgttaggcatctcccaggcgaccggctccgcagcaagatggcggacgagaaggacagggaaggtaaggtaggggagccggggagccgctgccctcgccgcccgccgcgaccccgggctgcacggggaagcgccgggtggggtgggccctcgtccatctggagttcccacccgcagggaaagggcggcctgaggagggggccacccggcagcagcagtcgccctgcccccgtccccgtagcccgcccggcccgccgctccgccccgccccgccccgcctctctcccccgccccgccccgcctctctcccctcttccctccctcttctctctcccctcctcccgccttcttctttctcctcccgccctcttcaccctcttcccctcctcccgccccgtcctccttccccctccctcggaggccgggccttgcatcctgcgcgggctgcgccggaggcgccggcagggggtgctgataatggcgtcgttgttcacggtcgcggggaagccgccgccgcctccacactctcgcctggggtctcggtgccgcaggcgccacgcccgtagctgtccaggctgtgggccccggggggtggcctgggtgaggaggagttctggccgcctgaatctgacgggatcctctgtttgcgccgaaaccccgcgctggcgcagcctgatggcgttcgcggccaccattttgcctccttaatgaggacgcaggaggacggtctggaggtcacagccgctgcctccgagcttcccggtcctccgaaatgcctgccccgccgccggctagcgccgcgcaattggcctagtgtcttgtcttaaaaaaaaaaaaagacacacacccaaacagcaattttaataacgacgaaaaaccaaaacctggttgagatcttggaaccgctgtgcgccggccgggcctctcccaggggaccacccagccccgcgcggtggccgcctgcagaggcgggactgcgcttcgaggcttaaggtcgccagttcggaggcatcgatgtgttgtctgtgcggagaagccaaaaagtgattacgtttatttgcaagaccgttcatgttgttttcagttcatggtatgattaaaacccgatcctttgttaccatgcccttaggtactaaaaaataattgtgtttgatagttggcagtcacccaaaaatatccaaaaagccatgaaacagtaaaggtaaacaagtaggaagtgaaaataatattcgtcctttgttttctttctggagtgctcaaaacaccctctcaaaccatttttctcagcatagaaccaagtgtggtcaggttaacagctaatatttacaagggaagaaacgaaccctgagatatttagtcacttgttccggtgatcacagaaaatcggcgaagaaacacatgaaactgccaacgatctctctattgataacaaggataccgtgatttttatgtaatattaatctgagaagccaggattattttgtaggtattagctttacgaagatgcccttacatacaaagaaaaggataattttaaaactttcccagaaaaatggatggcttatttttgttctttaccaaaaaaaaaaaaaaaaaagccattaggagataaactagcaaggtaattatggatatttattttcttaaaaaagacttggttaggtcagcatgagaaaaaacgcactggagtatggtacaaatacagtatttctcgttttttaaaaactgagagctttcctgatttttcagcttttgaacaatttttttccatttaaagtaaattcagagaaacaattttgtcgataactcatagaagtaatgactgttaaaagctggatgccattcattcagaatacatatattcaatgccattatgtagataaggcattctacttagaactttgaaagatacgaaaatgaaagacattgtctttgcttccaaggaaggtgagatgagtaagggagatgagaaatttacaaatgggaggaaatagttaactgggctgagtagtctgggtgccaaccactgtgctaggtgtgtatccttgtagtccgtggacagcagcctggacatcactggctgccaccgacctaataatgaatcagtcttcattttaacatgtttgtaggtgatttgtatgtacattaactttcgagaaggccgggcgcggtggctcacgcctgcaatcccagcactttgggaggctgaggcgggcggatcacgaggtcaagagatcgagaccatcctggccaacatggtgaaccccgtctctactaaaaatacaaaaattagctgggcgtggtggcacgccctgtagtcccagctactcaggaggctgagacaggagaattgcttgaaccggggaggcggaggctgcagtgagccaagatcacaccactgcactccagcctggcgacagagtaagactccgtctcaaaaaaaaaaaaaaacaaaaacaaaaaacaaagttcgagaagcactcatgtgctgtatctcatttattgttaacagttttatggattaactaattgcagtttgtgaagggtattatgaaataaaggcattttgttagaggataaactaagtagagactcattttggtggtaagatctttttatggaaatagtctattactatatttgattgtcagctactgtattttgaattttcagaaattacgtctaaccaattaatcagaattgattaagttttgaggattcactcaactaaactcataaaagactgatgtgcaaacctgaatgatttattaatttaaataagggtatatacattgacttgaaggctgattttgccaatatactaatataataattttggcaatatactaatataataatatactgttttatgggtactaagcttcgggtagtgtgaatttgtatttcagaagtcatttgatgaccgtggaatcacacaaaagaaaggataattttgaaggatgtgttcagtaccctctaagttccaaaagatctgggaccatttctgatctgttaatactgagtgttgtgcagagtgcttggaacgtggtaggtaatcaataaatatttgttgaattcagaacatttgaattaatcaaagacagcttatgagattttaaccaaagcattcctagctattttccccaaacttattctatacctaaaagtacacaaaactcgttttaggtctcttttcccctctgctttaccggtaagatacattcttctattccatctggctcaacaaaacgttttatttcacagtgccacggtattcactagcatgtctttaaaaaacaactacaaaaaacctcattgtagaaatacacatatgttttaaatagttcatccttaatattgagatttctaaaagttctaaagggggaataagtttcagggtacctatcctatccactcttcttcaatatttagagattaactttgatagaagtattgagaatattgataagaaaaattacctaaattagaaggggctattgtgctcataaaatttttttctaagattatgtacgttgaagttgttatacttatttgtagcattttttgctttcatacagtataatttattttttcatagattaaaaattatacagaattatattagctaaaagtttaacctttagaaccaaattatttttaaaaccacttttttaactgaaagaagaatgtttgaaacgggatgagaaaaaatatttttgaaggtttattatttttccaaagtttcctcagccagaacattttttgttttgttctttcttttccttctgttttgtctgtttaaatggagagtcaatgcaattgttgattctttggctccttaaatcttattgtttctgtctcttagagaattttatataggactggaaggatcttctgtttgtaattagactcacgtctaggaaacaaactgcttagttataaaatttgaacttttggcagccagtgagctttggaaagtaagaactttttagtaagctgcagatattaaaagctcactctaggatttactatttttgtttctattaaaatattctttgttactttgcgtgctttgataacattgcttgataaagtgcctctaattcaattatcacctcctaaatggaagaggttttacaaggtttgttgttttgtttctgatttccttcattgtgccactcttttgaaaacccaacatttggaaatataaagtaaaaaacagaaatttcaggtgcctattactttataaaaagggttcccttaaataacgtctttgttttttttttcttcttttattttgagacagggtcttgctctgctgcccaggctggaatgtggtggtgcaacctctgttgcctaagctggaatgtagtggtgccatcacggctcactacagcctcgacctcctgggctcaagcgattcccccgacctcagcctcccaagtagctgggactacaggcgcaagccaccatgcccgactaatttttttaatttgtagagacagggtttcactgtgttggctacgctggtctcaaactctttattttttttatttttattttttttttgagatggagtctcgctctgtcgcccaggctggagtgcagtggcacgatcttggctcactgcaagctctgcctcccaggttcacaccattctcctgcctcagcctcccgagtagctgggactacaggtgcctgccaccacgcccggctaattttttgtatttttagtagtgatggggtttcaccgtattagccaggatggtctcgatctcctgaccttgtgatccgcccacctcggcctcccaaagtgctgggattacaggcgtgagccaccacgcctggctcgaactcttgagctcaagtgatctgcctgccttggcctcccaaagtgctgagattacaggcatgagccaccctgcctggcctcatagtaactgtcgatagtatagagtgtagcctgtgggacagtacaaaggttgagctttgaagtaagacttgaatttgaattccgtcttccccaagctctaattatctgatcttagccgagatgctaaacataagtagcttcaagttcctcagatgtaaagtggggataattatacccccaatatttcataatgttgtaatggggacaatgttttcttattcatttttacatccccagcacctgccacagtgcctggcatcaaaggaatgctgaggccggctcacgcctgtaatcctagcactttgagaggcccaggcaggtggatcacttgaggtcaggagttcaaaaccagcctggccaacatggtgaaaccctgtctctactaaaaatacaaaaaattagctgagtgtggtggcgcgtgcctgtaatcccaactactcaggaggctgaggcaggagaatcgcttgaacccaggaggtggaggttgcagtgagctgagatcacactactgcactccagcctgagtaacagggtgagactctgtctcaaaataaataaataaataaataaaaaatacaataaaggaatgctgaataaatgggaaagaaagtgtttggtacgtatctagtgaattagtaagtattagtatctgcttaacataaaacataagagttggccaggcgtggtggctcctgcttgtaattccagcactttgggaggccgaggtggggagatcacctgaggtcaggagttcgagaccagcctgaccaacatggtgaaacgctctctctacgaaaaatacaaaaattagttgggtgtggtggtggttgcctgttatcccagctactctagaggttgaggcaggagaattgcttgaacctgggggatggaggttgcagtgagcctagatcgcagcattgcactccagcccaggcaacagagcaagactccatctcaaaacaaaaaaacaaataaaacataagagttaagaaaacttttaagtcttaccaattgggatcatgcataatgcattcctgcatatttctggggtaatttaataagttttcttcctgttttagaccaatataaatatccggttaagactaagcaaacaagaagactagctttttgaagcctaatttgtttcctcttattcagaataaaaaaaaatttgaagaaaaactggactgaaatttgtttttgctctgatatataaaatttacagaaatgtctcaagaatagtcataattttaaagatcaaatggacagtgagatactacctcacgcctgttaggaaggctattatcaccagaagtcccccaaataataagtattggtgaggatgtggagaaactggaaccctcgtggactgttggtggcaatgagaaatggtgcagctactatggaaagtggtatggcggttcctcagaaagttaaaagttgagttaccatgtgacccagcagttccacgtgtgggtatatatccacagtaattgaaagcaaggcctcgaagagatatttgcacaaccatgttcatagcacattgttcacagtaggtaaaaggtggaagcaagccaagtgtccatcagcggatgaatgaacaaaccaaatgtggtatatacgtgtagtgaaatattattcagccttcaaaggaggaaattctgacacatgctaccgcttgaatgaacctgaaagacatcatgctaagtgaaataagccagtcaaaaagacaaatactctgtgattccacttacatgaggtacctagagaagtcaaattcatggagacagaaagtagattgctggttgccaggggctgtggggagaggagaatgggaagttgtttaaggagtgtagagttccagttctgcaagatgaaggaagttctggagattggttgcccagcagtgtgaaggtacttaacactattgaactatatggttaaaagtggttaatacagtaagttttacattatgtgtattttaccacattttagtaaatagaaaatgttgagtacattcagaatgaaagaaatggtacattgtttttcaaaggcaatttggaaatttgtattgaagaataaatgatgatggctaggcaaggtggctcacatctgtaaactcagcactttgggaggctgaggtaggaggattacttgagaccaggagttcgagaccagcctgggcaacatgctgagacctcatctttgctaaaaataaaataaataataataaagaagtcgggggttccctctgttggctttggagcccccatccctctgtctctgtacagggaagcttcttccttctcctttcttgctccttcttgcctgttaaactctctatttcttaaaaccaaaaaaataaaaaataataataaaaagtgatgtccacatgctttgagctttaatatacttctggatatttatccttagaaatatattctgaaaagaataaaaaatgctctaagcacaaaaatgatcaacataaagttatctataaatttgaaaatatagataacatttgcatgtccaactaatggggcatacaaaataaatggttgtatgtccacttgttgggttgcagccaaatatataaaaattatatgtgtaaatgggtaaggacacgtgggggagcccaggagatgatgatgatagcagggtgattagacttttaggggcacttatttttaaaatctcattttaatgtcagttctacaaaactttaaaaacccacttaaatatgctaattaaaaattattcttacccacttgtgaaagtgtgtttaccagatcctgtacttgacaatcctttgtaaacctctagtatggattttatagatattaagactgtaaaaaagtaattttagtttttatttttattttttaagagatgagatctaggccgggcgcagtggctcacgcctgtaatctcagcactttgggaggctgaggctggcggatcgcctgaggttggaaattcaagaccagcctggccaacacgggaaaaccccgtctctattaaaaatacaaaattagctgggcatggtggcgcatgcctgttatcccagctactcgggaggctgaggtaggagaatcacttgaacccgggaggcggaggttgtgatgagctgagagcaccattttactccagcctaggcaacaagagcggaactccgtctcaaaaaaaaaaaaaaaagagacgaggtctcactctgtcaccctggctggggtgcagtggcttgatcacagctcactgtagcctctactttctgggctcaagtgatcttcccactttggcctcccaagtagctgggactgcaggggcgtgccactgtgcccaactaacatttttatttttggtagagataagatcttgctctgttgcccaggctagtctcaaactcctggcctcaggcaatcctaccaccttggcctcccaaagtgctgggattacaggcttgagccaccacctctggcccataattttatttttttaaatgcactagtaaaattgggagtttaaaaacctggactagaatttggacattgcctttttttttattctttttaagattttgcttgttagtgtcaatttatctgacctttggtttgaagaatttccatctaaagaggaagataggcagctaaggagacaatgatacaataatgtgataagtgctatgatagttgcacatgtatgatgattgggtgcctggggagagtcacctgattcacacacaccctctttaaattatagcccctttttattccctctcatagctatttgtttttttcctctttcatactatattttgtaattgcctgtagatgtgttgtttgatgtctgcttctcctagactcttaacttccaaaaggataggggtcatgctcatgcatatacccagagcatggcatatagctcagtatttgctgaatgttgaatcaaagttggctttctgaaggagataaccgaagcttatcttttttttttttttttttttttttttttttgagacgtagtcttgctcttgtcgcccaggttggaatgcagtggcgtgatctcggctcactgcaacctctgcctcctgggttcaagcgattcttatgtctcagcctcccaagtagctgggattacagacatgtgccaccatgctgggctcatttttttatatttttagtagacggggtttcaccatactggccagtctggtctcgaactcctgacctcaaatgatccgcctgccttggcctcccaaagtactaggattacaggtgtgagccactgcgcctggcctaatttttgtatttttagtagagacggggtttcaccatgttggccaggctggtctggaactcctgacctcatgtgatccgcccaccttggcctcccaaagtgttggtattacaggtgtgagccacgactcccagccccaggcttatcttgaaggtgtaatagcacagagaacaagtaggggatggatatttcaggaagagaagaaataacatacttgaaattgtgaagactcaatatggccgaaatttaggatgggttaggagatgtgggaatttttattcttaaagcattggtgagtgattaaaagtttttaacaaggccgggtgcagtggctcacgcctgtaatcccagcactttgggaggccgaggcaggtggatcacgaggtcaggagatcaagaccattctggctaacacggtgaaaccccgtctctactaaaaaaaaaaaaaaaaaaaaaaaaaaaaattagctgggcgtggtggcaggtgcctgtagtcccaggtacttgggaggctgaggcaggacaatggcgtggacccaggaggtggaggttgcagtgagccgagatcacgccactgcactccagcaagggcaacacagcgagactccgtctcaaaaaaaaaaaaaaaaaagtttttaacaagatgggaggctgaggcaggataatcacttgaacccgggaggtggaggttgcagtgagccaggattgcaccactgaactccagcgtggctgacagaatgagactctgtctaaaaaataaaaatgaaaaaataaaaaataaagttttttttagcaagagacaatcatatttgttgtctagaaaaatcacttgggcaagtgtgctcagtggattagatggactccaggtttgggactccaggtttgtcccagtatagtagtccagaaagataaaaccctgaaccaaagtaatggaagtcaggaatgaaacaaggagataggctagaggaaatggatagattttgtaataggacagatatgaatattgagtcaggtcagggacacggtttctgattgggtaacaaagaataaagaggaatagtagagttatgtaaataatagttctagtcttgcacatgttgagtttgggtgcctgtgaggcattcaggttgagatataacataggcagcactgtgtgcttggtacctaaatatctgttgaatgaaaaatgagaatgatgtgtgttggatcgcttgaatgtattcctctgtaagtggttgtagtcttgggaatggttgagaatgtccagaaaaaatggatacaattttgttgactgaggccgggcgtggtggttcacgcctgtaatcccagcaccttgggaggcccaggcgggtggattacctgaggtaggcagttcgagaccagcctgaccaacatggcaaaaccccctctctacccaaaacacaaaaattagccaggtgtggtggcaggcgtctgtaatcccagctacttgagaggctgaggcaggagaatcgcttgaacctggggaggcagaggttgcagtgagccgagatcacgccattgcactccagcctggatgacagagtgagactctctgtccccaccccaccaccccaccgccaaaaaaaaatgttgactgaaaggagaagtgactaggatcagaactctgggtaaaaatcagtaattgaacagagaaaaataacttgtgaataagattgaaagcacaattgcaaaatcatgggaaaatgagcaaatagtgtcacaaaagccaagtaggaagaatttcatgaaggaagcacttaaaaatgttgggaaaaactccccaatggttaacatttatagagcacttactctgaagtaggcactgggctgaatgttttacgtgtattatgtcctttaatccttacaataaatctatgtggtaggtgcctctgttacccgctttccacaagtaaggaaatggaggcttagataggtaaagcagccttccagtttcagctcaaaaggtaagcgcttggaagtcatcactccggttgctcctggagccataaactgcaagaaatatttgttaattttgacaaattggtggaggctgcgtgtggactgtcatgagagtgagaaactcctggaggcctgcagtcttaggcggtccctcacacttcctccggttttactcctaggaaccccacggggttattctggtgaagagccaagcaaggttggtttaacaggggaaggggaaagcaacgcttttgaaatatgctagtgcattcttcataaaaaggccaatttcagtggccgctagtctggtcttatctcaacggatggaaaaagctgaaaaacacttgtgaaggtcacagcccattgacacaggtccactaaaagactgagatttcatcgtaagttgatagaattctcctcacccatccctcaccaccacatcaacaggaatacaactcagaccaactgacagcggcttgcagctggaagacctacaaggtggagactctatttaaggacaagttcttagggaagcctgaagaggaatctggcacctacagctacagcaaacattaaacacagccctactcctagccagattggggtaaagcctcacactagtagctgattactatcatgtctggcttccaacaaaaaatgacaagacatgctaataggcaagaaaaacagcccgaagagacaaagcaagcatcagaaccagacttagatatatgataatgggtgttttgtaattatcaaggaatttaaagaactgtgattaatatgttaaaggttcaggccgggcttggtgacgcatgcctgtaatcccagcactttgggaggccaaggagggtgggtcacttgaggttaggagtgtgagaccagcctagccaacatggcaaaaccccatctctacaaaaagacaaaaattagccaggcgtggtggcgtgtgcctgtagtcccagctacttgtgaggctgaggcaggagaatcactcggaccctggagtccatagactcaatgtggctgaggaaagaatcattgagcttgaaggtatgtcactagaaactttccaaactgaattgcaaagagagaaaagaatgaaaaaacaacacccaagaaccatgggataatttaaaaggtgtgaaataacatgtaattgaatgccagaaggaaaagaaagaatagagcagaagaaatatttgaaaaaatgggctgagcgggcccagcactttgggaggctgaggcgggtggatcacctgaggtcaggagatcgagaccagcctggccaacatggtgaaaccctgtctgtactaaaaataaaaatacaaaaaattagccaggtgtggtggtgggtgcctgtaatcttagctacttgggagcctgaggcagaagaatttcttgaatccaggaggcagaggttgcaatgagctgatatcgcgccattgcaagagggtgagactccaatctcctagggaaaaaaaaagaagaaaatcatctggaaagcttgttaaaacatagattgttgggtctcaccctcagtaatctggagtgagggggtctggaaatttgcatttctaacaagttaccacaggatgagcatgctgttaagaaacattgatctaaaatttaaagtgaattttgccatttcagtgtatttccttctaggttttgtctaggcagatttgtattttgttttgttttacaaacttgagatgatattgaatatggttttatgtccagcttttttcacttactattagaaacattttttcatgtcacaagtatttcttaaagacatataaaggagttgcattcattatattaggttggtgcaaaagtaattgtggtttttgctattaaaagtaatcgggcctggcgtggtagctcacacctgtaattccagcactttgggaggctgaggtgggcggaccacttgaggtcaggagtttgagaccagcctggccatcatggtgaaaccctgtctctactaaaaatacaaaaattagccagttgtggtggcgcatgcttgtaatcccagctactcgggaggccgaggcaggagaatcacttgtactcaggaggcggaggttgcagtgagccaaggtcatgccattgtactccagcctgggcagtagagcaagactctgtctcaaaaaaaaaaaaaaaaaaaagtaaccggaaataccgcaattacttttgcaccaacttaacctaacattaatacttatggtcactatgatttacttaaggtttgtctaactgttagatatttaaattgtttaaaaatgttctgttgtaaatgttcttatacaaggattttttttttgacccagctttgatcctcatcctctacccactttggaaaaatttcttttttttctggagagacagggtttctctctgtcatccaggctggagtgcagtggcccaatcttagctcactgcagcctcaaactcctgtgctcaagcggtcctcccacctcagactcctgagtagctgggactacaggtgtatgccaccgtacctggctaatttttttggggggggggaataattttgttgaatcccatctctggtgggtcttcctagttacagaggataacccaatttcccaattctgtgagtaccttgtgatccttttgtattaattacattatttctctccaattttaaagaaatcaatcatagacccacatattgccattcagagcttatgatcaggataaaatacagatttgcttattgtctctctatcctgttacagtggaaatgataggaaactagatattttgtttcttttgttactaaatccctggatttagaaaatgtgtaggatatagtaatcactgtaaatatttgttgcaagaatgcaggaaccaggagtagcacattgatggcaccttgcatcttcttattaagagtaaatgtatttttctgtgaatccttttaaaatactgaaaataggctatgtgtggtggctcacacctgtaatcccagcactttgggaaattgaggcaggtggatcacctgaggtcaggagttcgagaccagcctggccaacacagagaaaccctgtctctactaaaagtataaaaatgagccaggtgtggtggcacacgcctgtagtcccagctactcgggaggctgaggcaggagaatcgcttgaacctgggaggtggaggttgcggtgagccgagatcatgccactacactccagcctgggcgacagagcaagactctgtcaaaaaacacccccccttcaaaaaaaaaaaaaaactccctcaatttcctgacacatacgtgtttatctgtacttactggctccttacaaaaacctcttacctggtttacttgttttcatttattatgctgtaaatctggttattggttaatgaattctctacctaaaatccttaatgtcttcccattacccttaggatagtctgaattctaacaaaacagacaaggatgtcttctgtctccagggttttttttttttttttttttttctgattacatgtgtggtatcaccattcacgcattctacacttcattatacgcttcatcatagagagcaatttctttgttgttcctgtaatgaaagtgctagcctgcgcacatattgtttccttatcccagacttcatttagtaaatagcattgcttagtggttaagaacatgaagtctgtagttaatccttatgggctcaaattctggctttgccactttagagctggataactttaggcaaggtacttaggtgttctaatttcttcacatgtcaaatgaggagcatagcagagcctgtcccatgtggtggtaaaggatgttgtggagaacttcacatgccgtaagagctctagaaatgttatgagtccttacttaccgtgttaggcctggtgctagatgttggggaataaaacagatttgggccctgtcctcttagatattgctgtagaggagagaaccattaaagagttacataattattgggccaggtgtggtggcacacacctgtaatcccaatactttgggaggccaaggtgggcagatcactcgaggccaggagttcaagaccagcctggctaatgtggtgaaacccccgtctctactaaaatacaaaaattagccaggcatggtggcacacacctgtaatctgagctacttgggaggcggaggcatgagaattgcttgaacccgggaggcagaggttgcagtgagccgagatcgtgccactgaactccagcctgggcaacagagggagactccatctcaaaaaaaaaaaaaatacataattgttataagcagttcaaaaaagttcagggttccacaaaagggacatctgatttaaatttttcttttttctttcttttatttttttttcagacagagtttcactcttgttgcccaggctgaagtacagtggcatgatctcagctcaccacaacctccacctcccaggttcaagtgattcttatgcctcagcctcccgagtagctgggattacaggcgtgtgccaccatgcctggctaattttatatttttagtagagacggggtttctccatgttggtcaggctggtcttgaactcctgacctcaggtgacccgcccacctcggcctcccaaagtgctgggattacaggcatgagccaccatgcctggtctgatttaaatttttcttacttcagtggctttgaatgtgacatttcctctaccaaaaactactactagtaacagatggaactgcgaatttacaagcctgaagtaagaaaggagcatagcttattagaggagttgcacgaggctccattgtggctggaatggagacatgaaggtgggaagaatggtgtgaaatgaagtttgaaagtaggcagaggccaggtctttgtgaagaccaggtcagggaggctgacttctatacaagagcaagagggagccattggagctttttaaacagggaaatgatacaattcattatgtttttaagaggtcacttggccagatgtgatggcacgagcctggagtcccagctacttgggaggctgaggtgggaggattgcttgagcctagaagttcgaggatgcagtgagctatgatcacacctgtgaatagccactgcactccagcctgggtaacatagtgagaccctgtctcaaaaaaaaaaaaaaaaaagatcacttgcttgcactgtggaagggtggagcacggcaagagcagataatgatggtggtgtcttggattagacagcagcggaggaaatggcagagaaggtttgagagtcaagagagtctaaacgtttttgtgactggatgtggggactggaggagacagggatgaatgaacacctttcagtccaacttctgactcttgcttctcatctttatctaaggtccatcctcaagtctgaggtgggtgccactcttgtgcctccgtagggctgtctgtgtatgtcactaagttttagcactgatctgttgtgatttactatagctggtctgttttccttttaagttagaatgtatttatagtagatggtagctgatcaacaaacatttcataaatgaaagcacagattaacataaaagtagatgatgattgagtacagtatttctttctttttttttttttgagatggagtcttgctctgtcgctctggctggagtgcaatggcgcgttctcagctcactacaacctccacctcccgggttcaagcaattctcattcctccgccttccgagtagctgagattacaggcgtgcatcaccacacctggctaatttttttttgtatttttagtagacatggggtttcaccatgttggccaggctggtttcgaactcctgacctcaagtgatccgcccacctcagcctgccaaagtgctgggattacaggtgtgagccacagctacggtatttcattttaagcctagtgttttggtggtatattgtctttggatcaagttgtttatgaaaaaagaattctcaaagaactattcctaccacctctctcccctgacccccccagccaaaggccaagaattggattcttgatttttttttttttgacagcatatgtctggaatatgtattggtattaattgggtcaaatagaacaataacattatctgtactttcagttaattaaccttgagggcatttctttaccttcttttttgtatgctttaaacagttcccatggtaagtattcctcttggggcttattattttatcttaatttctgtaggtgggattttgagtatctaattagatatttaaatatgtaaacagacatctccatgttagaaaaaactcagctgcactatttgtttaaaaaacttctcttatatccttaggtgatttgacttgtgttttgttatgactgctcctttgtatttattatcattaatttgttctttcgaaattaagtttaactttttttgttgtttttctcctatggtttagattttaacttagtgcaatatgtagttttttagtctttgcagcatttccattgatggaaaacaaatacagtgtgaaattgttggctttcatatacccaatatggaattaaagtgaaaagggaactatttaatttattatttttttaaatgagatcgggtcccactatgttgcctaggctggccttgaactcttgggctcaagcgatcctcccgccttagcctcctgggtagctagagaattattatataatggtataacttgcctcaactgggatttttatcaattaagtggcattttgttattatattgacatactaatttagttatatttattttataataagcaacactgctgtttatattttgtggcctattagagtaggaacaactaaaaataaggtaaataatatatttttaaaggagcatgaaataaaaaattttatttaatatttaggaaagatgatatgcgtatccaacccattgcaaaaattatagtaattgctagttccaaaatattgttagtgaaatgtcatcagattcctataaggcttatatcttcatgaaaagtaatgctaataacactgagtgtgacattagacctttgcctgttttctctctttccatatatgcttcctgtgaatgactaatagaaaacttattttctctcaaccaaatctgtgtaacttactttcctgagatactaggcaacttccctacgttacaaaaaattagtaatgataatgggtaactttgattgaatattcctatagttcaggtggtaaccctcaaaacaaccttgtcagctagatactcgatattgtgcttttcacagatgagaaaaactgaatatttgagcagttatttatcctaaagattacagagctatgtacgtatgaatatgtaagaatatgatctttaaaccaggtggtctggttctagagtctgtgatcttaaccatgacactgtattgcaacctagaaatggtggcaaaatttgttcaaagtacaatgttaataaagtaattttgatttatttagttattatttatttattttttgtagagacaaggacccactttgttgtccaggctggtcttgaattcctgggcacaagcgattctcccaccttggcctcccgaagtgttgggattacaggcatgagtcaccacaccaggccaataaagtaattttaaaaattaactaaagtccatactttactcagattttcttaatttttacctaatgtccttttctgctccggagtcccatcaaggacaccaggttaccatttagttgctatggctccttcggctcctcttggctgtgatcgtttctcaggttttccttgtctttaatgacctccttgacagttttcagaatgggtcagaatgcccctctattagaatttgatgtttgtgtcctgattagactggtggaatgggattttaggagggagaccacagagttaaagtaccattttcatcacatgacatcaaggttatgtactattaatatcaatacaattgatcactgttgatgttagcctcgatcgcctggctgaggtagtgtttgtctggtttctccactgtggtaactctgtctccccattccgtagtctttggaaggaagtcatatgtgcagcccacactcaaggagtatggagttatgcttccctccttgagggcagagaatctacatgaattatttgaaattcttctgaacagaagatttgtatcttttctcctatatatttatttacagtttcctctattcatggtttggctttccgtggttttagttaactaaggtcaaccaagatctgaaaatattaaatggaaaattccagaaataaaccattcattttaaattgcatgctattttgagtatcatgacgaaatctctctctgtcctaccaggatgtgaatcatcgctttgtccagtttatccacattgtatatgctacctgtctttaatcattgacatcttctgcttctgacatttaaccatgaacattgtcatggctcgggatgacccgggatctcccaaggcaggtgctcttccttttggtgtatcatcaggtcaacagtagcctgacactgcatcatggtgctctgtgtcattcacctcacttcatctcatcacgtgggcattttatcgtctcacatatgacaagacgcatgagtacagtacaataagatattttgagagaggccattcatatagcttccattacagtatgttgttatgattattctattttattattggttactgttgttaatttcttaatgtgcttaatttatcacaggcatgtatgaataggggaaaacatagtatatatagggcttggtgttatctgaggttttaggcacccactgcaggtcttgggacttatccctcgtggataaggggagactactgcacttgatcattcattcctgtcagtatggacacattggatgtttattttatactttgggttatgagccagtactactttattcattttgttgctcaaattgtttcagctttggccattggaagctcttttcgctggctcctatgtcactatgacatagccccatcaaggtgtggtgtttttggggggttttattgagacagtgtcttgctctgttgcccaggctggaatctcgatttactgcaacctccgcctcccaggctcaagcagtcttcccacctcagccttcctagcagctgggactacaggcatgagccactgcgcctggcctaatgtgggtggtgtttttttttttgtacttctactactactactactactgctaggatctagttctactcagtacttctggcaccaaatgtgtgggttttccacaccaaacaattctccagttccctgtggacaccaactgggagtcctacaattcaactcaatttaataccaactacccagagttactacagatcccacaggttaaggatttggtcccacaagaccattccctaggaaagtaggctaactgctgattaaaggtagtggatccttaagttactcacacttcagttagatgtggctacaaattgggggtttccataacccccttcttagttccataatttgctataaaggttcacagaactcaaggaaacactttgtttaacatttactggtttatcataaaggatgcaaatgaagaaacagatggagtgacataaagggtgcggtgagctctgccaggtaccccagctgaggagcttctgttctgtggagttgggtgcactattctcccggcatgtggatgtgcttgccattccagagctcttggaacccctttgtttagggtttttgtgggggttccattatgtaggcatggttggttcgatcactggccattcgagattcgctcaatccccagcctcttccctctctggaggtcacagggtggggtcaggtttggggaatgagtcagaatttttggcagataatttctattttgtattagctttctggattattctgattccattattgtaacttgtttactatggtccagctttatgccctttgtatacattatgacttttaatcctcgtaacagccctgtgaggtagagaaatagagcagtaggagtcagggcctgtttggtcagcattttgctattaccacctttttaaacttttataggagtggctctgaatctctagaaagtcatgtaaagatcttgatatttatttaaaatcataaacaaatattcacaaggaaactttttttcttgacattcagtatgttttaagtaattttcatgtggttcgagccttgtaaaggtttttctggttttcatagtgtagaaagtaaagaaagctgttacaattgactgtctggactgatttattcaagagaaaatcacttggtttatagaaggcctttaacattttgtgagtatgtgttttaaaccaaaacccatagataggaagagccgacagggagctggaaactgcaataagctttcttctaactagcaaacgcagttgacagacatctttttatagacgtatctgtgattgcacgctgtttttaggcttgataattttttcaacaaggaaaaacttttcttcaatttgaaaaagctgtttacagtaaaatggcaaagtatgagaagacagaaagccatcctgctcattctaaagctaaattgggccacatttcccttaaagtatagacaacagcagcagtggaacacagttaagtgtgtgtttagtgaaggaaagttttttgaatactgccgccacaataatttttcaaaccttgaattctttattgagaaagtgacaaatcagtgagagagggaaagggaaaagaaaattaattgaatttgcaaaatttcttaaacaactaggattacagaagtaaaagaatgaatttgaaggctgggcgcagtggctcactcctataatcccagcattttgggaggctcaggcgggcagattacaggaggccaggagtttgagaccagcttggccaacatgctgaaaccctgtctctactaaaaatacaaaaaattagctaggcatggtggtacccatctgtaatcccagctactctggaggctgaggctggagaatcacttgaacctgggaggcgaaggttgcagtgagccgagattgtgccactgcaccgcagcctgggcaacagagtgagactgtgtctcaaaaaaagcccccaaaaaaacaaaaaacaaaaagaatgaatttgacgtagtgcctgtgtcagttagctattgctctgtaaccaattactcccaaatctagcagctaaaacccacaaatatttattatctctcataatttctggctgtagctttactgggtgattgtgcctaagggtctctcatagtctggggctcactcacatgacttttggcaggaagccttggttccttattggttgttggctggaggcctcagtttcttgacacatgagactctctataggccacttgactgtacatgcaacattgcatctggtatcccatagagtgagtcattcaagagacagaaagagatgacacagaagccacaatatcttttataacataatctcagaagtaaccaaacattacttttgctctattctattggtgacataaactaaccctatataatatcagtggtgactgcgcagtggtataaatagcaagaggtgagggtcatcgggaaccatctcagaggctggctaccacagtctgccttctggcctccagtgattcacgtttctcgcacatgtagaatgcactcactctctccaaaggcccactagaatgggccttccgtcccattacagccattacagcatcagctcaaagtccagaatatcatatctaaatcaagcccaggtggtaatgaggttccttggctgtagctacttatgtatgacttcttgagtggtttctcttgatctatagacctgtgaactagagagatgttacttgccccttaccactcaacatacaatgggaaaaggtaacatccacagacacttctatcaaaaaagaggatgtcttcgtgtatttgtgctgctgtaacaggataccacagactaggtaacttatgaagaacataaatttatttctcacatttctggaggctggaaagtccgagattgagggtctgcatctggtgagggccttcttgctgcatcataacatggtagaaggcatcatatggggatggggaaggaggctgaactcattcttgttaaggaacccactcctgctataacatacgtgctcctaagataacagcattaatccattcatgagggcagagccctcgtggcctaatcacctcttaagcttccacctcccaaaacttgcatgggggtttcagtttccaacacacgaactttggggatacattttttttttggtatactttttggtattcctccatagtaaggaggaaatgggaggaacacaggagtcgtggttcataaaactgagcctggcaagtattggacatttattgattaggactcagtcttactgtccagaagtgattctaggtggcctttagctctgtcccctgagctcttggttagactctttgtcatcttttcttttacgagaagtagtacatgtttacagctaagcagttttctaagcctgattcctgtcaatagaagttttgggagtccaaagaacgtttttccttttgtaatctctttgtcatttttagttcaggcttaaggtgtttctgcaaatagcttccttttaaaatttttcataggtctcccacgaatcttattgtccattagacaaaagccatatacacaaatttgtttgagataagctgttctctgtctttggctcctactaagatagctaagagacattaaacttctttttttattttttttcttagatggagtcttgctctgttacccaggctggagtgcagtggcacaatctcggctcattgtaacctccgcctcctgggctcaagtgagtctcctgcctcagcctcccaagtagctgggtctataggtgcatgccaccatgcctggctaatttttgtatttttagtagtgatggggtttcaccatattggccaggctggtctcaaactcctgacctcgtgatctgccggcctcagcctcccaaagtgctgggattacaggtgtgagcccctgcgcctgggacattaaacttctttttaaaccctgttgtttgagtgaaaggatctgtaagactcaccctcaaactttctagagattctttgctagtctgaatgttgccttgatgcaccacatttggtaattctgaagtcttaagaaaggactgtagaaccatatactgtattatgttttcctggcagtgccctaaatttgatctttaagaagccacttcttagtgttttcttgccatctggagatctagggaattttcacaactagcaattcctggctccttgttgtttaacaggctttcctttaggttatctctcctcttgtattttattttttgtttgtttgtttaaaagagacaggttctcggccgggcgcggtggctcacacctgtcatccccacactttgggaggccaaggcgggcagatcatgaaatcaggagatccagaccatcctggccaacatggcgaaaccccgtctctactaaaaatacaaaaattagccgggcgtggtggcaggcgcctgtaaccccagctacttgggaggctaagtcaggagaatcgcttgaatccgggaggtggaggttgcagtgagccgagattgtgccactgcactccagcctgagtgacaagagcaagactccatctcaaaaaaaaaaaagagggacaggttctcactctatcccccaggctggattgcagtggtgcgatcatagctcactgtaaccttgaactccttgggctcaagcgattttcccacctcaccttcccgagtagcaagaactacaggtatgtgccactgtgcctcactatttttaaatttttttgtagagatgaggtctctctgtgttgctcaggctggccttaagtgattgtgatcctaccacctcagtctcccaaagtgtggatgacaggcatgagacaccgagcccacccatctcttgtattttattatgcgcaactggaaggaaccaggaagcaccttcagtgcttttcctggaaatccccttatctagattacccagtttattttctactttccatgttgatacaggtgacaatgttgcaaaatttctgctattgcataaaaaggatctctctttgcagtttccaatgtgattttcctcactttcccttaagctctaacctagagcctacggaagggccagtactgcttggctgcaaagcctctcccacatttttaggcatgtgttacgccagctccccgttttcccgtaccatacctctagatgttatctagtactattacctattagtcatctattttgtggtaacaaattacccccaaaacttagtggcttaagacaataaacatttattttttcacacagtttcttagggtcaggaatctagaagttgtttaattgggtggttctggctccgagtctctcatgaggttgtagtcaagatgttggctggggctgccgtaatctgatggattggttgggcagagactctgctttcctggggtttcccataggctgcttgagtgctgcttgagtggggttacccataggcagctggtttcccgcaggactcgtgataagaggggtgtgggggggccaacatgaaaatctagtatgaaagtgatgtgctgttacttctgccatattctgttggtcccatgggtcagccctggtgtattgtgaaaggggactgcacgaatgtgtgaaagccaggaggcgggaatcactggaagccatatggacgttaccaggaggcaggaatcactggaagctatctggacgttgtcttctacaaccctgtcttgaagaatttcgtagcctactgggcacgagtgcctacatgttctaagcattgtgttagactgtcacatgttgttgatttggcatttacaatccagaaaggaactgctacccccagttgaagtttaaagagatcaagtaacttgttcacgacagattcgaatctagcctgggaataaacgcttggagcctaggccttaggtaaaggagtggataaatattctatagcatcattgcctttgtatttaaatatgaattttcttcattatacttatgtttagcagcagccatttaatgtctattttatatgtggacacctctgctcaactgttttttcttgtattcccttctccatgcagtcaccccttggcatgtggcggggataggctccaggacctcctgtggataccaaaatccacggatgctgaagtcccttacataaaatggcagaatatttgcatataacctatgcacatcttcttgtatacttcaaatcatctctagatcagttataatacctaatacaatgtaaatgctgtataaatagtttttatactgtattgtttagggaataatgataaggaaaaaagactgtacatgttcagtacagatgcagttttttccccaaatattttcaatatacagttgaatccatgggtgtacagagggctgattgtgtagctctgacctttttattttttttaacctatcctatctcgttcttctactgactttccttccaacactttccatagagtcctttggagcgtcagacttactctaacgtgaataaacttctttacaaatactctttttatagactacccctctcatctctgtcttaactaaatcctggctttcctgctagaatgccactcttcggggaccatcttgaatgaaagctgttcattcttccataccattttgtcttcaagccagtaagctgaatcagtctacttccaattccaaatcattgttctttcaccctcatgtaaaaattcttcttcctttgaaattcgtgccatctttttttttttttttttggtttatttttattttttgagacggagtttcgctcttgttgcccaggctggagtgcaatggtgtgatctcggctcaccacaacctctgcctcctgggttcaagcaattctcctgcctcagcctcctgactagctgggattacaggcgccctccacgacacccagctaattttttgtatttttagtagaaacgaggtttcaccatgttggccaggctgattttgacttcttgacctcaggtgatccgcccacctcggcctcccaaagtgctggggttacaggtgtgagccactgtgtctggccctgaaattcgtgtcatcttaatcattttctgtcattctttgtcactgtcatttattagtctgcctgtagcttatcccttgtttatcaaagactttggcactcttttctcagttttctgtccatctcttccactatcattctgggtggcttcagtagccaggtggactaccatgcaacatgctagtttcatcatccttgttcttttcaactccagtgaccttcacttccacttctttccaacattttactatcatgacttttagactgtaagacactctgaaatcttgactccttcattctattgactgaccaccatctcctaatttccagaggtactctgctcccttacatatatatttattttatttttcttttttcttttgagaccaggtcttgctttgttctccaggctggagtacagtgatgcgatcacagctcactgcagcctcgaatggctgggctcaagcaatcatcccacctcagcctcctgagtagctgggactataggtgtgcaccactgcatttggctaattttaaaattttatttttagtagagatgaggtcttgctatgttgcccgggctggtcttgaactgagctcaagcaatccttccaccttggcctcctgaagtgctgggattccaggcgtgagccactgcgcccagctcccttacatatataataccggtgttggatcttaccaagatgtctaggctgacccccttcccccaattggcttatcagtcaaacaaatggctaatatcaaacgattctggctaatgaagtagaaaaggaatttattagaagatagtaggtagctcacaaaatcaacagggaagctggagaaccagcttggaaaatgggcaggaagcaaagaggcccagcagcatataccccagctaatgccatggcactaggacagtggttaatgtgctgttgctcctacattcttgctgttatttcttctgccattcccataaataattttaatactgtctctccatttttatattacctgcttaggattcaaaatcttgcacaagaacatctgattggctgagtataggtcacatgcctattcctttgctaccagggagctgggagaggaaagatctgccttctttggcttacttagtgagaaggtagacacttttctgccaatattatacataataggattccctcaaaagacaacgaatgtttggatcctgggtcaaaaaaaaaaaaaaaaaaaaaaaagaaagaaaaggagaggaaggggaggggaagaatagaaggaggagaaaaaggaggaagtggaggaggaggcagcaatattgacaaatgtctactttagcccactactggcttgggaatggggagaagtctgcctttaagcctcctgaaaaaaaaaaaaagcctcctgatccaactttaacctccaaattctcactagatgatcttgcttcttatttcaaaaataggagccattaggcctggaatcccttcacttgttgcctctgtctttaaatgtacctaatcaacattgtcttttcctgtttccctttagctatcttagtagaagagctcttccttctcttgttcaaggctaatttttccatttatattcatgatgtcatccacacttgtcttctccaggacccctcatcattaattaagccttccttcttagttaagattatttattaatattccttttttgtcagacattgctgaatacaggagatataaagatgaatttgatatagctttgaagtatttattatttagtgggaaaaagacagacacaaataattgctgtgcaataatttaatcatgattgtaattatagtagttccttactttatccatggggaatactacaccaagacccccagtggatgcctgaaacaatggatagtactgaaccctatatataccatggtttttcctatacatacatacccatgataaagtttttttgtttttttgttttgtttgttttttgaggcggagtcttgctgtgtcacccaggctggagtgcagtggtgcaatcttggatctccgcccactgcaacctctgcctcccgggttcaagcaattctcctccctcagcctcctgagtagctgggactacaggcatgtgccaccacactcagctaatttttgtatttttagtagacatggggtttcaccatgttggccaggctggtcttgaactcttgacctcaggtgatccacctgcctcagcctcccagggtgctgggattacaggcgtgagccaccacacccggccaataaagtttaatttttaaatgaggcacagcaagagctgaatactaataactaatgataaaatagattagttttaacaatatactgtaataaaagttatgtgactggtctctctctcaaaatatcttattgtactgtactcacccttcttgtgatgaagaagggatggagtggaatgacgtgagatttcatcatactgctcaactgcgtgcaacttaaaacttaagaattgtttatttctggaattttccatttaatatatttggaccacggttgagtgtgctaactgaaactgtggaaagtgaaactgtggacaaagggagactgctgcatttgtgtaatttgtttgatacatgattttctattagaatgtgtcttcagtggccaggcacggtggttcaagcctgtaatcccagcactttgggagccaaggcaggcagatcatgaggtcaggagattgaaactatcccagctaacacggtgaaaccccgtctctactaaaaatacaaaaaaattagctgggcatggttgcaggtgtctatagtcccagctactctggaggctgaggcaggagaatggcgtgaaccctggaggcggagcttgctgtgaccacagattgtgccactgcattctagtctgggcaacagagcgagactccatctcaaaaaaaaaaaaaaatgtgtcttcagtgtctaatacctaagaggtgctcaataaatattattgaatgaatgaagaggggtaagcacagggtactgtggaatcatagaggataggtacttggccctcccctaggagggaaggaagattgggcttatgtcagtggaggcttggtggaggagactgcagcagccagcaggggaaaaaaaatcaggggaaagtaccaggcagagagaggggcatgaacaaaagttgagaatggtgaggaggtggagatggtttgaacagttaggtgttaaatagagttattaacagttaacatctattgagtttacatacatacatagtatatgtttatgtatacttgttaagtactttacatatattttctcatttaatacttacagtattctttgattaaggtattattcccattttagaatagaaaaatctctgcaatacgtagggaaaatagttaacttgcccaagaccatttagcctataaaggatcaaggagggatttgttttggggtctttctggatgcaaaacctggtgctctttataaatgccatgttatactaatacagtgtggttcccaaacttggtggctcatcagagtcccctgaggacctttgtaaaaatacaaattcctggccataccccagacctgttgagtcagagtttccaggggcagagcttatagatctatatttttgggtggttcacatgtaactggcctgggactggttctctcaccctggggagttattgcaggtggtgtcaagagcaaggcaggaatagctgactagccagggaggttttcctgtgtcttgctcctgatccttgactttaccccgtagatggtggggcactgaagctgagaagtgtcatcagatacacatattgtgcccaccactttagcaacagtgtgaaggatgaagttgaaggcacaggttacaggcaataagaacttacatctttagactgctgtcttgactgagttcgtcctttttcctcacattctcaagttttctaaattttttttctcttggttctgccaacccttcagttctcttttccctagctaatttcttgaaagaaatagttatactcaatgttaggtttcagtcagttcaagaaatgttccttactgacttactcttctttgaggtcatcttccatcaataaatgtttattgaatgttatttgaaagcatggtcctttctcagattttgctttgaagtgaaaataccagggatgatttattttttcatcacgtaatcactcatatgacaatttttattgatcaccaagtactcttcatgtgtctcctttatgctagggcctgggatacaacagtgatgagataaggcctcggactttactgatcgaacatctaatggaaggtggaagaagagaccatcacacaatgacggtgttatggggaacacagggtacagtgcattcatacctcctccccatcactgtgtcaatcgcttaaccatctctctgcctccagccttgcttccttccagttaagttatcctcattgattatacatctagccagatactccctactctataaatcttcatttgatagctattgtccttaaaataaaatccaaactccttcaatgtgtcttactaaaaaaacttgagcctatccccaccttgcgtactctcattctgtttcattatagggaagttaaggagcaagaatttgaacttttccttatgtttctttagtttcttttctttctttccaacatgttcttgttctgttgcccgagctgaagtacagtggtgtgatctcggctcactttgacttcccaggctcaagccatcctcctgcctcagtttcctgagtagctgggactacaggtgcacaccagcacgcccagctaatttttgtgtttttttgtagagatagggttttgccatgttgctcaggccttagtttcttttctggaagatttttttttttttttagtattttgaattatttttaagtaagagaaaaaaaaatcaaccttgttaatataaagggtaatcacttaaaaagcacacctaagaattagtatctcaaattgttgtgtagccgccaccaccatccaacttcagaacctttttgtcaccccaaactaaagctctgtgcccattaatcaataacttcacatctccccctcctggaaactaccgttctgctttctgccttaatgagtttgagcactctaggtacttcagataagtggagtcatacaataatttgtcttgtgtctgacttatttcacttagtataatgtcttcaaggttcatctaccctataagaatgtgtcagaatttccttccttttcaaggctaagtaatataccattgtatgtgtatgccgcattttgtttatccatctgttgatggacatttgggctgtttccaccttctgtctattgtgaataatgctactgtgaacactggtgtgtaagtatctgttcgagttcccacttacaatacttttagttatttactcagaagtggaattgctagatcatatggtaatttgatgtgtaactttatgaggaactacgatactggtttccaaagaagatactattattatcaccatgtggcaagtggggagacttgggcacagagaggttaagtaacttgcccaaggtctcacagctagtacatggtaaagccaatggtggctggctccaggtcagtgctcttaaccagcaatatatacatacttactggcctcttttgtaatctctgttataattatgttttcctatttggggaagattgacatcatttggaggttttttttgagatggggttttgctctgttgagcaggctagggtgcagtggtggaattatggcttactgcagccttgacctcctgggctcaagtgatccttccacctcagcctcccaagtggctgggactacaggcatgtgccaccatgcccagctaaatttaaattttagaattttaacttttttgtagagacaggatctcactatgttgcccaggctagtcttgaactcctggcctcaagcaatcctcccccctcagcctcccaaaatgctgggattacaggtgtgaactaccgcctgttttgttttgtttttagaggcagggtctccctatgttgtcaggctagacttgaactcctgggcccaagctattagcttgctgagtagctgggacaataggcatgtgccaccttcgagttttgagaattggactaaatcaaacaatattttactcgtagagtatttccttcttggattgatttttttgtttgtttgtttctgagatggggtcttactgtgtggccctggctagtctcaaactcctgggcttaagtgatcctcctgccttagcctctggagcagctgggactataggtgtgagccatggtacccagctttggattgattttttttttacatgacaaaattgttatagttctcactcttaaatattttttagaatagttctagatgagtatacaggaaactctttaggaatttgtattctacaaaacaaaatgaaaaacaaaagtatactgacacagtgtatcagtaacaaatagcctgactctcaaagtactctcattacaaaacttagaatgatactttttttttttttttaaaggtggtatgttacccagtctcaaactcctgggctcaagtgatcttcccacctcagcctcctgagtagcggggactataggcatgtaccaccacactcagtgaattatatgttttaaaaggatattttgtatattggccatttctctaacatttcccaaaactgcatgcttttggcatctgtgctataaacttagaccaaagtagcttcagaaatacagtagaagctccccttaacgtgtgtgccagattaacataaaacagacatttcctttctaagacatgcttattctaagggcacgcagaataccttttgccattcattaagtatgatgttagttgtgagtttttcataaataccttttatcctgatgaggaagttcacttctattcctagttttcttttaaacaataaccttaagaagtattttttaattgacacataataattgtacatatttatggagcacagtgtgacattttgatatgtacacataatgtgctatgatcaaatcactattcctagttttccgagtgtttttataatgaaaagatgttatgtattgtcaaatacttgttctgtgtctattgagatgacatggtttttttgctcctcttcgttctattaatgtggtgtattatggtgattggttttcatatgttcattctcgggagaaatcccatttggtcatagtggataatcccccataaagtggctggattatgttttcaagtgttttgttgaggattttgcatttatatttataatggatgttggtttgtagttttcttcttatgtctcagttttgttttttttttaaatcatgttaatactggccttatagaatgagttgggcagtgcttccgtctcttcaatttttgggaagattttgtgaaggattggtagattggtattaatttttttttttttagacggagcctcactctgtcacccaggctggagtgtggtggtgtgatctcggctcactgtaacctctgcctcccaggttcaagtttttctcatgcctcagcctcctgagtagctgggattacaggcgcacaccaccacacctggctaatttttgttagagacgggatttcaacgtgttggtcaggctggccttgaactcctggccttgagtgatctgcctgcctcggcctcccaaagtgctgggattacaggcgtgagccactggcacccggccttattgagtttttagtaggtttacaggtactatcagagttattctcaaggtgtttacagtatggaaagtgagacaaataagtaaactgctaattataatatggtttgatagactattatgatagagatagcatgtatgctacatgattacataggagggtacttaacaaaaaagagaagggaagccttcaaaaggtcagttactcttaaacgtgagtgacgaatgggagatagccaggaaggaggagagcaatattccaggcaggagtgtccgtcacaaaggcggagggcaatattccaggcaggagtgtccatcacaaaggcactgggaaaaagcattatcactgggacactacagagacttcctgcctagtgcatctgtgtggaaaagtgtgaagagatcacatttttgagataggtaggagcctaagttcataaagggctttgtgcgcctggttaaggagtctgaatgttagtttgaaaggccttgcgaaccattggaggattttaaaccagacggtcaaattactaaatttgcattttagatcatcctagcaaaatgtggattatggtttgatgggtggaatgggaagtgagagaaaggagactaaaggcaaaaaggcaggaagtgactacattaatttagctggaagtgatgagtgtttatttatttatttatttatttttgagacagagtctcgctctgcctcccagcctggagtgcaatggtgcgatctccacttactgcaacctccacctcccatgttcaagtgatcctcctgcctcagcctgtgattacaggcgcatgccaccacacccagctaatttttttttgtatttttagtagaggtggggttttatcatgttggccaggctggtttcaaactcctgatgtcaagtgatccacccacctaggcctcccaaagtgctgggattgtagtctaatcgtaagcaatgacaatggaaatggaagggaaagaacagagttcagaagggtttataagtagatggccgggtgcactggctcacgcctgtaatcccagcactttgggaggctgagatgtgtggattgcttgagctcagaagtttgagaccagcctgggcagcatggcaaaaacctgtctctactaaaaacacaaaaattagctgggcatggtggcacaggcctgcagtcctagctacttggggagctaaggtgggaggatcgcttgaacccaggaggtggaggttgcagtgatctgggattgcgccagtgaattccagcctgggcaacagagcaagactctgtctcaaaaacaaacaaacaacaacaacaacaacaacaacaaaaaaccccagaaaggttgaaaggtgttgatgatcaaatagaattaggaagatgaatttgttagaatgagaaatttggaggactgtgatcagggaatcagtagaagatagcagtgagaaggaatagtagattatgtgtcctcaagtgatgaaccttaatagagtagtagtttttaatatgaagttgaaacaaggatgctcccagacaagtccaggttgtgggccattctgtatgatgctataaagcctggtctcttcaacaagctaatttcatgtgtgtggggaggggtggggaaggatggaggactgttttagtttcaaagagaacaaaataatatgtaacagccaaatgcagtacataatctttgattggattttagtatgaaaaaaatacctatgagacatttagggacagatggagacatttgaatatggaatagatattagatgatcttagtgaatttttgttaatttttaaagatgtcataatagcattgggattatgcaggagaatgtctttatttttaggagatatgctgaagtatttagggatgaattattctgatgtctgcaattgacttagagacagacagacatggaaagaggaatcaaaaaatggcaaaatattaacaatagtttaggcggtgggtatagagttgcttgtaacactaagctttcaacttttctgtgtgtttgaaaatttccttcattagagaagctggcaaaaaatatggcagattaggagtatggggctatgagtagcaatggggagctctctattgctaaccttccccaagtccctgagataggtaagccacgggagaatgagcagccagttctgaaagggacttcaagatgggtaatgactttggggtagtgcttctcagcttttatcactttaaaacctaaacattggccaggctcagtggctcacgtgtgtaatcccaggactttgagaggccaacgtgggaggattgcttgaggccaggagttcaaaaccagcctggtcagcacagagtgaccttgtctctacaaatgaaaacaaaaattaaaaaaaattagccaggcatggtggtctgtgcctgtagttccagctactcaggtggctgaggcgggaggattgcgtgagcctgggagtttgatgctacagtgagccatggtctcaccacagcacttcagcctgggacagagcacgactctgtctcaaaaacaaagaaacaaacaaaaaccctgagcatggaaaataatatttgtgtggcacacaatatctggtaaaactagatgagctttgggactctacatgaggcttgattattaaaaaaatcattatgttaaaaaattttgttatgtatttcattatgtaaaaaaatttataagaaaataaaacagagcattaggaaattttaaaatgatgacccttttttaaaagttccaaatgtatttaaaatgttaaaggtggaacttgagcttgcttcccaacgtgttactttttaatatcaaactttttgcttgaaatagttgtactcaattcctgattttaaaaaatctttaatatgagctcttcaatttttgatcatttactaccaatgagtaactgttcatgcagaaatgtaaaagcatttttcccaaccattaaaaaatcaaaatatgaactaggcccctacctatctcaaaaatgtgatctcttaacatgttctcacacttttttttttttttttttaaattttcagagcaagatccttcaggctgcagtgcagtggtgctatcatagctcactgcaaccttgaactcctgggcttaagggatcctcccatgtcagcctcccgagtagttgggactataagcatgtgccaccatgcctggctaattgctttttaaaaaattttgtgtgtgtgtgtatgtagaagtgaggtctcgctatgttgcttaggctggccccaaactcctgggctcaagcagtgcccccagcctggcctctcaaagtgctaggattagaggcatgagtcactgcacctggccctcgcacaaatttttgtagtttcccaaggattatgcttttctttttttttttttttttttttttttgagactgagtctcgctctgtcacccgggctggagtgcagtggcaccacctcagctcactgcaacctccacctcccaagttcaagtgattctcctgcctcagcctcctgagtagctgggattacaggctcgcaccaccacgcccggctaatttgtatttttagtagagacaggggtttcaccatgttggtcaggctggtctcgaactcctgaccttgtgatccgcctgcctcggcctcccaaagtgctgggattacaggcataagccactgtgcccggctggattgtgctttttcactgtgcctttgtcagtgatactcctgcctggaatatttcaaaccagttgaaattatatcatctaaaaacttctcctttaattaaccaatataacttggaaaattttctaataatccaaacgatttttttttttttttgagttggagtctcgctctgtcacccaggctggagtgcggtggcacgatctctgctcactgcaagctctgtctcctgggtttacaccattctcctgcctcagcctcccaagtagctgggactacaggcgcccgccatcatgcccggctaattttttgtacatttagtagagatggggtttcaccttgttagccaggatggtctcgatctcctgacctcctgatccaccctcctcggcctcccaaagtgctgggattacaggcgtgagccactgcgcccagccccccaaatgattttttaatccagttgaactgtctcatatcaattatttcaaagtaatgaagatttaatttatatatgatgcatgtgttttttgtttgtttgtttttgagatggagtctctctctgttgcccaggctggagtgcagtggcacaatcttggctcaggctcgctgcaacctctgcctcccaggttcaagtgattctcctgcctcagcttcctaagtagccgggactacaggcgtgcgccaccacgtccagctaattttggtatttttagtagagacagggtttcaccatgttggccaggctggtctcacacttctgacctcaagtgatctggccacctcggcctcccaaagtgctgggattacaagcatgagccaccgctcccgacctctcatgcatgtgtgtttagggccgcacaacaagcttggctgctactgaaaggacatatcagttacggaggcatggaagtagcccatagtatgtgaagataaagatttgggactgcttcctagagccatgagccctgtcagtttgaagtagttgcacactggaatgaacactatgctctttgggcacctggaacagaaacttctccaggagctctctactgggtaatggtgcattctgtatctggcctctgaaggagaagaccacatgatatgtcacacacttggcaatggggagcagtgggtgcctgatggcatttgttgtggttgtcgctgtgcagaacaggaggcctgccatcggagcctgtcgtgccctggtccccctgtgggaagctctggaatagactgctttctggggcctgacttcatctggccacactgagagatgagagataagaggatcagtattttggggtacccctttaatccatccactttacaggctgagtatccctttttctttcttttttttttttttttttgagacggagtctcactctgttgcccaggctggagtgcagtggtgcgatctcggctcactgcaagctctgccttccgggttcacgccattctcctgcctcagcctccccagtagctgggactacaggcacccgccaccacacctgggtaattttttgcatttttagtagagatgaggtttcaccgtgttagccaggatggtctcgatcttctaacctcttgatctgcctgcctcggcctcccaaagtgctgggattacaggtgtgagccaccgcgcccagccttgagtatccctttttcaaaatacttggtaccagaagtattttggatttctaatttttttggattttgaaatctttgcatatacataatgagatatcttgggaaagggattcaagtctaaacacgaaactcatttatgtttcatataaaccctatagacatagcctgaaggtaattttatgtagtattttaaataatttgtagatgaaacaaagtttctctacatagaaccatcagaaagcaaaaatatcactatgtcagccacccatgaggacaagctggttgtttggcatcagcatcattcctgaccctaaattgataggaattgatattgataagcaatcatcttcttacatttattcacacggaagtacttaccagtaaaaaatatgaagtaccattcatgaagtgaaaaaataatgtgttcaaggtaatgaagcagcacagtggcatcaccagaatacctgtgtcagctgttagcaacagcaaacaccggactttcagtctctgcctgcaatgctgtgttttgattagaaggttactgtatactgtacaggttgagtgacccttatctgaaatgcctgggacctccaaatgttttggttttggagcattttggatttagcattttcagattagggatggttaacttgtattgcaatgtccagtgggtaaggattcctgagttagggtagtcctagatttcagttaaggcattaattattcctgatagatgataatttgaaaaaagagactcgatgatcaagtgactttgggaaatgctgtgttgaacaaagttaagtttcatgattgtagaacattccaaagactttaatatactaatacacactataaatgaccatatagaactacatataaatattatatataaaccataatattcagagttttccagacatttttgatcactgaagccttttattgagaagctctggctgggcgcagtggctcatgcctgtaatcccagcactttgggaggtcacgggaggtggatcacgaggtcaggagttcaagagaagcaccttgaggaatgagtgttaaacagaacacagtttagaaaatatattgataagaagttattaaaaattcatgccttgcaggctgtaaatgcactttaatcagagtgccatttgttttgttcaaatgttttaaattattggaatgcacactttttaaaatatgcaaataaagtttggaaactaaaaaataaagttagtgcctgttctttagagatggaaggataaaattataaattataagttttacctatttcaaaacaaaagtcagcattatacttattggtaaaagactagtgttctagattattaataataataattatatttttataaaatggattattatcactttatgcattaatgttgctttggtagtgctggccagtgccatgagtcatgacagagaaataagatacaataagaagataatacaaaaagtattattagaaaatataaaataatcaactgaaagattttaattaatacatttttcaggaaatatataatcaatagcaaaaattcaatttttacctcaaacacttgaaattacagggctcgaaaaaatatttcatcacaatatctacaaaacccataaaatactcaggcatcatcttcttggaggattgtgtgtgacttacatgacgaacctcaaaatatgtaatatttaatttagagatctataagggatatatatatctaaatatacacctcttagatgtgaaaactattctaaaatgttaattctcaatgtatagctgattgcaatagcaataaaactttcaatggtatttcatttggaatttctaaattgtatatggatttctgtatttcctttggaataataaattggtattgatgaacattcctaaaaagaggctaatagagtggcaataaataaaatgctatggtaatggcacaagactagaaatgcaaatcagaatagaattaacagaatggacaattgatagaattaatctcaatcacataaaagatgataatacacgataaagtgcaaggaatcaagcacctggtaaagtaggaaaagctaatctttcactttgaatcacatcaaaataaacttcagatgaattactcagtgtgttgtccagtgtcaaaaacaaaaaacaaagaacaaacaaacaaaccacagtaaatctatctgtaaattgttgaagaaaatagaattaagtatttgccagacctcgagaaaaagggtgatttttctttgtctctctcttgggcctttcaaaggataagtttctcaactttacagtatgagaagaaatctcaacagatgtgactacctaaaaataaaggataatgtacttttaaaatgaccttaaatttaaaaaccaaacatcagctttgtgcagtggcagtgtcgtaaccagagagattttcccaagatactgttatggctaataagaaccttgctagttcaactgtgttcaactcgttgaatttcagtgagataaggcaaatatacaaaggtgaattgggcaggattgttcaataaagaattgattattgattataataatgaaaaatcagaaactaaacatccacaattggagggttgattaaatacattttgataaagctctataatggaatatcaggcagtcactaaaaataataaggtaatgaatatttattgagaatgaaagatccaatttattgctgagtgagaaattagattagagaacaacattaaaagtagttaactctgggccgggcgcagaggctcacacctgtaatcccagcactttgggaggctgaggcagttggatcatttgaggtcaggagtttgagaccagtctgaccaatatggtgaaaccccgtctctactaaaaatacgaaagtgagcttggcggtagtggtgcacacctgtaatcccagctactccagagactgaggcaggaaaatctcttgagcctgggaggtggaggttgtggtgagtcgagatcatgccactgcactccagcctgggcgacatggcaagactccatctcaaaaaaaaaaaaaaaaaagacaaaaaaaaagaaaaaaagaaaagagtagttaactctgggtagaatttgaagtgattttaacttaaactttcatctgtgtctttttcctccagtaattgtgtatgattttgatcatcagaaaggaaatggagctgttttcattttagaaaaacaagttcaaacaactgacctggaaaattgtttgcagtaacttcgacatagggttaagtctttattattcaaacaggtcatgcaaattgtaaagaaataattgaagatcccagtagggttgagcagagaacatgaatagacaattcataacatagaaaacagagatggtaaacaaacatatggatcattattcagattcatttgtaatcaaagcagtgtaaatttaaataatgaggtaatatttatttgttgttaaattagcaaaagtttattgctgtgttataataaagaaaaaataatatcaataaattatggtgtattattttggtaccattaaaaatggaaggttgtgtaaattatgttgcaacctggaaaaatataacatttacgtgaagtaattaaggagttaagattttatactgtaagtactaacaggtgggatggggtggagtgaggtgaggtggggtggggtgtggggggagaagagcaggattgttcaaatgaggaagatctgagttcagtccagctctgccactcaataactctgtgatcttgggcaaggtgcttagcctctctgagctttggtttctttttttctctacggttgtaaaagtatatacagtacctgacgtagaacctggtgtatagtgtttattcagtacatatttgttgagtgagtgaatggtagttattcaatgccatatataaaagaatatgtatgaagaaagattggaagaaaatacagcaaaatgatgagtagttatgttagggggaagagaatttgactgattttaaaatttcctattttctactattgggtggtattatatttctaattgaaataattacctaaactcatgcctaatctctttctttctgggtgtcctactgtatttactgtttgatacattttgacacctttttcttttctttgagacaaggtctggttctgtcgccaggctggcgtgcagtagtgtgatcatggctcactgcagcctcgacctgctgacctcaagcaatcctcctgcctgggcctaccaaactgctataggcatgagctcccatgcttagcacaatttagagacttaattacattattgtcctttattctttcactcagccaaacaccttggagttggccttaacccttttctttctctctgcacctaacataaaatttatcagcaaatcttgttggctctgctctttagaatatatccagaatctgccgggcgcggtggctcacgcctgtaatcccagcactttgggaggctgaggcgggtggataatgaggttaggagatcgagaccatcctggccaacatggtgaaaccttgtctctactaaaaatacaaaaaattagctgggcatggtggtgtgcgcctgtagtcccagctactcaggaggcagaggcaagagaatcgcttgaacccgggaggtggaggttgcagtgagccgagatcaagccactgcactccaacctgggcaacagagagagactctgtctcaaaaaaaaaaaaaaaagaaagaaagaatatatccagaatgctgacatttctcaccaccttcactgctaccattctggcccacatctctcacctggagtattgcagaggcctcctgactggtctctctgcttccacccttttcataatagccaaagtgatcagcagaccgcatcactgtgctgcctggaaaaacccttcagcggcttctcatctcattcagagtaaaagccgaaatccttaaagtagcctacagggctttttttttttttttttttttttttgagatggagttttgttcttgttgcccaggctggagtgcaatggtgcaatggcgcaatctcggctcactgcaacctccgcctcccaggttcaagcaattctcctgcctcagcctcccaacttgctgggattacagttatgcgccaccatgcctggctaattttgtatttttagtagagacagggtttcaccctgttggccaggctggtctcaaactcctgacctcaggtgaaccaccctcctcggcctcccgaagtgctgggaatacaggtgtgagccaccgcacctagccaaggcctctttacaatcaccctcaaactcatacctttctgatcttatttcttactcttctgcacttactgttctctctgcctgaaaactctgcagttgttcataaggctggttccttcccctccttcaggtgtctgcccaagggtcgccttaccacagaggcaggcctctctaagaccaccgtatcaacccattctcccccacccacgcccagcactcctcgtgtccctaccctgtttattccttcctctatttctcacaccatttgccttactatgtattttatcgaatattacgagcttatatttctttcccaataaaagtagctctatggaggcaggaatttttttctattttgttccttgccataaccttagcacattgtaagtactaggtaactgtttactgaatatatatatgagtgtttcatatatgtaagtcatagtccaaaactagtttgaaagctttttgagtaaatgtcatgttggtttttatgcctttcttcccccaactccacaagcaaagaataaggcaaggtaggcagggaacactgttgataagcaaacagtatctgtttttattggtttcactgtgcctctcaggctacgactctacccaaaggacttgagatagagaggccgctgctggaaatattctgtcaccgtgattggagtggttgagtggttccatgagtatatgcgtatgtaaacacttaattaagctgtgtatttaagatcagtgcacctttaccatatgtatattttgcctcagaaaaaatgtttacaaatacagtgtatcctttgacatctccagaggaagttaaacatgctaaatgatacataaatataaggagagggttcttcatatgcttacttattaagattgctagtctggttattagaatttttgttttgaattcaaagctaaagtaaactaatttttatttactttgtcttttgcagagataatagtagcagaatttcacaaaaaaatcaaagaggcatttgaagtctttgaccatgagtcgaataatacagtggatgtgaggtgtggaaatatttttttttttgttacacttttaaattactgatacaagtcataagatacaagagagctattttctctttttacactgtaccttggatttattatgctcttttaagtatttattttccatgctccgtaaaaggtctttgctagctattgctttgataagtactgtttcttattcttcatactctggtagaaacaatatactgtattctcattgcctgttccaacctataattgtaaactctgtgactgagatgaactctattttagctttagtgcttggcacatagttggtactcaggaaatagtcgttgagtgaaggaacagcatttgctttgtaaaacacataaatatgtattataaggccacaaataggatattgcaaggaaacagtaatgcttatgcgatgacacactccccctgtaaaatagcaaaaagaacccaaacagaagaacataaaaaggcaagagaagacatgaatactggtaggtctgaaatggaggacacagcttgggactgaaacaaaacaaacaaaaaaccccttaagagaagagattagacgctaataagaattgtagggtttgtgccacacacatcaaagaaaagcaatgaagccaggcgtggtggctgacacctgtaatccaagtactttgggaggtcaaggtggacagatcacctaaggtcaggagttcaggaccagcctgaccaacatggtgaaactctgtctctactaaaaatacaaaaactagccgggcacgatggcaggcacctgtaatcccagctactttggaggctgaggcagaagaatcacttgtacccgggaggcagaggttgcagtgagctgagatcatgccactgcactccagcctgggcgacagagcgagactctgtctcaaaaaaaaaaaaaaaaaaaaaggcaatgaaaccatcctttcaggaggccgggctaaatgagggttatttgatgagattgcaatctcaagaccagaacctagtagagaggccagcaaagcagtgggaagtggtttgaaaatggttctggaaaggaactgtttgatgcttataaaccagtgccatcagagctgcagcaccatacagctccggtggctgtggtcacattgcattctgtgggaatgacattgtggaacaccaggccttcctgtgggtatcccagtaggaaatgagtgggcagggtgctggtggtggtggtagggttagggagggggtgcagcaggcagcccggcctgcaatttgaataactaactacatgaatgacaagtgccttgacctcagacctctccttgaagggttctcctcctgggggcgggggacagaggtattgttagagaagtcagggaaagtatggcattatgagagagagggaaaagagagaaaagaaaccagcatctgcttgaggcttgtcatctaacacactacgtgtagttgggtgccagaggcttcacgtggattacctcattttaatctttttatttatgggttaagggttggcatctccggtttccagagacaaggagaaggtaaatcgtttgctccatgtcacaccaggtttctctaacgccaagtctcttgctacactgtgggcatgccacactgcccacactcccactcctactctttagagacatcaggggcttctcttctgccttcaggcttcctgacagtagcagtgaaaagaaaatctcccgatcactgacagcaatgatgccaggccttttttggtaaaagggccaattcagtaaaagaaaacgtgtttatgggctgaatctttttttccattgaaagttaaaataactttaccgaggccctgagggaaagtggatgttcttacaacctaaagagtctgctttgttaattaaagatggttactaagaaaattgttattgtttttagcattaaaatattgctgctgagtatatttgaggaataacaacatggatgaatgtagctttataatttttcctgtgttaatttgtatatcactttaaagtttataatgaatgttctcatgctgctggtatcattaccatccactctttttaaaaaattcgtttaaagatagggtcttactctgtcctccaggctagattatagtggcttgatcataactcactgtatgtaaccttgaactcctgaagtgatcctcctgcctcagcctcccaagcagctaggactaccacgcccagctaattattatttcttgtagtgacaggggtgttgctatgttgcccaggctggtcttgaactcctggcctcaagtgatagaccctccttagcctcccaaagtgttggtattacaggtgtgagccactgcactcggccactctttataaattggaaattaagctttgggaggccaaggtgggtggctcacctgaggtcaggaattcaagaccagcctggccaacatggtgaaacctcatctctcctaaaaataaaaactaaaaactaaaaaataaaaataattagctgggcatggtggtgtgcacctgtagtcccagctgcttgggaggctgaggcattagaatctcttgaacccaggaggtggagattgcagtgagctgagattgcaccactgcactccagcctgggcgactaagtgaggctttgtctaaaaataaaaaagaaagaagtgtctttgaacggagggagagatatgtaatggctcagtgggggcaggacagagagagctgttcctggagacgccccccgcccccaggcactggctgttcctcccctaactgctttatccctcaggtggaggtttggtgttacttcctgtgtagggctgatctaggtcccctgagaggtctaggtcttagaattttgtggtggctactttccctttcccttatctctgctttgcacaaattgaaatatttgatttgaaattgtattgcattagataaagggaaagtctggtattccaaatgctgggcagccaccagcccactgtcaaaagcattatgagctgggctcctgctactgcccttccacctctgaggggcagtcctgaggtctggaatcagacttcctgggttcccatcccagctccgtgactgcgagtcactttgttattctctttgtgcctccatgtacctttgcctcctaggtttcatagtataagtaattagttctcagagtgcccccaagaccctttccggggtctgtgaagtcataactattttcataataaatttaagacagtatttgttcttttcattctcactgtttccacaagtatatactggagtttttctttctttttttttttttttttttttttttagacagggtctcgctctgtcacccaggctggagtgcaatggtgcaatctcagctcactgcaacctccgccttccgggttcaagcaattctcctgcatcagcctcccaagtagctgggattacaggtgcccgccaccacgcccggctaattttcgtatttttttttttttttagtagagacggggtttcaccatgttgtccaggctggtcatgaactcctggcctcaggtgatccacccaccttggcctcccaaagtgctgggattacaggcgtgagccaccacacccagccttatactggagtttttcaaaggctacatgacgtgcagttttacaacagattgaacgcagaactagatatgagaatgcagctgtcctctgtgaagccaggtgttacatatttacattgaacgtatgtaaaacaatgtaaaacaatgccattcttctaaatatactttttgttttggaaaatatagtttaaaaaattaacaactatttatgtaaacatttgggttgatttatgatttttaaatgaattaataaatacatatttttaaaatgtaagctttaatttctaatatgatagtaaatatagatgcatataactcacacaaacatagacgctttgagcgccttgataatttttgatagtttgtaaaaggagttatcagaccaaaaagtttgagaaccactattgtgagtggacatttttaaagctcttagaacaatattagcttgggatttaaagctaagaacagtattagctattataattattctactttatatatatatagtttttattattattattttgagatggcatctcactgtgtggctcaagctggattgtagtggcccaatctcggctcattgtaacctctgcctcctgagttcaagcaattctcctgcattggcctcccaagtagctgggattacaggtgcccaccaccacgcccatctaatttttgtatttttagtagagacagggtcttgctatgttgcccaggctgttctcaaactcctggcctcaagtcatccgcctgcctcagcctcccaaagtgctgggattacagacgtgagccactgtgcctggccccattttatgttcttaaagtaaataactcagacttgttttgcccctgtttaatctggatgagcaatgttatgctgtatgtaacaaaactctcataagaactttaaaatacatattttgttttagagacaagctctctttatgttgcccaggctgaccttgaaaccctgagctcaagcgatcctcctgtctcagcctcccgagctgggactataagcacgtaccacacctggctagaactttttacttatttccgtatgttccatatcgatctcttaagatctgaagcattttattttcctttttcatttccttgttaaatagttttcgaaagctagcgccttgaaaaacattgggcaggttttcaatatcactaattagggacattctgattttgcctcatataaaacacagactttttttttttttttccagacagtctcactctattgcccaggcaggagcgcagtggagtgatctcggctcactgcaacctccacctcctgggttcaagcgattctcctgcctcagcctcccaagtaccaggaatagtgagattacaggtgtgtgccaccacccccggctaatttttttttttttccatacttttagtagagacagggttttgccatgatagctaggctggtctcgaattcctggcctcaagtgacccgcccgcctcagcctcccaaagtactggaattacaggcatgagccaccgcacccagccacattttcatttatatatattttcctgctctgtgtttagaagttaagaagactgattgaaaattaaatttttgaatagatgatatatgtacatgggataaaattctaaaggtagaaataatatatagtgataaataaatctcttttttacctatccagttcccctttctaaaggcaaagtttgttacagttttctctaattcttccagagattctccatgcaaatatgtatgagtatgcatgtgcatgtgcgtgtgcgtgtgtgtgtgtgtgcatgtgtgtattttttactgtggtaaaatatagataacctaaaatttatcattttaagtacagaatgcagtggcattaacattactctacaaccatcaccgctatccattttaggctttttcatcttcccaaactgaaactctgtacccatttaacaataattccatatcccaccctctcgcagcctgtggcaaccaccgttctgctttctgtgtctatgagtttcattatcttaggtgcctcatatatcaatggaagagtacaatatttgtccttcctgtgcttgcttgggcagcacatatactaaaattggaacgctacagagattagcatggcccctgcacgaggatgacatgcaaatttgtgaagcattccatttttaaaatacaaacaaacaatatttgtcttgtgtctggtttatttcacgtagcgtaatgttctcagggttcatccatcttgttgcatgcgtcagaattttattccttttttgaataatattccattgtatttatatcccacattttgttcatccatctgtgtattgatggacatttgggttgttttcatcttctgactgttgtgaataatgctgctatgaatactggtgtatagatatctgttccagtctctgcttttaattcttttgggtgcatatccaggagtggaattgctggatcatgtggtagttctgtgtttgatatttgaggaaccactgtactgttttccacagcggctgcgccatgctgcattcccaccagcaatgcccagagattctgttttctccacatctttgccagcacttgtcatttctgttggttttttggaggggggtgttgttgttattgttgtttctctaataaccatcctactgggtgtgaaatggtatctcactggggctttgatttgcattttcctaatgattagtaatattgaacatcttttcatgtacttattggccatttgtacatcttctttggagaagtgtctagtctttgcccatttttaaaccaggttgttttattttgttggtttttgagttgtaggatatgtgtttatttttaacgtgaatggtatgatactatataaaccattctgcactctgctttttttacttatcaatatatcttgactatttattaatatataaaaattggctgggcgcagtggctcaaacctgtaatcccagcactttgggaggccgaggtgggcagatcacctgaggtcaggagttcaagaccaccctggccaacatggtgaaaccccgtctctactaaaaatacaaaaattagccatgcatgatggcgggtgcctgtaatcccagctacttgggaggctgagacaggagaatcgtttgaacccgggagacggtggttgcagtgagccgagattgtgccactgcactccagcctgtgcggctgagcgagactcttatctcaaaaaaaaaaaattatccttatttcattgtatggatgaatcataatatattgaattaatctccttactaatggacgtttaagttgtttccaggcttttgctataatagctcatgctgcagagaatatcttagcatgcatatcatctcacaaaagtgagaactttttctcggtaaattattggaaatatgtcaaagggcttgacaatttttggtagatgttgctatcttgatgatagagtctctcatcttgtgtgagagtaccagtttcttcagtccttctgaaacaagctttaattatcaagcattgggattttttcccaatctaatatgtgaaaaatagaaactcagtgttaattttctttttcttttcttttctttctcttttttttttttttgagacagagtctcgctctgttgcccaggctggagtgcagtggcacgatctcagctcactgcaacctctgcctcctgggttcatgccattctcctgtctcagcctcctgagaagctgggatcacaggcttgtgtccacctggctaatttttgtatttttagtagagatgggggttcaccatattggtcaggctggtctcgaacccctgacctcaggtgatccacccaccttggcctcccaaagtgctgggattacagacgtgagccaccatgtccagcctaattttcattttctaaattagaacatctttcatatctcttaaaactgtttgtatttccttttgtttgacctgacagtttatgatttttccccatttcttcccactgaattattgatctttttctatatgaaaggtctcagccttagtcatgatgtgtctgtcatctatcttttcactctacttttactttctggcatgcagatttttttttttaatttagtcaaattacacacctttggagtatggatttaatttttggaaacaaacgaatgtcatttcgagtagttttagtagaataaatttaggttcccctaaataaagctaatttggtggggacaaaatacacccacaaggagtgcctctaaggtaaagaagataatttttccatgtagctgataaatttaatttgaaaatgactctaatcttattcacaaacaaatccagtttttttgtaatctaatggaataaaagtacaccacaagtccgtagagacagttgctggctctatcatgcattttctatgtgtcaccctctttttatttcattttccttatctataaaattgaaataaaaatgccagcaccacttaagccacaagagtataagaatatcaaataaaaaatatcaacttactttttttaacactccattctaatcaatttcagaacaggttgatactcaagaatttggtgagctaaaatgagatggggcccaatcctggaataaaagtgccaatctttcccctttcccaagccacacccatctgtcctgttcctatgcttcaatgcctttacagtgcgaccttatttttagtattccagactattctgtgtgatatggtttcactgtgtccccacccagatctcatcttgaattgtcgctgccattatccccacatgttgtgggagggacccggtaagaggtaattgaatcataggggcaggtttttcccatgctgttcttgtggtagtgaatcagatgattttataaagggcagctcccctgcagacggtctctttcctgccgccatgtaagatgtgcctctgctcctccttcgccttccaccatgattgtgaggcctccccagccatgtggaactgtgaatccatgaagcctctttttctttataaattacccagtctcgggtatttcttcatagcagtattagtggtatgagaatggactagtacactgtgtttactttatacctgccctatctataggagattttccctaatattttcttaatctttagacaaattttgcagtccagcagcaccaagtatccacttgctaatacagtgagtctcttttttcattgcttccatcttcaactcagtataagtctctgaggctcttggtatccaatatttatttcttttactgatagggagacttcagcttcgttagcaattggcaggaaccttgagtgtactaggtcctgtctaaaattctgtaagaaatagtaacaataacttatttgtaatggattagaaataacttttcctaggagcactggaggtaccataaatattacttttacttcttcacatatagtgctgttttgaagagatattaaaataacatttcgcaattcatgtttatcaggtagtagaaagtgtgagcaatgtggagagattgcatggacagttcccccaagacagttattatctgagaaagctggaagctactcagagagctttataaaaactgttatcgatactgggtctgcatttgtgcaatggaaaaacatggaagaggaatgggaattgctgggtccacacacccctcaataagaaatgaattgtaaaaacaggtttattcatgcagtgattgttcacatgtatgaatgaagtgaatgatgaactaagactacatgtgtaacttggataaatctcaaaaaacaacgttgaatttaaaaaattacaaaaggacggaaacatagtaccatatatatacactttaaatacacaaaataatagtaaatattgtttatgaatacaaatatatgcatggaaatgataaggattatcctcagaatagtggtgtgattgcatctgaagatgaaaggagaagggatgaggagtggaatgttagctgtttctgcaatgctttcttgtcaggaaaaaaattctgaagaaaatgtggcaagatgttaacatctgttaaatcttggtattggctgtcgtattttctcctgtacttttctctgaaatactgtacaactacacataaaaataaatatttttaaaagagtgatttatatcttatctctttaccatctcactttgtagttgctttgttaaaaattggtttcttatcatggtccttttgatgaactgggattaaagaaaagagtcaaagagaattttttaaagtcattccaaattctacttcctgaaataataatttttaatgttagactactattattctagagctctttctatccctgtgtaataaaataagtggatagaagggtgggaaattaatgagaaaggaagaaggaggaaaggaaaggaaggaaaaagatattgaagaaaaaatctaggatataatcttcatgtgggaaggacttactttaattttacttgactgggacaaaagaaaaaaaattaagttgaagaaattgtggaatctcaaatgtttgttagccataagagacgatatttattttaagttcagaaaagattttgagaaaaacattaagagactgtagtccttgtgtgtttttttaaactatctatttcgaatataaaaagtgtcagttgattccttgctgtgaaagataaggacattagcacttccaaaattctgtctacgttttctctcccaacccccaatttatcttaggtatatttttatttttacactgacaaggtagaatgttcatactttgtttagtattcacacatattttagtagttttgtatatttgaatgaaattaccactaaccacattttctcatttttttctccatccttgaattctttgatttatttttgtgtgttgattctcttgtcagtttttttttttttttcaggaagtgctcatggatgtttttgagactgggtctccgtctgtcacccaggcaggaatgcagtggtgccatcacggctaactgcagcctcgacctcctgggctcacacgatcctcctgcctcagcctcctgagtagctgggaccacaggtacacgctaccacacccagctaaattttagtttttgtagagacagggtctccctatgttgcccaggctgggcttgaacttccgggctcaagcaatctgcctgctcagcctcccaaagtgttgggattagaggcgtcagccaccatgctgagcctcttttatcttttacatgttttttttgtgcttgaatactttttacttgaatgacatcttataaatttacacaatcatttctcatggctaagaagtgttccaatgtgtaactatactagaatttaacatatttcctaattttagaaatgtaggttgtttgtaatatgatgctgctgtaattgtgactgggctagaattattagtgtggaacttttcaaagatcttatttctctcctgcactgccaaaaaataaaccctggatgcccaatttattttatctttaccttttcttaaagaggaatattttttttcttgttgggagaagagatatgtcaatcattatagttacgttctgagagtgggatggtgtgcaggataaagaagaaacccactctgaccgagactggaagaggagtttgttaaagatgtgggggaagtaagatttgagagagaggagtggaacttgagcagttacagaatatgaaggagcaatcaggaaaggggattacagcttaaaagtttttgaatagataatatgttcacatgtttaaatccaaagagaataaaattcaaagaaaagtccctgtaactcttttccaccagtcacccagttccctctaaaatattggcaaccagaatactagtttctagggatcactccagattctagccatacacaaggaaatgcaggtatattattttcttataccctgtttttactgaaatggttacttactttcatactatggtatgattcccatggagtggggtcatatctgtgatgaagcttgcttttatggcttttctgtagcgttcggggatctggaatggaggtagctctccagttcaagcttaggctaagtggcataaatgccataagggttaatgtattggaggacatcacaaagggcatggggtcggtcctagatatcccagtaggctatgttccaggctttacagatgggagttaataggaatggcattgtgacaagaaaaataacatttggattcaggcttccctcttcagggcccattactggctgttttaataaagaaggccatttctgtatctttggaggccaactttggttgactgtggattacaggtatctgtctgtttttgtttttgagatggagcctcactctgtcacccaggctggagtgcagtggcctgatctcagctcactgcaacctccacctccccggttcaagcaattctcttgcctcagcctcccaagtagctgggattacaggcacccgccaccatgctcagctaatttttgtgtttttagtagagaaggggtttcactatgttggccaggctggtctggaactcctgacctcaggtcatctgcccatctcagccctcccaaagtgttgggattacaggtgtgagccactgtgcccagccctgtttttttttttggaaaaggaatctcgctctgtcacccggactggagtgcaatgatgtgacctcagctcactgcaaccttcatctcctgggttcaagtgattctcctgcctcagcctcccaagtagctggcattacaggcaggagccaccacgcctggccaatttttgtatttttagtagagatggggtttcaccatgttggccaggctggtctcgaactcctggcctcaagtgatccgcctgcctcagcctcccaaaatgctgggatcacaagcatgagccactgtgcccagcctattgttcttattggactgtcttgatcaagtgcaaattttgctgtatgatttcaaaagtggggagccagaggctgtctgaggattggtggtttcagagagtgtacttcctgaggcctctgggtgtgtaccctctgtggcttccagattcattcgtcctgcagcctcaacctattctccttaacagaggaaatctaatattagattcactcgaaaagtgtggaagacttaatgcaaatgcaccacaaagaacagctcatggtagtttctttattagctttgaaatatagaatggacacaagccagaaagtgttactgtgtattcctgtggccccacacttgtttggaaacggggctcctttttatcattctgttggtcatgctctgtcaggttggatgggaccaaatattctttaagttttctcagttcgagcaagtttcttgtaaggacgtatttggaaataagtataagtgatagaaggtgttataagtaatccagagaggatttaaagtatatggaaggatgtgcttaggttatatgcaaatactatgccatttaatacaaggaattcatttgtataaggaatagcaaaaagtcccctcagcagcattccagcctctcagtgtactggaaggacatttattgccattagggtaacacaggggctctcgtatttcaagtcactctggtgactccacatcacctggtaatctaacatgctggtgattctactcacctgcttttatttcttcttttccagattcttcctattttgctcccgactgatttgatcctgctgtgtgtctcctactcctttgcgtctacctcctcatgggttcagatgctttgtgattctgcacctgccttctctctctgtgccgttcctcttccatctctcttccatctgtatgtcttgctttaaaactcccaaggaaaaaagaagaaaagtcggctttggtcatttgtcaatattcagtagtgtgtgcctttgttgagcagagctcaactgcatcagcccctctcttgcacacctatagagggacgccttattttggttaagtagccatctctggttcaagtatctgtgcctagggaggcaggtccaatggtacaaagcatagcaacctatacattcagaaactctggggagggaagtgtggatttggcagagaccttactgctcatctgatatagttaccccaaatcctaatgaggttgtttgagcctagtgttaggccattccaacacagtttctaggccaacagttggaactctgtggtaaactcaccggtttattaccatccccctccctggtagtgctagtgattcatgtcatggtggtcggctgtggtggagattgcatagtctaattctgtttcctctcctcctgagcacatagctatactgtaattcccagattctcttgcagatagaggggagctgggaattatggtctagctagaccatgtgacctagtttttaccaatgaaatgtggatggaggtaatgggtgctacttctaggcccggtccatggaaacctcccacgtgggaggtgcttttccctttacagcttgatatatacagtatagtgacattggaagccatatgttgaaaattatggaaccacaagatggaaggagctgggtccctgaatgagttgtcggaggaaagccatccaccgatcaggaaaatccattttggattttatgtgagccgtctccatgactattgtgttaagccactggaggctggagtttgttacagcagtggctgttatcctcacatagtggcattattgattttgctccacagggacccaaggaaggctttgggctccttaggtatcttggtgagcactgtcccaggcggaagttggttaacaggatggcccccttcagggagggctgatggggtatgggagagcgaccatcgctttgctactcctgataagcatgacataaagaatgtctctctttaagccttcctccccgaatcccaagctgtggatatcaatacatttgtatagattcatgcgagagttccagagtattctgaaactgcctctgaatttatttgcagaaaggtaggggttagtaactagtgataccactttatgcacagagcaagtaaactccatctttaccatggccaactgtagcaatagagttcagtgttttctatatcacagatagaagaagtaacaaaacttcatccatttcatcttcatatatagtaaggcgaggtgtctgagaggcaggggtgagaaagacaagactggcatgcatggtattgaaatggctgtgaaagggagaagatttgcttatagtagcagggcccaggtagcatgggaattcattacttttatctttaaaggggttagaaacaagtgttcagaggtgccatgcagtaatgaaaccagtccaggagccaggctgtaagtgctgtaattcaagtaagcttttggttaatttaaagggatggtagttacaccagctcctaacccatcgccatcttctgtttcatgtttttgattactgagaagtgacactcaaatgtttattttttcttaaaactactgagtacattttgtaacagctccagtttctactgagagctcatttatgccatatttcctttgctcacataactctaagagtacttctgttttttactgaaagcttgtatttctgtctctgctaagttataaacttactgatgacaaaatgtatttattatttgagttctgtaacgcatacaacattgccttttctctatatacagtgtgataatattagctgggggtatgtaactagttgtgtggtgttattaggaaatgaatctgtaaaggtgggctggggccattcagtgaatgatcttgtctgttgctctaggatcctggatttcattgtgtaagcaatacaaatccataaatgctgagaagggataagatgagatttgggcttttagaaagaaaaccctagccaggtgtggtggtgcacgcctgctgtcccagctacccaggaggctgagacggaagattgcttgagcttgggagttcgagaccagcctgagcaacatttcaggattaaaaaaaaaaaaacaaaaacccaaaaaagaaagcaaactctagctttaggatggtagatccattggcgtgcggaccagagcagtagttcttaatcctgggtgagcttcagagcggcctcacagcacggctagtccggtactgcatgcgaaggagcagcacagagctggcacacggcgggctctccaacccaactggacctggtgacctttatgaacccgcagcccaaagccaggcagaatcaaggaggtctccacaggtgccggtgtgggtagcttatgggccttagccacaccctggcaagtaactatcccttttcataacaaagctttcctgggcacttaccctgccaactgtattctgccgagttctcctctcccggaggcagtgagcatggaatgcccttgtctacgttgggaaaaggatataaaggattatggatgaaataccttctcccacaaacgccttctatataaaacaaaactaaaaaatttccacccactaaaacccctggctaaggccctatgattatctttctctttacagctaagaatcttaaaaaagagtttgctctttattgagcactctgttccttcttcaacgtgcaatttgtaatttcacttctatctctccgtcccatcctgttcaaactgtttttcctgaggttgttgtctcttactttatttttcatatgattgtcttttgttttcttttcttttctctcttcctttcctttcctttctttctttcttttttcttttttttgacagagtctcacttgcccaggctggagtgcagtggcgcaatctcggctcactgtagcctctgcttcctgggttcaagtgattctcctgcctcagcctcccaagtagctggaattacaggcgtgcaccaccatgcccggctaattttttatttttagtagagatggggtttcaccatgttggccaggccggtcttgaattcctgacctcaaatgacccacctgcctcagcctcccaaagtgctgggattacaggcatgagccaccacagccggcatcttttgttttcatccaacacctctgactcttttttctcagcctctgctttgggacgattatctttctatctggactattaatgtctgctagagtttcatctccatccttcttttcatttacaccctttctgggaaatctcttccatacctaaatctgtatcttaacctggaaaacatttttaaagtctatataaaaaaagcccttcttagttcaaaggtaaaattttaggaaaattaaattgaaaacttataagaaaataacaataatggaaactagatttgaaaacagaaatgacaggatgggcgcagtggctcatgcctgtaatcccagcattttgggaggccaaggcaggcgaatcttttgaggtcaggagttcaagaccagcctggccaacatggcgaaaccctgtctctaataaaaataccaaaattagccaggcatggtggcatgcacctgtaatcccatctacttgggaggctgaggcaggagaattgcttgaacctaggaggcagaggttgcagtgagccatcattgtgccattccactccagcctgggtaacagaatgagactccatctcaaaaaaaaaaaaaaaaaaaaaaaaaaagaaaagaaaatggaaatgatgttagaatctatgagatacaaccaaattaagactcattaaatgcctatataaagaaaaatgaaagcatgaagaaaatgaacagaacatccaactcaaaaaagctagggaaaataggtaaactgaaagaaagcagaaaggagaaattaatgaagataaaaacagaattaatggggttgggaaacagtgtaacagtaggaaccaataaatgaaagttttttttttttttttgcaaaagtttaatagaaagataaatcactagcagtgtcttatttgggaaaggacaaatgcaagataacttgggagacagaatgattaaaacataggaaaatttcaaatctaatgagagtcatttgtacaactctatacaagtgaatttgaacacctagctaaaatggtcaactttctagtaaaatacaatttgccagaaccagtcctagtcatatgtatatagattggaagagttaatattgttatgattgcaatactccccaaattgattaacagattcattgcaatctctatcaaaatcctggttgcctttttttttttttaaacaaattgacagttaattctaaaattcatatagaaatgtaagggacctagaatagccaaaacaatcttgaaaaaggataacaaagttggactcccatttcccgatctcaaaatttactgaaaagctacagtaattaagactgtgatactggcatgatgatgtaaggctagacacatgcatcagtggaatagaattgagtctggaaataaacccttacacttatggtcaattgatcttcaataaaggcggcaagacaattcgatagaaaaaagaatagtctttacaacacatgatgctaggatgactgaatatccacatgcaaatgaatgaagttggaccctaccacacaccatatatgaaaattaactcaaaatggataaaagggctgggcacagtggctcacgcctgtaattccagcactttgggaggccaaggcaggcagatcacctgaggtcaggagttcaagaccagcctggccaacgtggtgaaaccccatttctactaaacatacaaaaattagctgggcacggtggtacacacctgtaatcccagctacttgggaggctgaggcaggagaatcgctggaacctggaaggcgggggttgcagtgagccgagatcacaccactgcactccagtctgggcaacagagcgagactctgtctcaaaaaaaaaaaaaaagaagaagaagaagaagataaaagatctcaataaagagctaaaatcgtaagacccttagaagaaaacattgatgtgaatgtttgtgactttggattaggcagtggtttcttagctatgatacctaaaacaagcaacccaagacaaaaatagataaattgaatttcaccaaaattaaaaactttgtgcttcaaaggacactgtcaggaagataaagagacaagccacagagtgggagaaaatatttgcaaatcatatatctgataaggggtctagtacctgtaatatataaaaaactgacaacaataaaaagacaacccaattaaaatgtggacaaagtatttgaatagacatttctccaaggaagattatttaatggccaaaacatcacatgaaaatatgctaagcatcattagtcatcagggaaatgcaaatcaaaaccatagtgaaatactactttagatccactaggatggctgtaattttaaaaatgaaagatagcaaatgttggtggaaatataaaatggtgcagccactttagaaaacagtttagtagttcttgggaaagttaaatgtagagttaccatatgacccagcaaattcattcctaggcgtatactgacgagaaatgaaaaaatatgtccatacaaaaacctgtggatgaatgatcatagtagcattatttatactagccaaaaaatagaaacaactcatgtcaatcaggtgatgaatggataaatgaaacgtgatgtatttataaaatagaatattgttcagctataaaaggaatgaagtactgatgtgtgttacaacgcggatgaacctaggaaacattctgctaagtgaaagaagctggacacagaaggccacatgtgtatgacatttatatgaaatgtctagagcaggcaaatctgtagacacacagatcagtggttgtgaggaggtaaggggagggagggatggacgtagctgctaacaggtatggggattctttatggggtgattaaaatgttctgggattagatggtggtgatggtagctcaaccttgtgaatatactaaagccactggattacacacttaaaaaatcaattgatgaaaaagcaaaacaaactgatctcacaaagatagaaactctaaacacaccaatttacatagaatcattaggcaagttttcagagttctctcaccaaaaggcttcaatccagatagtttcacaggataattctatcaaagaagaacattttagctctagtgctacttcatctctttcagagaatacaaagtaagtataatgttgacaccaaaaacttaaaaaagactgcattaaaaaatcttacaaaacaatcttatgaatatctgtacaaaaattgtagataaaatgttagcaacaaaattcagtggcacacataagcaaatggagtttattccagaaatgtaaaaatagttctgtgttgggaagtttattaatgtaattcatcatataaacagatctgtgaagaaaaatcataggatcatctctatagaggcatttgacagaattcacacattcataattttgaagactcgataaagtagaaattaaggacatgatttcttagcataaaatatgtgtgtttcagcccaaaatctagtttcttacttaataaagaaggcacaaacagcattttcattaatgtcaggaataagataaagatatccgcatttgctgttattatttagtattgactagaggtattaagcaatataattatataggtgataacagacacgtaagtatttgacgttaaatggtagaaggtagaaaagatagaagaaagaactatctttattcacagatatatgattaaatatctggaaacctcaagaaaataaatggaaaaactacaaagaaaaataatatttgctaaagtatagtagggaataaaattaatacatagaaatcaagagcgttcacctatacaaacaatgcccagttggatgatataatggaaaataagactcatttacaatagcaacaaaaaagctaaaatttatagacaaaaatataacaaaaaccatataaatgctacataattcagataacttgaaatatataaaaatagatgaacaaatagacataccatgttgttggataagaggacttgaaattataaagatgccaaataattctaaattaacttattaagttaacacagtctcaattaaaatatcaccagatcttttctggacctagataagtgaattttaattttcatatgagaaataagttagcaagaataggcaagaaaactctgataaagagtaaggtggcccagcgtggtggctcacacctgtaatcccagcactttgggaggccgaggcaagcagatcacgaggtcaggagatcgagaccaccctggctaacatggtgaaaccttgtctctacgaaaaatacaaaaaattagctgggcatggtggcaggcgcctgtagtcccagctactcaggaggctgaggcaggagaaaggcatgaacctgggaggcggagcttgcagtgagctgagaccgtgccactgcactccagcctgggtgacagagtgagactccgtctcaaaaaaaaaagtagggtggtgagtttagctttgtttgatattaaaacatactacaaatcctctattgttaaaacagtatggcataatggatcaatgaaatagaaaatccagaaattgttccaagtgcatatggaaagttaatataggatataaatagcatctctgatgtgtgaggaaaacatagatttaactggatagctatttagaaaaatataaaattgggtctgtacttcatgctgtatagtaagataaagtttgtgtgcaacaagtatctaggtttaaaacaaaaccttgttaagtatttaaaaatatgaatgaattccattataaacttggagtaggaaaaataactcaaaacaaaagccagaagtagaaagattttaaaatttaataaaattttacataataaaatttcaagccaaaaaagaattataaaatcaagagataaataacaccttgagaaaaatcttacattgtaaatggctaatatccctgatattgtgtaaaagtggtaactcttttaaaaatatttgattaaccagaaatttccatttcttgaccacagagaaaaaaggaatctagtatgccattattttgaaatttaatcttttcagtgcacccccttatttactgcattattcacaatagccaatatagggaattaacctaagtgtccaaacgaatgaatggataaggaaaatgtgatatgtttacacagtgaaatactatccagtattttaaaaaacattttattttgaaataattttagagttatataaatgcaaaaacatagtacccaggatgggcaacataatgaaaccttgtctctacaaaaaaaaaaaaaaaaaaaaaaaaaaaaaaaaagccaagtgtggtggcacagtgcttccagctgctcaggaggttgaggtggttggattgcttgaacccaggagctcgaggctgcagtgagctatgatggcatcactgcacttcagagtgcaacagagtgagacgctgcctcttaaaaaaaaaaaaaaagagtttgtgtatccttcaccccattcacatcttacataactacactacaatgatcaaaaccaataaattaacgttggttcagtaccatcaactgaactagagatgtactggagtttcaccaatttcccacgaattccctcctctctcccaggatccgtgcagaacgctgtcctgcgctgttgtcttgtctctttagccctccagtctgtgacagttcctctttcatcaccttgatacttttgaaaaatcctgctgaattcttttttagaatgtccctcagtttgggtttgccagatattttcctgtgattagattgagccagtatatttttggcgagaatactacacacaagtgagtttgtgcccttctcagagcatcatgtcagggaatacatgatgttgctctgctttagtactgatgatgttaaccttaattgcttgcttaagatagtgtctgccaggtttccccacagcaaagttatgaattttccttttgtatttggtaaataccttggaggagatactttaagactgtgcaaatattgattcccctcaaactctggcccacaagtagcatccgttggtcaatcttgcctgtgaatgttattactgtggtttttgccaagcggcgttttggtgttatttttaaaaaggaaattccaggacagtgggcttgttctcattttgttgggcagtcggcagccattgggcaatgtggaatttagaattacttaggcctttcccaacacagaaaaatgccatagtctattaattcagtaaacatttatggaacccttgttatgaccaaggcctcttggtgaaatatgcagacagcataggatctggtctgcacctgagtctttttctctgccactacttttcaccttgaatcacactcgccatcaagatttgttctaagatgttattgcaaaaagtgctgagagacaagtccaggagtcagaggataggaccaatttccaattttgccccagactagctacgttactagcagggcgagtcagatatcgtctcaaagttctagtctccttatttttaaaatagggaatataatatagattgacattagaattaaatgagtggatatatatgaaagtactgtttaagtgaaaggcatttttcaagctataaagtgttctacaaattaattattgtctgggcacggtggctcatgcctgtaatcccagcactttgggaggttgaggcgggaggatcgattgagcccatgagttcaggaccagcctggccaacatagtgaggccctgtctataaaaaacaaacacacaaacatgaattactcaacaaatatttgatttcttattaagtgtgagctttttctaggtgttagaatatagcaatgaaagccaaagcctctgccctccaggaacttatattttagaggaaaaaggtggataatagaaaagtaaacaagtaataaatacaatttcaaatagtaataaatgctacactgtaaataaaacaggatgatgtaacaaaatgtgctataaagaaaataaagtaggataatacattagagaattggggtgtgtttaggtgggatggaatagtttagacgttctggtcagggagtgcgtctctggaagtaattttcgagataagaactttaagattaggagtcagctgtgtgaagcaggggagagcaaatataaaggccctttgaaggggaaaggattaggatgctggagaaaagcaaagaggatagtgtacctgtgaggtcgctagagagtggtgtaagatcaagccaaaaacgttggcagggccaaatgacgtagagcattacatgctgtgaaaaagaagtttctcggtgcagttgatcaggaagaagttgaccagaaagccattgaagggttttaagcagggcattacatgttatgattttcattttaaaaagattgttctggctgctgtgagaatggattgagatggccatcaagagcagaagcagaatgacagcctgtggtctattgcagtggtgcaggcaagagggaatggtggccaggcaagcttggtggtggcagtaagttgtaagatgtcattattgttattgttatgggctgaattacgtcccctccaaattcgtgttttaaagtcttaacctccagtatacctcagaatgaaaccttagttggagataaggtctttaaagaggtgattaagttaaaaagcccaaacaaaagggaggtgattaagttaaaatgaggccattggggtgggccctaatccaatctgacttgtgtcctcctaagaagaggaagtttggacacccagagagacagtgggatgctcgcgcacagaggggtgaccaggtgagggcacagggagaaaaagtggcgcctacaaattgaggaaggccccagaagcagccgacctgctgacacctttatctgggacctctggcctccggaaccgagaaaatcaatttctgtggtttaagtcacacagtctatggtaatttgttatggcagccctagcaaactgatagagctatgacaatcatgggtatggtgctgatctcttcattgtatttatcactacctaaaattcgcttagatttatttatgtttactctttcactcccttgattgtaagttccattacagcagggattttgtctaattcatagtaatcgcaatgctgcggagtgcctgcgccatggcacatgaaaagtgaccgtgtggttaaattgtttctcagtcactctgtaatatccagtattttgtagagcttttgtttttaatgatatacaggagatccagagttttttagggggctacaaactctagcacataggactatataagaaataacactgcagcaagttagaaccaggtgttcaggaagcatatcttagcagtggagacacgatctcttgattagagggaccttggataaaagaggccttttttgaacagaatagctctgctgaagaaagagatttcgtcattattttaccttcatttcatggcttttccaaaataaggtacatgtgtgaaaaatgccctccgtaagggcgaggtctttattttgttctctgctgttctgtaaacgataccagcacatcatagggttcaaatatttgttaaatgaatgaaaacattttcagatcctgctttgtccttagacatttttggattgctttaaatgttctcttatccttagcataatattagctatttaatagagcaggtaaaatgttttgcctatttttttttgtctcttataattgtgtgaaatattctgaatctggtcttcactttggtgtttttgaccttaggctgcccttaaactgaagtcacagcctagctcaatggcactggctcccccttgtgtcaggaacttgatactacacccactaaatgccagcctgccaagaaccaagcttccccgggtcaaacattttaagtggtccaaatgctatacataattaaatgatgacaccacgattgggccaccttattggggctcatttgctccaaatagtcttactcctatgcccactactatatatatagcacaggtacagaaaaacatttttaatacttgtaaccataaaggcttttggagttagtttgtacttcttatcaatataagacatctacgttgacaaaagaaatcgaatgttgactgagtgcggtggctcacgcctgcaataccagcactttgggagacctaggcgggcggatcacttgaagtcaggagtttgagatcagcctggccagcatggtgaaactctgtctctactaaaaacacaaaaaattagctgggcatggtggtgggcacctgtaatcccagctacttgggaggctgaggcaggagaattgcttgaacctgggaagcggaggttgcagtgagccgagattatgccactgcactccagcctgggcgacagagcgagactctgtctcaaaggaaaaaaaaaaagaaagaaagaaaaagaaatcaaatgtctcagcatattttaaatactttatatggaacagttgattttcactttctttcaaaagcctaccaaaattgaggagttagcgtttttttaatcccatgaaatcgatttaaaaggaagaaaattatttttcaaagggacaacattttattttcaagagtagtatttgatttctgttttgtgtacatggtagaatactgagtgagttgctcctggccactctcgctgttgaggagatgaacccgtgcagggacggccccaggaaggcctctttagctgtctgaatgaagtgattttgactctcagcgtcagtggtgtgctggagccagaccgtgccgacttatcccagctcacaagagctaatggctaaatttcaggagttctgcaaactattgttaaagctagtttatattagaaataaattatatagacaattcagttatattaaaaaacaagggtgctttcttcagcagcacttatctaagatcagaacaacatcgagaagatgagcgtggcacctacacaggctggcacacacatttgtgaagcgttccatattttttcaggttattctgtattaaatgcaaaataaatgcttttattaacaatgacaaaaagaaaggtaattgtaataaatacaatttaccacttcgtaattactttattatattttactcatactttgaggttatttgtgtctagtgtatgtgtggtggatgtaccatataatggtatgctattgtcatttcttccagactccacctttagtgatttcatgtttgtaattggcagcttgaaatcgatcttggaacaatggaaataaaaccacaatggaaataaaaaaggatccaaatcaggactttttgcctatgaggagccagtgataaccagcccattactatatgcaaaacgagtttatatgttttttctctactccaaaaacttaacaaaagaaggaattattaaactttaaaaaacgattttaattttattttactacattggtttcagttttttattttattttatcatttatttatttatttttgagacggagtctcactctgtcgcccaggctggatttatttatttatttatttatttatttatttatttactttttttgagacggagtctcgttctgttgcccaggctggagtgcagtggcaccatctcggctctacctcccgggttcaagggattctcctgcctcagcctccttagtaggtgggattacaggcgcctgccaccacgcctggctatttgtgtgtgtgtgtttgtgtatttttagtagagatggcatttcaccatgttggtcaggctggtcttgaactcctgacctcaagtgatccacctacctcggtaccccctcccccgacccagccccaacaaagtgctgggattacaggtgtgagccaccatggctggcttggtttcagttttttaaatagttttttgaaaagataacttcaataatttaaattctttaataattttaataatgttaaaaatggttttaaaaggttgctttaatttaattgaatttatttatgttgagacagagtcttgttctgtcacccaggctgccgtgtgatggcagcatcacagagctcactgcagcttcaacctcacctgctcaagtcatcctcccatctcagcctccagggtagctggaactacagccacacaccaccatgcctggctaattttacatttttttgtagaaacaggttcttactgtattgctcagggtggtcttgaactcctggacacaggtggtcctcccgcctcagccttccacagtgctgggatcacaggtgtgagccaccttgccttgtcactggtcgagggttgtgactgcaagttgtccaggttcttggcattttgaacaaagaattggacaaaatgcccagcaaagcaaagcaaagtatgaagcaacaaaagaacaaaagcagggattcattgaaaatgaaagtacactccacagtgtgggagtgggccagagcagcagctccagggtccagatgcagaatcttcttgggtccaaatacccgctagcagttttccattggccacttcacgtccatctcatgtaaatgaagtgctagcccacagtcagtctgaatggttgcagaaagcagccaaccagaggctgaagtgaagttacaaaggtcacacccctgtgcaaacaggagttggttttcgcagccaatcagaggctagggtgaagttacaaagttatacctctgtgcaaacagacttggcaggccattagtctgactggttgtggacagcagccatcggtctgactggttgtggacagcaaccattcagaggccggagtgaacaaagatgcaaacgaagactcaacccgcagtcagtctggtttgttgcagacagccaatttcccatctgcctaccagaaaaggtagtgagtttgcaaagggagtagcctctggtccttttgttacttaggctggaaagttagggttttcctttcaatttagttctaggaagtcagtgtgaaatagccttaggatccctgcctccagaccctattgccctgcctcagcctggcctaaaagctttacttgaatcttcaatcaattcacttaattcaaagtttcatttagtagaaataggttaaccaaccttaatattatatatgattttatcaattatgttatatttttgtttcattttctagttcctgtctaatgtcttgttttcttatttctaaacttctttcttttattttcatcattaagctatgaatttttttcctatctcctgtaactttcttttcacttatttcagtgtttttacatttttctcttcagctgtctccctttgcagacagacctcgatctctttctcagaattaatggcctcatattttcctgacctgtgctccttctcgctgtctcttttattcttagctcacctttaggatcctcactactcctgaggctgaactgttagcaatacggtttcctccactgtggccaggatcccagctccatccggataccatctggacatgtgcagggctcacctggccccttctgctgttttcccatgtctttggcaccagaaatacgatgcgaggatagtgcataggatcattcggtcatttttgcctctagccccgtatttcagaacatgggaggacaagagaagctctgagtcgtttttgcttctgctgtaatttgtttttattctcatctcaaggaatttggaagtccttttgaaataaatgcatctcatttcattatcatttgaggaaagagacatttgagaggaaagggcgattaatatttaaacaccacctcccttcccctacctcatttgcccttgtatttttttcttctcactcgctctcttatattgcctttactgggcaactatgtcaacaaattgccactgaaaggcacctgactggtgagctgccttgagctgaggtcagtgtgatccttcagctgggagccgctgctccgttttagagggcgagccattgctaccgctgatgagctgagcctggggctcaacgagtccatctgaaaagccatctctcttccagcagcagggagccactcgcagtgctgctttcatcagccttcgtgaaggatgaaaagggcttcgtcttttccacacacacttgactccagcagcgtgggggtttggagcactgatctcccctaccgttgaaaacccacgtgtaacttttgactctcccaaaacacaactaacagcctgctgtggactgaaaaccttactgataacataaatgtcaattaacacatattttatatgttatatggattatctactgtattcttacactaaagtaaactaatgttactttaataagagagaacattaggccaggcgcagtggctcacgcctgtaatcctagcactttgggaggctaaggcaggtggatcacttgaggccaagagttcaagaccagcctggccaacatggtaaaaccccatctccactaaaaatacaaaacttagccaggcgtggtggcgggcgcctgtaattccagctacttaggaggctgaggcaggagaatcgcttgaacctgggaggtggaggttgtagagagctgagatggtgccacggcactccagcctggtcgagagagctagactccatctccaaaaaaaaaaaaaaacgaaaaagaaaatgttattaagaaaatcataaggggctggtgcagtggctcatgcctgcaatcccagcactggcactttggaaggccaaagcaggtggatcacttgaggtcaggagtttgagactagcttggccaacatggtgaaacctcgtctctactaaaaataaaaaaataaacttagtggaacatggtgacacgtacctgtaatctcttatttgagaggctgcggcaggggaatcgcttgaaccccagaggcggaggttgcagtgagctgagatggtgccactgcactccagcctgggtgagagagctggactctgtctcaaaaaaaaaaaaaaaaaaaggaagagaaaatatatttactcctccttaagaggaggtggatcatcataaaggtcttgattatcatcttcacatggaggaggctgaggaggaggaggaggaggaagaggggttggtcttgtttcgagtggcagaggcaggagaaaatccacatctaagtgggcttgtgttgttcacaccatgttgttgaagggtccactgtgcctttcttttacctgcaaggaatggtaggctgatacacagcctcatctcaacttttacttcaggaaacaatattttaggtctatccagggtctccaagtttctgaagtactgagtgaaaatgttgtaactaatatattttgttatgaaactgaggattaagacatccttcataaccagcttctgaagccaaagtgatacagatagtataacaccagagtaaattgttgtataagtagtttatgtatatgaggcagggtttctgttatcctttgttattactgtggttttgatggatgagagtgaaatgtgcttatcttgttttttttttaaataaaatctttttatttaaaaaatttcaaacttctaaacggtaagagtgttgccctgaactcctgcacacttttacttagattcgccaatccctcatgatctgccacatttgtttttgcctcctctttctccttctccctctctcccccgtttctctctatatatgcacaaacacacatacctatttatacattttattattattgttattttcatcatcaccattttgctagactatttgagagtaaactgtaaacattgtaacctttccctgaaatgcttcactgtggatcttctttctttctttctttctttttggagaaaggtgtcttgctatattgtccaggtgggaaatggacatgaactcctgggctcaagtggtcctcccaccccagtttcccaagtagctgggactataggtgtgcaccgctggggtcttcctttctttctttttcttttctttttttttttttttttgagacagagtcccactccatcacccagatgggagtgcagtagctcgatctcgactcacgcaacctccacctcccaggttcaagtgattctcatgcctcagcctctcgagtagctggacttacaggtgtgtaccactacagctggctaatttttgtatttctagtagagacaaagttttgccatgtgggccaggctggtctccaactcctggcctcaagtgatccacccacctcggcctcccagagtgctgggattacaggcatgagccaccgtgcccagcctcagtgtaggtcttctaagacaagaacattctcttacataagccacagtgtctgtgtgtgctcttaaaaataaccttagagtcagatcacttgggttaaggtgtcatttggctcattcctctgcttcttgcaggtgcatttctaaacagtacaaaactgatattttctgggagtgatagaccgaaattcttatgggggccagcctgtgatataaaagtgagaatctgacagagttcatactgtactcatgacatgtatgtatgccccacctaaacaaataaacacgccaatcctagactaaaaaaaaactgtaataagaaaaaatcatcaacaacaacaacaacaaaaatacccgatggccaaatttgtcacttgggtcaacaatttgcggccctggatctacggtcaaagctcccgtggggtggaatatccacagctttctttggaagcactgtggtatagttcagaagttctcctttaagtccaagtgcttgactgagatttgtgagaggcagcagtcgcagtggcaggtagcatgagagctaggctgtgtgtgtgaatcccgtttccaccatttgctaccggtgtgatcttgggaaaatgtcttaacctttctgtggttcacttttcctcatctgtaaaatagtacctttcacacaaagctgtcatgaggaagaagtgaggaagaatatttaaagcaccttacaccagagtctggcacgcgtaataagtcactgtagaactggattctgcgaagacgaacctgatggctagaggccatcacatccatgcagatcatgatcctggtataaggggagagggatgtgaggactgttcctcctggaagacctagagaagatgttcattcttgagccagaaagctacttaatctacttttctcccattgggagtgactttcttttgttcttatccccgttgtcttttttttcttttttcttttccctttttttattagacggattttcgctcttgttagtagagatggggtttcaccatgctggccaggctggtctcgaactcctgacctcaggtgatctgcccaccttggcttcccaaactcctgggataacaggcgtgacccaccgcgcccagccctcatccccgttttctactcatccttcttgtcagacttctccccagctctctcctatatttccctagtgctgagggggtcactgcttgaatattaactctacgtgatccctgacaagttatttaatgtctttgagctttagttttctatctgtaaagtggggacaataatagtacctacctcctagttgttgtgagggttcagtgagttaatgtagggattactgtgtcaggacagtccctggcacacagtaagtgctgtggaactctcagctattgggtaggatgtgcatcattctctttaatagccatattcctccacggtgtactctatacttgtgatctcaattttctttttgctggctcttttttggagttttttcttcctctttttctcctctgcaagtgctcttattgaggtcagtcctcttctttttgtccagatctaagattctgcttattctcttagccttctgaaatattttatttttttactttgagacagggtttcactctgttgcctaggctggagtgcagtgccacgatctcggttcactgcagcctcaacctcctgggctcaagcaatcctcccccaagtagctgggactacaggcatgcgccaccataccccaataatttttaaaaaatttttggtagagatggggacttgccatgttgtccaggccaccttctgtaatactttaaactgtagcaacctggccaggctcatgcctgtaatcccactactttgggaggctgaggtaggaggattgcttgatcccaggagttcaagaccagcctgggcaacatagcaagactctgtctctattaagaaaaaaaaaaaatcagctgggcatgatggtgtgtacttgtagtctcagttgctcggaaggctgaagcaggagaatcgcttgagcccaggagtttgagtatgtagtgagtgtgatcgtgccacttctccagcctgggtaacagagcagaccccatctcctcaatcccccccacccaaaaggaagacaaaaccatcgatattattttgcagccagaagcttgggggtaggggacagtaaggaggttattggagaaagggaagtggagatgaggagggaagggagggagtgggagggagacactggctgattggctgagcagtggagagctaccgatggcaggattctgcagcgcggtgaggcatggggtggatgttgcgaaatgaagctggcggttacaagataagccatttagaagaagtgttgtgattagtgaaaggaagccgggaaatagaatagagtggcgaagcacctatcaagttttttcaagataaggaagatacctgaatattttaaggcaaaagaggaaacagctaataaagaaaataatgaagatgctgagagggagaggtaattgtgtgaagaacaagagctgagtgtggaaacgaaaaactaagagggagatttgcttctttgaggaggagcactttttatttctccaaggctacgagcacgaggcaagagctataggacattcctctaaagtggtacaaagtcagcgactgtaaaggtgacgtgaggattaataatagcacccagtgatcgtgcagttcacatctgttgagtgcagtgggtgataaggacgttttctgagatgaagggagggaagtgggtgataaggacgttttctgagatgaagggagggagtactttggagcttgaggcaagagatgctgcagaatagctgttttgagggagtttgccaggaagtcaacagacgactgagcggattgttaggcaacacccaggacagatttgatgttggatgggggtgaatttgtcataggccacgcttttttattttattatttattgcagcagtgctttgcaggaacaaagaaagtgaaaattgagatgttcaggattatggactaacagcaggcaggatggagggtgaagggcccagagttcagggtggtgacagtggccattttgagtggctgagtgtagaggactgagcagccgtgtgtagattaactgccaagcacagctgcgtgagtgagcctaggccaagctagcggaggaaccacgcagccaacccgcaggatggcggaaaagaataagccgtggttgattccatcactctgtggcgggcagcttgttacacagcagtagaagatgcatgccatgccttgtgttgactgcgcacagcagggagcctgaggcaagggagcctggcacagaagcagaggtcagtcggctggagaagctgggcaggtggagaagaatagagggggcctctggggagcacccagaaatacccagcagctctggagaagtgcaggttttagaatgtgagagtgagaaggaggcttgccatcttgagagatacacacctggtggcaagttgtggtgacggtaagtgctggagggagcgcagccacagctcagactgtctcttttcttccgtgccattcactctcagcagaggaccttgccttgtactacacagaggacagagaagtctttttatgtgagtttcttcatcatcccatttccaaagacaaactagggatacagatatgaattgtatgataaaacttgagataacagataagtcacattacttttctaagtctgattaaatcttgtgcccctacttgtcaagaccaataaaaagttagtagttttcgtggcttctttttggctcttatattgtacagtaagtcttctcttaacctttcaatcagttgttggaaactgcgactttaaatgaaatgatgtacagcaagtctttgaataatgttgttacaaagttgatgagaaaaaaaaatggttttgttatatgtccttttgcttacggttgtagtttccaagaacccatcaatgatactcagagaagacttgctgttctgggactccaaggcttagtgcagtctctgggggaaactggagagaggaaaagcattgtgctcatgagctgtctaggcctgagacagggacagcatccgtgtcgtctgcaccaggctcagccacagggagccttagcacagcttccagggccccagagctcaatggagagattagctttccataagaggaaggaacctcatccagtgcagtagaggaaaagagaagaacataggtgagatataggtgggctagtggagcagtttgtaggtgtacagggagagttcttgaggaagccgtggtattgttcttcaggccactgtggcctcatcagcaaaagaatctttgcctttttttcttatatcatcaggcctttgtgattcgagactagagagaaagaagttgcttaatgcctgcaagatgtcaatcacgtgggctttgttttctggggtctacccgggcaggtgagaccatagcagattcgctcagcagagaagaggatggtgatgggttcctcaaggggatgtgaaagagggagagggaaatttcctatgatagggaagaacttgccattctctcacatgtagcaccttgcaggcggcaggacctaggatgggggtggctggaagaacactgagcgctaagtgcctggccaaggccctcccaccctctcaggaaacccacccacccagtgaacaacgcccgcatcagccttctttgcacgggctctttcccagtagcattaaaatatgctcacatcattcaggtcttcagtatcaaaaaagaaaaaacatcctctttaacaccatgttcctctccagacaccccttccctcccctttacttctgtttgttttttggggtttttgtttgtttgttttttgatgtgggggtctgtgtatgttgcccacgctggagtgccaagtcagtgtctgttcacatcacgatctctgctcactgcaaccttcgcccccacttcctctgggctcaagtgatcctcacgcctcagcctcatgagtagctgggactaccggcatctgtcaccatgcctgacttctccctttcacttcttagatcctccttgacccactgcaatctaatttctcctccaccttcaacggagagtgcccttgtcaaaatcatagctgatctccttttttactaactccagtggctgtttctcagaatttacctccctcgacctctcagcagcatcggaaagccaaggatgactttccattttttttctccttagcctccacgccccggccctctcctggatgttcacttccctctctggctgctctgctccatctctcatgcgggttcctctttcttggatcgttccttgaatgtgggtactcctcagacctcttccttctctttcccagccaatacattctacgtagaggagctcttctgctcctgtggcttcatgaccggatccacgtctccagccagatccttctcctgcacttcgcactcttatgagtatcaagtctgtggtttgattttaccccacttgtaagctagcaagttagcttgttactgtctcatggatgttggcacaagacttgagactcctgagtcagtgacaaaggacttcattcctcttggcacagcaggcaacatgagcatcagcttgtgggtgacagttactcctgccctcaccttttcctggtgatgggcccagctggatgcctgcacaggaaatgggtggcatcacagaaagggaacagagctttcagaacagagaatttcagggaacagaacaggggatatctactgcttttatagcaagcaggaagcaagcctgctctttggcctggagggagacattatgtcatctctcgaggctgctcactgcggcatagccctgagagatggtcagggttttcatggcataaccagcaagaacaagcatgttggaaattcaacatgtcccagattgaactcttcatttcccttcacctaaacttttttacttcctttttaaaaatttatttttatttattttgcacatttattggtatttcttttagagacacgatctcactctgtcacccaggctggagtacaattgcaggatcatagtccactgcagccttgaactcctcggctcaaccgatcctgccatctctgtctcctgagtagctgggactacaggcacgtgccaccacactcgactaatttttaaaattttttgtagacatggcagtcttgctgtgttgcccaggctggtcttgaaatcctggcctcaagtgatcctcccacccacagcctcccagagtgctgggattacagatgtgagccaccgcgcctggcctgtttctccttctattttctgaactcagtgattgatgcagtcctcgatatttgtaactcattaccaactgataagaaattcttaactcttttgactttcctctccctcatgaagtctgatgactccttcgaactctctcttaggtttatttgctcttcttgccgctcgctgcctatccctgggtcagactgtgcttctcttatgtgtttaagacaattacagccttttatcatccagctagaatattcattttatgaagttgtaagttgttttattacgaaatgtttttagagacagggtcttgctgtgctgcccaggtggagtgcagtggccatttacaggtgtgtaatagctcactgcagccttgaacccctggcctccagccgtcctcctgccccagccttcctagtagctgagactaagttacttaatttaaaatgtatgtattcatttgtttgtaattcaaaagattcaaaaggtagatgctgaaaagacttcctccagcctttgcccctgccacctgctctcctccaaggcattctccaccctccagttaatgttaccagctcctcctgtatcctgttaatactgtacccaaggtagacattttatactcaggttactcaagtaccgtatgtgagattgtgacacaaatttccataccttacatttgcttaatacttttttttttgagacagattctcactctgttgcccaggctggagagcagtggtgccatctcagctcactgcaacctccgcctcctgcgttcaagcgattctcctgcctcagcctcctgagtagctgggagtgtcccagagaggaacatggaggcttctgttgctgacacagcacagtggaattctcactttctccttatctgctctcttctcagtctgactccagatggaagctcttccctagaaaagccctgtccagaaggagtttgcatagtctatcattttccattttctgttagccacattttttcaagtaaaaaagaaacaggtgttggaagaaaaactttagacaaggccgggtgtggtggctcacgcctgtaatcccagcactttgggaggctgaggtgggtggatcacgaggtcaagaaatcaagaccatcctggccaacatggtgagaccccatctctactaaaaatacaaaaaattagctgggcgtggcggcccatgcctgtagtcccagctactcaggaggctgaggcaggagaattgcttgaacccgggagatggaggttgcagtgagccgagattgtgccactgcactccagcctggagatagagcaagactccatctcaaaaaaaaaaagaaaaaggaaaactttagacaaattgaatttaacagaatttaattgagcaaagaaccatctgagaatcagctcacccttccaaaaaaagggaagtgatgtacggaaaatggaagtgaggtgcagaaacagctggtgtagttacagctcgaagttggcctcctttgaacaaggtttgaaccgttggctgtgattggccgaaactctgtgattggggcatgagtaggttatgtctgttgtaacatccggttaggttgcagttcactatatatgcggaaacctctaggtcaagcttaaaacatgtaaggaggcagctttaggcgaaacttatataggttggtgcaaaagtaattgcagtttttgcccttttaatggcaaaacccacaattttgcacgagcctaataatttaacacaagtaaaattaattttaacaacgtatcttatttaacccaatgtgtctaaagtgttatcatttcaacatgtaaccaatattaaaaattattaatgagctattttgcattttctttttcatactaagcttttggaatcagtgtgtattttacactgacagtacatttccatttgcagtagtcacatttcaaatgcataatagccagatgtagttggtggctgctgtttggtctagcacgggcctagaatttgtcttttcccaatcttgtctccttcaaaaatctttttttttttttggtaattaaaaagtcgatatatcatggttgtacatatttatgaggtccgtgggctattttgatacctgcatacaatgtgtaatgatcaagtcagggcaattgggatatccatcacctcaaacgtttatctttgtgttgggaacattataattcttctcttcttgctattttgaaaatagaataaattgttcactctaattttcctactgtactatcaaatactggaacttactccttctatctaactaatatatttgttcctattaacccaatatctctttgtcctccttctcctcttcccttcccagcctctggtaaccatcattctactctctacctccctgagaccaacttatttagctccagtaagtgtgagaatgtgcgatttgtgttgccctccttcaaaactcttgcctgcaataagagtgagaatgtgcgattagccgtgcatggtggtgcacatctgtagtcccagctacttgggaggctgaggtgggaggatcacctgagttttgggaagtcaaggctgcagtgagctgagattgcatcactgcactccagcctggacaacaaaagcaagaccctttctaaaaataataataataataataatatctttgctatatgaaagaaaaaaaacaagaaaatgggaaaaaaggaaatatacttgacatgaggatagtacatgttttgttggcccttcatttattaagaaggaagatgagtaagtgaaaagaatcctatattccacagttactgactttaggtttcacttttaagttgatacttattctgcaacctctttcagtgaagaaatttaaaattcttatttaaaacgttttctttgtaaatagggagtaaatataataccactaaaattatccagagtggtaaagaaattaactactctagttaagtgaatatttgcgaaattaaattaacattcaaacattacaactttaattttgataattttgaatggaagtatttcgtaatcaattacacatccctgtcttaatattcagagagtattgaatagcatttatacttttcttaggttatttgtggaattgaactacgttatgatgggggcagggagaggtgaataactcatatttattgagtcgctgctctgccaggagatgtgctttgtattatgatagctcttcttatttaacccttagtgtatcccccttcctggttcttagtgtttgaaggaagtcactgtgttttacctaccaggtaggcttatgcacacattgattaggtaggtgatctctccaatctagtaagtcacagagctgggatttgaaccctagtggtttggcgctagaggccatgcttttaacactctgatactaatgtcaacttcaccacaaaactctgcggtagacattatcatccccattttacaggtgtggaaactgaggctcaaaagagttaagtaacacttaacgtcagttggtacatggccaatgtttctttttctttctagaacttttttatattggcccaggcaaggcatttgccagtcaatgaaaccatttctttcatctttctttggttcacttatcctcctttttctttccccagaaaacatcttttataatcatgaggcaatatcggagtgatttggtttcctacattacaaaatatgctctgagataatttggagaaacctggccttttcggagtttatattctaaaaccattgaaaacttttttttttccagagagattggaacaattatcaggtcattaggatgctgtcctacggaaggagagctgcatgatctgattgcagaggtgagtacggcgaaaaggtttcattcagccagctctctgtgtgagagctactccttgtaattaaaaacaatccttaccggaaactaaaaaaaagtgccccaaactactgaatgtgctcagtggaaatattaggataactattcatattagccaaccaacaaaatctgaaagaattgagcagatcttgaagaaatgactatgaacaagtaacacaactgatcaaataaagaacccactgtagaaatgatcctctctgtaaaattagttgaaaagaggccagtagatgcaaggggctgaccgtatgcagaaaggctattgacagagacagtaaggaatttttatttatttggggaaataaaactaacttttagaacaagtagtaaacagaataaaatatcaagaatgaactttacattgaccagagagtctaagaagtttaaaaacgagtcatgtgtaatagtggaggtgaatgatcccataaggcagtggatgagcagcccacgatgagagtgcttcatgctctgtttgactttccagaaaggtctctgatctcatttcaaatgcagcattcggttcaacaacagagactttaagggaaaaaagctacctggccaggagaagaatcttttcagaattgcttatctaggcacaaagattttagtggagtctggggatggcaaaggggataacaggagacaggtgaggaggtggaattttatctctttattttgcacctagcgcagtacctgcttgttcaacattaagttggagagaaggaattgtgaccgtggtgagtcacttaacccctgttgagtgtcagtttctccataataataactacttcaaagtttgcttcaaagataaatgaaagaaggtacaagaatgcatgttttgaatcctaaagcattatgtaaagttaaggaagggaagattagaaagatgagtctgctgcacagatattagcaccttggtgaccaaaaagcagtagcaattttttgaagcatttggaaatattcagtaaaggaatctaagttgtaagaacacattgtttttaccttttgggattcaataaagctatttttaccaagagtaagaggaaaagcttgtttttcctgaattgatgctcacattaaaaaaagatactgattactgccttaaagtgtttctgcacaaagctggaattagtgttagggaaaagcaagctggaagtgtggaagaggtaagaactagaggacgaatttacagcgaaatcatcatcatcacatgctcaggatagtaagtgaagcaataatgaaaaatacctccgaaggtcagaaaaggaggatctctagagtctagtccctttatggtttgtttgtatgttttaatctctatcaggagttagcaaatcatggcccctggccaaatcctgcccaccgcctgtgcatgtaaataaagtttcactgaaacacagctaaactcatttatttgtatattatctatggttgtttcctgactacaagggcagagttcagtagttgccacagagacctacagcttggaaagcttaagatatttaccatctggcctttgcagaaaaaggttgccaactcctgatctatgggcttctgtgccaaagtagaacaaataccacatctagtactagaagatctgagttcaaactccacagctaccacttatagccatgtggccttcaatgagccacttaatccttcaaagcttcgtttcacatctgcaaaaggagtataataacatgaaaatgtttttatgaggattaaatttaataaccgaggaatcaactgttacttggtgggcatgcagtacatacttgagtttgcttgcactgctggtggctctctaggataataatccccactggtttgggcagttagccacagtgggtgcttaggtcctaaagttttattttatttttacccttttttagggacatgacacaacctttgaaaattacagatatttagaatacttatgtaccagtaggggtcactgagctattaagctctgtaaatatttttctatatttgtatacgaacacaatttactctaattaaattctactgataaacagctttgggtataactaccttttaagaacttttccaaataaatgggtgggaaaaaagcacataaaaaaagcacaaatttgaattgataaatacaagtatgtatttgtacatatttaaatacatttaatagtgaatacatgtaaacacatttagaaaatcaaagccccgtaaaagtcaacatctaggggtaaatgtcatattgctaaatgttctataatagtttcagagatcaaactatttaaatgtatgtgtgtatatgctttaaaattgctctataaggctgggcacagcagctcacgcctgcaatcccagcacttggggaggctgaagcaggtggatcactcgaggtcaggagtttgagaccagcctggccaacatggtgaagtcctgtctctactaaaaatagaaaaaatagctgggtgtggtggtacacacttgtaatcccagctagttgggaggctgagggaggaggatcacttgaacctgggaggcagaggttgcaatgagctgaggtcataccactacactccagcctgcgtgacagagcaagactctgtctcaaaaaaacgaacaaacaaaaaatagtcctataaaaagttgaaacctttgtaaaattctctggttgtcatgtacttgaactttagtgtagacacattcttttctctttaatttttataactttcagccctttgcttcctgaagatcaatttcaaatatggtgtttctcttgaaatagatcattttaaaaatcatttaactttgatccatgcagtttatattctataaatagcaacttcctgcaaatactttctgccttttggaatatcacaaaaactggcaactgtgagaaggattagtgaaaaatcttaccgacatataggctaccaaataatccttcttttaatattaagttagcgccttctaggatcttcagggtatgggagctgggaggagataatggcattttcatacaaatggaaaggttatttagaggtctatgtcttctgaagttccaacctaagtggaattatggagaacttcaactaattacaaaggaaaactaaaagatgatttaaaagtaagacctatgtttgtcagattattgactcaggcttaggcactaagcacggattatgactttttattggggtgaccatctgcatcctccccttccccatccttgcccttttttggttgtagatgttaggcagcacctttgttggctccacatctgttttgctcctaagcgtgctatgttctattaaccatctccacctttccccgtgactccctcttcaatctgtctgctcattatatgaggcctcttaacttctgtgctcaaacaactctgcttggcctctgttacctgggtgtaggagagctggctagcaaatcattacatggatttaacaaacccaggtctacaattacctaatctagtcaaccctggcttgcagaagacaccatcacagaacttagtgacaccagtgcctttctcaccagcctgatacccttggtgagcagtgcatctgagccctcccatggaacagaatcctccagtgagtcttctgactcattagatgcccattctgccctcccacttccgtcagcttggtttgccacttcactcagggtttggtgtcgcttgttccaggtctccacttcactcagggtttggtgtcacttgttccaggtctcaccctcgcagcaagggtgccccatctcctagggtccttgccagagtgttaagtctgtgtcctgagaaagtgcctgaagtcgatgaattcttgcttatccagttttatattccagacctcttggtcaagcactctcatccaatctcaggggtactcccctagctcctagttcaggagccaattcctatctaattccttttgcgattttagtgtatagtctttttctttccttattaggcccagcacttcctcagccagattatgctgggatttaacacttcattattgcctggagcagcccattggatggatggccttggctcaaatatgatggctaggatcatcattcaattacatttcctgcaactgtagatttaagaggtgcatttcattgggaggctgaggtgagaggattgcttgagctcaggaatgaggcacaatggtggcccactgctctgcagcctgggtaacagagccagatctcaactcttttttttgagatggagtctgactctgtcgcccgggctggagtgcagtggcacaatctcggctcactgcaacctctgcctcctggcttcaggtgattctcctgcctcagcctcccgagtagctgggggttacaggcacgcaccaccacacccggctaatttttatatttttagtagagacggggtttcaccatgtcggccaggctggtctcgaactcctgacctcaggtgatccgccctcctcggcctcccaaagtgctgggattacaggcgtgaccaaccacgcccggcccagatctcaacttttttttaaaaaaagagaaagaaaattgaattttcatggctgccatagttgtcgtctggaagagctgtaatgcgaatcaggtgttaagtgtccagtagaatatgaccaaaaggagttggctgctctatatattttatttctaaactcactagggcctacccctggctttcaggattagatcaaagcataaaactacttaggaatgaaatgaaggtcctcatcagatccaaggagtggggcaagagtgagcagaaacttgaccagcacatagtaaagataggtcagtgataagaactgggccaggcttatcctggaattctgttcttggatcaaaagaggataccatggcagggagaccatggtaatgatagttcttaacaaaactgtccctttacatatgatggttgacctcgacatctgtgcacagccatcattctgggatctttgtgatatttctgggagtcactgttttccttctgggttggacttctttctatcccaagttttcctctttctagttcctctagcattttaacatattatttgataacttcttgggaaagagtgccttgggggtaaaatttttgagatttgtatgtttgaaagtgattatgctaatctttggctggaaatagaattctacattcaatggatttttcttcattaaatggatttggatttttcaggtcttcagtaagagttctgaaggcactgctcatcttcatgttcctggtaatgctattgagatagtgcaaatccattctggttcccaatcctttgtatataaacattaattttttttttcctgaaactctggacagttttttttccccagagtttgaaatttcacaaagatttacgttggtgtaaacacatatctaatgtgttaggtacctggtgggccttttcaaactagtgacttgtattttttggttccaggaagttttcttgcaattattttgttttcttttttctgttttttggaactcctattattcatttttgtgtttctggactggactagtctttaacattcttcttttttttttttttttttttttttgtatttttagtagagacagggtttttaccatgtttgccaggctggtcttgaacacctgacctcaaatgatctacctgccttggcctcccaaattacaggcgcatgccatcacgcccggctaatttttgtattttcagtagagatggcatttcaccatgttggccaggctggtcttgaacgcctgacctcaagtgatctgcccgcctcggcctcccaaagtgctcggattataggtatgagccaccgcgcccagcctaatattcttatttttcacttattttccatctctgtctctgtgttctctctggtagatttcttgaactttgtcttccaatatttttattgagtttctcatttctgttgtgttttaaatttccagtagcttgtttttgttctttgaatgttcttttttaaatagcatcctgttcttgtttcagatctctgaagataatagtgttactttatttgaagttttcttctctttgcataatctgttttctccaagttgatacctgtgtctgttctggtctttgtttttgttagtagctttcctcagtgtctgataaaccttggctgtcagttcctaacaaacacatgcatggaacttgtcaactttaaacttcatcactgggtaatctgggaatcacccgcatcggagtgttggggatttttctgtcgtgcaggcttgattctttggaatagagtgttcagtcttctgcttgggaggcaaaagcgtctagctgccagttcggacaccttctgtttacactctttagaaggtaaatctcgaaactcctgcagggatggagggcaggcagtcacttagtggggaaaactgagagggaatttacagcttttcaaacatattttaccctagttcccctaattttagttcctggtccctcatcctcatttccagaagcaaccaatgctttttgaggattctttactcactactgtcttgggttcagttttctagatctactagattattgccactcatccatctacttctcagcttccaaaattttattcccattatattttttcctattcttcctaagtaggtgtatgattattttaacaaatgtttctttactgcaattttaataaggtttgagagagagtaaagttagatgcagatatacagtttgcctccttaacacagaagtttcattgatatttgattagtcagaaaatagcaacagtactcctgagaaaagtattaataatgtaaatctagatgagacattgtaatagtctttagaaagagagcattagtaaatgttgggactaaagcactgataattatagcatataagatgtaatacattggagtgaattaagtatgcatgtgtaaatattaagtgtaactacaaaagagtataaagtgaatgcataacttccaaactgatatagaggataaaagaattagagggcattctgtcagtccaaaaagacagaaaagaagcatagaataatcagagtatctagaaaacataagataatggtacttataatcataataggccaggcatggtggctcacacctgtaatcccagcactttgggaggccgaggtgggcggatcataaggtcaggagactgagaccatcctggctaacatggtgaaaccccatctctactaaaagtagaaaaaattagccgggcttggtggcgggcacctgtagtcccagctactcgggaggctgaggcaggagaatggcgtgaacccgggaggcggagcttgcagtgagccgagattgcgccagtgcactccagcctgggtgacagagtgagactccatctcaaaaagaaaaaaaaatcataataaatgcaactggattaaactcaccagtgacaagaaattgaaattggacttctggaaaaatccgatattataatacatcaacacatttctgccatctctaccttcacattataaatttaactttctcatcatttccacatccatcaccttagtccaagccttgtcatttctccatgaatgactgcaatggcatttatttacttatttacttatttttcagacagagtctcactttgtcgcccaggttggagtgcagtggcatgatctcggctcactgcaacctccacctcccaggttcaagtgattctcttgcctcagccacctgagtagctgggattacaggtgccggccaacatgaccacgcctggcccaatacatgcatttttaaatatttgagatggtattcagtccctactcatttcgctaagtgaggaaacccataaacaaatgttacagttttttttatatctgtggtcagtggtttaatgttacatttatagtgttgagacaactatgatgtcaaagtgtgataaatactccccagtaaccagttaaaataatgtaatgacactagtgaatcatttcctacacttttcatcttggatggaaagtatcatactactccaggcataccacaagccccggaggtcccaaatctccatctttcattattcttaattggttaagtatccttggattttttttctttgaaacttcggaattggcttttgagttagtagaacaagatccacgtaatctacaccctggtgaagtgggaatttctatcagcctgtgcctggactctatcattgagcttctggaagagccctgggactttacatcgtttggaatttgactgtatcaagtttctcagagaatgagaaagggtgggagtaattatgttcttattttgaagtagttggtgatatgaaatgttttatctgttattgttcctacacatcctgcctttgggagatgggggagaatggaattgatctgctctaatttttatttatgttagatgctggaatttaattatagagctgatggtactttgcagattagttagtaatggctaccatccagccattacttcgagtagcatcaggtaaatttggggcaatgaggagaatatattgtaaaaagcatatactgagagtattgcttatttgtaattggtaggaaaacatttaacgatgccaaagccatgatcagcagcgggaaaacgtgacccagggaaatcttcaaaagtggttttttctttattagataaataaaacgtgtttttatatagaacagaaacaatcacggcaatagactaataaatacggttttattccagatttcttattgtataggtaatatccagattacaaaaaattttaaataaataggaacttcctttccaacaatgccatcaccttaatataatcattgttaatattttggtacacttccttacatattatttttctgtgtaggtttttaactggactgtaattttttttgttgctatcgtattcttttttttagagactgggtctcactctgttacccaggctggagtactatggcaagatcatagctcactgcagcctggaactcctggactaaagtggtcctctcatctcagccttccaaatagctggtactacaggtatatgccaccactcccagctaattttttttttttttttagagacggggccttgaaatgttgactaggctggtcttgaactcctggcctcaagtgatcctcccacctcagcctcccaaagtgcagggattacaggtgtgagcatgtgagccaccatacctggcagaactataatcttatagtataattcagtaggtaaaattctgaatcttgcttttttccacctaattatatcacaaattatatctccatgttattacaaagctttcattataaaaatgcatgctgattaaattgcacaagaaaaaaaaggaagggaatgatctctcttctgtgcatcactcagacacaaccagaatattttacctttttcactcactattacatcaaaatgatttttcccttctgttatctagtttttagaaaccaacgctttaagaaagaaatcctgttctactataacatggatgaaacttaaggatattatgctaagcaaaacaagctacagttgacccttaaacaacatgggggttcaaggcaccgacccccgtgcagttgaaaatccaagtataattttgcctcccccaaaacttaaactaatagtctaccattgactggaagccatatcaataacatacacaatcaattaacaaagattttgtatgttatatgtattatttactgaattcttacaataaagtaagccagagtaaagaaaatactattaagaaaatcataaggaagcaaaaatatagttactatccaacaagtggaagtgggtcatcataaaggtctcgtcctcattgtcttcacactgagtaggctggggaggacgaggagaggaggggtttggtcttgctgttccagggtaacagaggcagaagaaaatccatggagaagtggacccatggatttcaaacccatgtttgagggtcacctgtagttataagtattaatgcacaaatactgcatgtgaggtatccaaaatagcccaactcctagaaacagaaaatagagcagtagtggccggggaatggcggaggggaaaggggagctgctgttcaatgagtacagaatttcagttttgcaagatgaagacgttctagagagctgttacacaacaatgtacatgtagttaacactgctgtactgtacacttaaaaatggtgaagatgggctgggcatgggggtgcaccccaatagtttcagctactcgggaggctgaggcttgaggattgcttgaagccaggagttcgggaccagcctgggcaacattgtgagaccctgtctctacaaaaaaatttttaaaaattagccaggcttggtggtgtgtgcctatagtcccagctacttgggaagctgagacaggagggtcacttttgcccaggagttcaaggctgtagtgagctatcgtggcaccaccacactccagcctgggcaacagagtaagaccctgtctctaaataaaaaataaaccaataaagtatacagaaggatgtgcataggttatatgcaaataatgtgccattttatatgaggaagttgagtatttgcagattttggtatccatgaggagtccgggaaccaatccaccatggatacagagggacacctatactaatatcattaatattttccatgccaatattctactataataggagtgcaatcgcttcctaatatttaattatatggcaatgaccatattaataaatagaaacataatattccattaaatgaatattccatattacatatccattcatctattggtaaaggttgctaacaatttttaatatcatggatcctgcatgataaacattatttgaataaagtataggcccttttcagatgccagagggccttgtgaagcaagccaaggcagtgatgggttactgaagggttttaaatgagaataacatgatgagatttgcattttattttattttaattcgtatttgtttttattgaaggaggttgtactttagacaaaccagtctgatggtagtaagcagttagattggaataatttatagtcatcctttccctgggtcatatctgacagcttggagccctttgtacattttgggtaattttttcctaaatggttttatttatctcttttattcagtaaaacttaattgccatgtttctatgatgctgtggtcagaatgtatgtgccccttcaaaattcatatgttggagcttaaaccccaatgagatagtattaagaggtggagtcttcagggggcaattaagtcgagagagtagatccctcacgaacgggattagcaatgttataaaagggctggagagaattagctagtttttgcccttgcatccctctgccatgttaggacacagtgctcatcccctctgggggccacagcattcaaggccccatcttggaagcagagaccaggccttcaccagacaccaaggctgctggtaccctgatctgggacttcccaacctccataactgcaagctgttaggtatgctgtttatacattacccagtctaaggtacttcgtcatagcagcacaattggactaagaccgaaattgatcttcgtgggactatttctataacaaatacctgacaatgtggaagtggctttggaactgggggtcaaggctggaagactttgaggtgtatgctagaaaagcctggattgctgtgaacagagcactaatggtgattctgatgagggctcagagaagagatctgtagagagagcctcaatcttcttagagattatctaagtagacaagaacagaatgttggtagaaatatggatggcaaaggcaattctgttgaggtcacagacataaatgagggatgaggtattggaatccggaagaaaggacgtcgttgctataacatggcaaggaacttgtctgaattgtgtccgtgtccatgctttatggaaggcagaacttagaaataatgaaccttggatattgaaattggcaaagagtttctaaaagtggtaagttcctggcattgacacttttgcacattgctaatagcagtagaaaatggtggtattcatactcccttcctggacggcattttagcaatacttatcaataagctaaaaaaaatatacaagctcattgatcagtttctggaggagatactgtatggagaacaaacagaaagattttacttcaaagatgttagtcacacggttgtttgtaacaacaactggaaacaacctgagtgtccattaacacaaaaatggttcaacaaatcttggtctgtctgtggaatggaatgctgtgcagtcattacaagtatgtcgtgaaagactgatgccaccacacacctatgagagtggataaaatccaaagcaccgacaacaacaaatgctgacaagaaagtggagcagcaggaactctccttcaccattggtgaggacagtgcagcactctcttagaaaacgaaacatcctcttaccacataacccagcactcttctccttttatttatgcaaaggaattgaaaatttatggccacacagaaacctgcacacagatgcttatagcagcttcattcataattggcaaaacttggaagcaaccaagatgtcctttagtgggtgaatggataaataaatgtggtacatccagacaatggaatattattcagcactaaaatgagttatcaagccatgaaaattcattgaagaaaccttttttcttttttcttttttttgagacagggtctcactctgtcacccaggctggagtgccagttctcccacctcagcttcccaagcagctggggttacaggcacatgccatgcccagctaatttttaaaaatttttgtagagatgaggtttcgccatgttgcccaagctgagctcaaactcctggcctcaagtgatccacccaccttgccctcccaaagtgtgggattacaggcatgagccaccacgcctggcctcagaggagtttgagggcagtgaaactactctgtgtgatactatcatggtgaagacttgttgttatgcatttgtccacacccattgaatgtacaacaccaaaagcgatatagtttgaatatttgtccccgcccaaatctcatgttaaaatgtaatcctcggtgtcagagatgggacctggtgggaggcgtttgaatcatgggggaagatccctcaggcatggctcgggccgtcccttggtgataaatgacttcacacaagctctgagttcacacaagctctggtcatttaaaactgcgtggctcctccctccgcactctctcttgctcctgttctggccatgtgatgtgcctgttgcctcttcaccttccaccatgattggaagctccctgaggcctcccaagaaaccaagcagatgtcagcaccatgcttcctgtacagcctgcagaactgtgagccaattcaacctcttttctttataaattacccagtctcaagtgtttatagcaatacaagaacagcctaatacaaagaattaaacctaatgaaaactatgaactttgggtaataaagaggtatcaatgtagctctattaattttttttgtttgtttgtttttgagacagagtctcactctgttgcccaggctggagtgcagtggcatgatcttggttcactgtaacctctgcctcccaggttcaagtgtttcttctgcctcagcctcccgagtagctgggactacaggcatgcaccaccacacccagctaatttttgtagttttagtagaggtgtggtttcaccatgttggccaggctggtctcaaactcctggcctcaggtgatctggccacctcggcctcccaaagtgctgggattacaggcatgagctactgcgcccggccagcttcattaatttttaacacatataccactctcgtggggatgctgattgtaggggaggctgaggatggggagagcaatccaggggacggggcgtggcatatgggaactgtctggacattccacttaattttgctgtgacataaaactactcttaacaaactcaaatttattaattaaaaaaagactaatggcttgataagatgttcacagtgttaagtaaataaaaaaagacgctagaattctatttcttgctaaaatatatatatacatgtatatataatacatacacaaatataatatgtggatatagcattgtattaatgaatataaaactaaaacaaagctctccagcactgtatatacagaagtgatctgtagatgacaggatcgaatccctgcgtgatttgtattctttgtgctcgtctctatttttcactgttccacaaagaacatgtattatctctgtaacaagaaaaagaagaaaagaaaactgcattatatcattcaaaaagttgtctagtggtcacaaagacactattgaagatgcatgttgaaagtttgaataaagttggtttttaaaatgcaaaaataaagagcaatatttttaaattaacgtcgttacatacatgatctgaaacatagctgtggacgtagtaaagtttatatatttaacttgaccaaaactcctttaggggattttcttattagggaaaggagggtcactttttgttcatcagtatattcagatatttattgtgttaaccactgctcctttgcttaatcacaaccaagaataaagcttttcctccaatcatattgcaacacaactttaaatcattgtttttggtctgagtggggttgaagagtatcttagtgagatgattgctgcaacacttgctgcaatcaccatctctatcaaatacaataaaactacttggcgtgggagcggcactcacccttaagtagagaaactggaactggagaggatgaaacaattagtgtagctggtgctcctgaagccccaccctcagaggattaaaacagggaaattaatggtctgacaggcactgctgcagcctttcccccatctcttcaaattggagaaactctcggttggaagtgatcttactaagtaccggatttagccacctgttgattcttagactctctggtgattcatctgtttttaacacttgcacttaaataggaaaggaatttataacccagaagactcgtgcagcctcgtggttgcacagcagcctctggaatctttagaataaataatttttctaaagtaagtggctttaaaatttttgtttttaaagacaacatttttggtagatgccaattaattattgtgattttgttctattcaaggtagagaaatattttctaaattgtgtttatgttttggttttgaaacatagtttatgtcaaaatttgtatctatactatttagagcctaatgtgaactatctcatggtttttatattttttactacaaacagtttttaaacattcacatgtgtatctgatttggtgacctggaactagctgaaatgcagatgctttataaaccatcttaactactgacattatcttgttttttgtgaagcatgaaatggttcagtttattgactgattgttatgtcactggggagaaaggaattttcacggtgtgttttattgtgcctatttagtgggttcagcattaaaataaataatgcttttatgagaaaagagatggcctgatgatttctcgatgcaagtggaagttaagaactccaggctgtgatcccgtcaaaacacctgccggaccctgacgccctcagataggcacttaacctctctgtgcctgtatttcctcaaatccaaaatggattaagaaaattgatttagaccaaagtagagtgagaagcacagtatttgccacatgctttgaggctgagataaatgttgatattattaaaaagtcccacagtatttattgagatggctccatattggggaagaggaggagagagactgtggagtgccggaaggcactgtgttagcctccagaatttgggcccctttgtgtggcaatgaaggcagtatattttcttcaggtcacctactccaccttaattctttgcaggaggagaagccaggcgtatcagggccttggttttccaggtgagcatctgctggcacactgttaagatgaattccctgcgaatggtacttttagcaggctacactcgagggatcttctggcaaagacgtttttcctgtacattcacaaacgctgcccggcttacttttaaattattactccacgttagcccttcccatagaagaaacaaactagacttaacttactttgcctcattcatgtttgcagtaacaagatgtatttgttttgtgagttgcttctgtcttttgaagggagggatgtggagtttggtggatatttgttactctcgcctttttttcagtccaaagaggccatgtggggaaacagcagaggtggaggcatcaccgctaacccacatagcctgccctctagacatggggcgaggcaacaagcggggagggagaaggtgttgaatgcgcctagcaattccgtgcgctatcttatttaattgccacattccacgtggcattttacggataggcggcagaggcaaacttctgtataaacaggtgggtctacactgtgggtcggggaggatgtgcctgaaatttcagcaccagcgattgagtcttttaggaaaaagtgccattgcatgtcatagaaccagaagtgtgtacactgctggtacaaatcatcatcatcatcgtcatgattgactctcagagttcacaaagcaccttcatatctcatggaaccttcacaaccatcctttaggttactggtccccctgttagacatgagcatgctgaagctagaggatgaattttaataacattcttaactattattggtctaacatggggaatatattgtgatttttctctgtaagaaaggtaatgtcttttttatttacttttcatacctagtactgtagaacatctgttttttaaaaaagactctgaccaatacagaaagaagtcaagtggattttcccaacacgactttgctttaagtgaagaaatgcaatgactttgtagtcttttcaaacatgtctgatataatatatggaatctttcttgaattcatttcagtataattgagttttctcctggagaaaataggtcccaattgcaccattttttctgcatttctgcatcaactctgtgaaatacatttttttttttggtttgtttgtgtttttttggagacagaatcttgctctggagtgtagtggtgcgatcttggttcactgcaccctccatctcctgggttcaagagatcctcctgcctcagcctcccgagtagctgggactacaggtgcacaccaccatgtccagctaatttttgtatttttagtagagatggggtttcgccgtgttggccaggatggtctcgatctcctgacctcgtgatccgcccaccttagcctcccaaagtgctgggattacaggcgtgaaatacagttctgaattctgaatatctgctctgcttgatgatagtgattcaaacttgatcagacttctgcttgatgatagtgattcaaagtctttggctaaaaatatgtcatatacacttagaatatatgttagttataatgtttgctagagccgctttgatagtgcaccacacagagtggcttaaacaatagaaatttattgtctcacagttctaaaggctgaaagtttaagatcaaggtatcagcatgattaaacatctaccctattcttcttgttcttttttatgacattggaatataccatatttgaaaaatgcattttagaaaaactaatggaatccaaataaagtttggaatttagtgactaataatatattaatattgattcattagttatgacaagtgtaccataataatgtaagagttaacaatagaggaattgtatcacaaatgaaattacaaattatgttacaaagcaaaagtaatcaaaacagtgtggtactggcacaaaaacagtcatatagactattggaacagaatagaaagcctataaatgaagccatgcataaatggccagctaatcctcagcaagagtgccaagaatacacgatagggaaaggatagtgtcttcaatgaatgatgatgggaaaactgttatttacatggagaagaatgaaattggatccgtatctcacaccatacacagaaatcaactcaagctggattaaagatttaaatgtgagacttggagccataaaactagaagaaaacatagggaaaatgctctttgacattggtctgggcaatgattttttggatatgatactaagagcacaggcaacaaaagcaaaaataaacaagtggcactacatcaaactaaaaagtttctgcatgcaaaagaaacaaggagcaacctatggaatgggagaaaatgttgcaaaccatacatttgacaagggattaatattccaatacatataaggaactcagacaactcaattgcaaaaacaaaaacgacctaattaaaaaaaacggaaaaaaggacctgacattttttcaaaggtgatgtacaaatgtccaacaggtatatgaacatcattgttcatcaaggaaatgcaaaccaaaaccacaatgggatgtcacctcacccctattgtaatggctactatcaaaaagacaaaagtgttggtgagggtgtggagaaaaaggaacctgttggtgggagtgtaaattggcacagccactacggaaaacagtacgggggtttctcaagaaactaaaaatagaattaccatatcatccaacaatcccacttatgggtataagtcccaaaagaaataaaatcagaatctctaagagctatctgtattgccatgtttattgcagcattattcacagtagctaagatatggaaacaacgtgtctataaacaaatgagtggatagtatatgtacacacacacacacgtatgtaatggaatattattcagccttaaaaaaggaggtcctgctatttgcaacaacatggatgaacttggaggacattatgctaagtgaaataagccagacacacagaaagacaaatactgcatgatctctgttacattttcaaaagtcaaactcatggaaacagagagtagatgggtagttaaccgggggtgggggtagaggaaatgggaaaatgttggtcaaagagtacaaacttttagtgataagaaaaacaatttctgatgtacagtgtggtaactatggttaataattattctatacttgaaatttactaagagagtagttctcaagtattctcaccacacatacaaaaaaggtaactagtgagtcggtggataagttaattagcctgtgtggtaatcattccacaaggtatatgtatatcaaaacatcgtgtggcacaccttaaatatatgcaatttttatttgtccatcatacctcagtaagactggaaaaaaatagaggaaactgagtgagagaggtatatgggaactctgtattatatttggaacttttctgtatatctaaaactattctaaaatccaaaggttattcaaatataaaatccttttataatataaaatagtgtctatattaaacattccatgaattctgtacttagaattattgtataattttattgtttttaatgccattgcttatacatgtttttgtactcaagaacaaattggatacggcctctagaggacagtgttgggtcatagaaagattttacaatttctgcccaagttgaagatggtcataatcatttttcttcttcttttctaaccacaagtcctgtttattcgttgtccctctgtaaaaacaacaataacaaagaacacttatgacccctctgctgttctgactagttggctgttttgttttaacttattttcgtataattttggttccacaaacatctattaggcaagaaagatctgcggagttggcaccataatgttcacatccctgagggtttgtgaaagttgtgagggaacccggggaagcgatatgaggcgtatattatgtgtcatttgtgagttcttccacgatggagacggaattatagagttgaacttcctttggaaaaacaaaccacggttcgtagcttgatcagggtgcatgtaagctaaagaggggttttggtcttttaaaggttgagactgcctgctctacagtggtttgttggtggtgggaggaaaggaaaaaaaccattgctcttgcttctggagcaaatttctggagtaatcagaatagcaactcaacattttaattttaaaattcctcctccggagataacctcgtaggattgccattgtatttgcccggggctcctgaggtggggagttgcagagtgctgctcaagtgcgtcagagccatatgaacattcacctgcaaaatgctcgccttggacttagaggcagctgaagacaattgttcatgaatggatgggctcagaaattctgaaacacacaattctgtcattgaatgcgctgaattttctgccgagagtggagtctgagggttctaccttgctaggtgtgaatctagtataaacattaaaaaataggagtcatttggatgatggtgtgttccacttagcagcaacctatagtttttcgtttgtttgtttttgctcgaagaataaatctgtccaaagctcatctgctgaattgggatctttgagccttttaataggagtcttgagagggagtggaaaatgtacagctccttatagatagcccgacatgaaagttaaggtcaatggtgttttgttcagccactccatccaagtcgaacccacgggcagggatctgttttgttctcatttactagtgctaagtgccaaacattctctttctcaggtatagtcttctaatttagtggtggtgtgacaaagttctatttaccatataggtacttaatacgtattatgatgatttaagatgtagttggtccttgagatcgtgattggtcccctcagctggtccctcactcaggattccttatctcagggaaaagcatcaccttatcccagtggtataagtcagaatcttgggagtcatccttgaatcctctgttttttccatccttactcataatgaatgcaggaccaggtcctaccaatttcacttcttaaatattttttgaagccatccatttctctctccatggccgccactccaatctaagcccttgtcatatctgcttagactactgaagaagctgcctcaccctcaagcagtgtgctcttccaaaacatgcatctatgagaccgtcactgatttcccattgttctcaggctagcaaccttatcactgtcatggacaagaaggccctgccgtcgggcccctgtctctctttctagcctcatcttgaagccttctccctgctccttgtactccagcctcctagccgccaatgtgtcagcagagagtcttcgcgtattcagtttcctctaggtgactgtctctcccctgctgtctctgtctcattaccttctactcatactctctaaatcagctggagtgttatttcctcatggatgacttccctggtctcctggtctaagaagtgttctttatttttttatttttattttattttattattttatttattttttatttttttatttatctatatatatatattttttgagacggagtctcgctctgtcacgcaggctggaatgcagtggcctgatctcggctcactgcaagctctgcctcctgggttcacgtgattctcctgcctcagcctcctgagtagctgggactacaggcgcccaccaccatgcctggctaattttttgtagttttagtagagacagggtttcaccgtgttagccaggatggtctccatctgctgacctcgtgatccacccacctcggcctcccaaagttctgggattacaggcgtgagccatcgcacccggcaatttttttattttttatttttttattgagatggagtctcgctctgttgcccatactggagtacagtggtgcgatctcggctcactgcaacctccatctcccgggttcaagtggttctcctgcttcagcctcccgtgtagcttggattacaggtgtgcgccactacgcccatataatttttgtatttttagtagagacggggtttcaccatgttggccaagctgatcttgaactcctgacctcaagtaatctgcctgccttggcctcctcaagtgctgggattacaggcgtgagccaccacgcccggccgagtgttctttattggctgttcttacagacccatgctccttcccctcactgtacttacatcagttcacagtgtctttggttgctgtttcttgattaatgtctgtctccctgatcagagtatcagctgtgctccagttgaatgatgaaggtaaatcttaaaaagataaagtaaaggaccatctctgtgagcaggggtcacgcccaagtgtgctcaccatccagagtctctagcacttggcacagtgcttggaacaactagttgctgaatacatttgttgaatgactaaatggctatttacttattgaatgtttaggtagaggaagaagaacccactggatacattcgattcgaaaaatttcttccggtgatgacagaaatactactagaaagaaagtaagtaagtaaatgcaattgttaaggcaaagtaatggtcagaattatgaatccattcatttcaggacgcttggctttttcactttgtgtgttatactcaagcagtgtgtcctaaggtggcctccctctaacctttcaagctacttctgaactggcagttggtacctgcttagaaatatcaaccacactagtgttatcctaagcaaagcataattagagggtaaataagctataaagatcgtaaatcaacattcttagtatcttctgttttgaattatcaatgataaataagaatcctaatatttttctagcaaaaatatagcattagcttaccatagttggttcatcatagaagtcttgtgcccagataaattgatgtccaaaaagctaatagataacctcaaacatgtcagtgattttgcactaaatatttcctgtggggctgaggtattttcaactttcatatccagaaatccaaaaagatttcaatgaggcaagtattatcatcccagtatgttagcagcttttattttattttattttattttattttatttttgagatggactttcgcttttgtcacccaggctggaatgcagtggcaccatcttggctcactgcaacctccacctcctgggttcaagcaattctcctgcctcagcctcccgagtagctgggattacaggcacgtgcatgccaccatgcctggctaatttttgtatttttagtagagacagagtttcactatgttggccaggctggtctcgaactcctgacctcagatgatctgcccacctcagcctcccaaagtgctgggattacaggcatgagccaccatacccagccctattttgttttatgtggtcatttattacggggatccccaaccaccaggccaggtactggtgccagtccctggcctgttaggacccctgggccacacagcaggaggtgagcagcaagagagtgagcattactgcccgaactccgcctcctgtctgagaagcattggcattagattatcataggaatgcgaaccctattgtgaactgtgcgtgttagggatctaagttgcatgctccttatgagaatctaatgcctgatgatctgaggtggagcagtttcatccccaaaccatccctcccctcccctggtctgtggaagaattgtcttccatgaaactggtccctggtgccaaaagggttggagactgctgatttattatgtaaagactgcggtaaataccacggcatttactcattttattgcataattatagatacagaccaattccagaagatgtccttcttcgagcttttgaggtatgtaaactccagcttatatgcatatacatatatataaatacatttatttacatacacacatatatgaaaaatttatcatgtagaacttattcaccaaatgaaaaatataatatctatcttttcttttcccctaggttttagattcagctaaacgtgggtttcttactaaggacgagctgatcaagtatatgactgaagaaggtaagtgtgatttattacttatcacaatgacttatgtgaggaattaataatttgttaacagttatgcgaaagttataggggatactttaaaatcagtcattctggtgaaagttatttactgttcctgctattttggcttggggatggtttctgttctgtgggggttaagaggacaaagagtagggaaaggggagatgggttgttgtctcgtagaattttgtgaagcacagtgattacttctataatttcaggcattgcattcagagcatttccagaataaaagatatgccatctggaaaacatgaactatcgatcactgtaaatgaaggcctcttcctagattgaagatttgaataaagaatataaaaattccgccccccccccggcgccccggcttttttttttttgagacggatccggtcttgctctgtcacccaggctggagtgcagtggcgcgatcttagctcactgcaacctccgcctcctgggttcaagtgattctcctgcctcagcctcccgagtagctgggattacaggcacaggccactgcgcccagctaattttttgtatttttagtagagatgggtttcaccatgttggccaggctggtctcgaacttctgacctcaggtgatccacccatcttggcttcccacagtgctggtaaaaattcccttttaaagagcttttctgtcagtgaagttacagataatgtagcctcaattgaatactgaggtcatttttaacactaaaaatgtccttttttaatgttaattgaaccatatatatttgttttgaacatggcccatcatacatatatgcatacacacacataaaacctgcacacttatatatatatgccaacatatttcctttaggaattctctctgctaggctgatgtgtaaatttgtttacactgaaggtcagtagcctgatggacagtctcctgaaaccatcctcatattggtccccttgccttctcccatacaaagctagagctctctggttcacagactgggtcctgaatgactcagagttgctaatcacttgaggcagaatgaaaagcgcaagtgattttgagtagggaagactaagactgcatctacacgcacaactggtttgaccattccagcttcatccaccttaaggcggaatacagagagtgagggtcagaatggcaaggccgtcacagctgccacccaagaactctgacgccattgttaaaattaccttcgggattaattctgatggggatgttacgactttcaaagcatcagcttcttcatcctgaggattagtctaaagaaagtaaatcctaggttatatatcaggcaacatgaatttagtcaaaatggcccaaacagttagattttcctactgttgtgtgcctactatatgtttaatatttagtaagtgtagtaaggtataatgatacttaaatctacttcctctctcaaggatattacaatcttatttgggaaataaaactaacataaaataattcacaatacaagacaatagaaagctaaatatcagaagatcaactagggctggcccagcctggaaaacttggtttgggaagacttaaagagaaaataggttttttgagatggtagaatgtatatggttaaattgttgagggcaaaggtaaactcttgtgcattataattctgtcacacatggtagatatcaacaaatgtttgttgaatgaatgagtgaatgagtagatgatgaagaccaggtgaaggggctaatgagagggagacattatcgatgtgtaaaacagtctgaacaaaaatggggaggtaggaatgaacatgctatttcagagagaaaataagcctagctggcccagagggtaatgttggcaaacagcaggaaattaacttcagtagacttactgggactaaattgtggagtcccaggctcaggagtttggaattcatcctgtgggcgatggagaagtattacaggcttttgagcagatgactcacatggtgtgtgagtgattgtgagaaggtttttctggtgctggtcggtttgttagatgcataagaaagaggttggactagggaggccacttagaaggttatttcagcattttgagggcacccaaataagggcctgacctggcagtgggaatggcaatgggaagaagggattggtacaataggactgtctgtggcaggatccatgggtcatgatgagtaacagagtgtaggcgacaaagctgagagctgaatccaaagtaccaccaaggctttgccctcgatggcgagtatgatggtaatgagactgactcaaacagaaaggtcagaacagaccgcagtgtatacagagacagtgcgaccacgtggtttacttggaggtgctgtgtgataatttcgaaaatggtatgtttacagagagttcatggtacttaaagatcaactattgagtatctcagcggactaagcataggacaggtatggtcaaataagaatacatatgttttcaattattcactcagcaagtattattacaaaccttccacatatatgaaccaatatgtttggaagtaatatgtaagatgtaaatctatacaaatctaagttacgatttaatataacagacccatcagctaagtgtaatagcagttgactagtttggtaaaataggagcttaagaattgctgctttgagagtctcagaattctacaaattgtttttaagtacatttatgctatataacaatatggattcaagctacttgcacattcatcctaatatccacaaagtatcaaacacactagtttgagaatatgcattcctacagccctggatgtcatatgataaaataaatcacactgaatcaagttcctacaagatagaagtccctaagtgtccaggaatgtgtattgcatcagacagtgtttagcagccgggaagatctcagaacaattttttaaacaaacacttgcatgttgctgcttctatgccaggtactgttctaagtcccattcaaatcataacacgtttcattctcatgacaaccctatgtgacaggtggtgtcgttatcacccccattctagagacaggtaagctaaggtggggagctgtgaagtgacttgctcaagatctcagagctcgtgagaggcagccagcatgtggatccaaacttgtgctttaaccactcagttatcttccttccatctttcatcaaatactggggcttcaagttaatcctctggtaatttcaaaagttttaatctaaataaataaccttgttcatgatgtctgtatgtcttcctactgttttgcctgaaatgacgtgttctagaggttgcttgatctatgacatctgcaggctaaaagaagtccagaatctaccagggtgtacaatagccttgtctttgaacctctggactgtcgtgatgtcctggctctacagctccagggagcgtaactagtggcactgtgggagcttgtggggctccatggctattaagctggctagtggaaagagaaaaaaatcagatgatcctaaatgataaattttcctttttgtctctctgaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataaattactatttatttaaaaactattcttaaaacattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaatttatttttttatgagtgccaattacaaatatcatttgggataataataacttagtgtaaacatttatatttgctgatccagcatgtcaccatttatggagtagctaaaggagttgagatcattggaactagagaaaagaaggttgagtggaagttgatagtgtaaggtagtggcaattctccctttgtctttagaattctcacccactccgcatatctgtcatgggagcattgtcctgaatactgagtaagaatactgagaaatgttatggtgtgcaaatgtacagctcctgaaagagcagaatgaagcacaagcagtcacaatggaaaaatatatggcatggccactgcctcctccttgcaattctctccgatcttggcatcttatatggcaactatatggcaacttacaagcaaaggggaagataaagtaaagggaagtgaacaattttccaaacttagatattctgttataacaagacacacacacacacacacacacacacacacacacgggtctctatttgaagatggcttcaccactatatgtgtgtatctacatagatgtaaacatttagagttgctgtgagccttcctcaggcatgtagtcttgcccccaaaagaggcggctgctacccaagagactgtcgctgttcattcattcatgaaacactgaaggagtaccatgagatgatgtgctgggaaccggagtccctaacgaatccaggtcacagtttagtgagggaagcctgcaaggcagtcagcagccacatttcagataggggcatgttcagggtcccgtgcaagtgccgaagagaggcagctactcagccttgcagggagagagctttctggaagatgaaaggtgctagtgagcggagaaggcttcccaggacaggaagctcctgactttaaaacgagtagtttagtaagtgggtggcggggcacagggcatttcagcaggtgagcagcaagtccagaaaccctagaggtgtcatgaaacatggaaccacctgggaattgaaagcagctcagtatatttggaatgtgggagatttgggggtcatgatgagaggtgaaattggagtggtaaacaggagcggtatcattaaggatatcgggttaggtgctgagttaaggtttcagtgtgagagtttggactttattctgaagatcacagagaaagatcatttgtaagcagcatggaaaatagatttgaaaggtcaagactagaagtgagaccagtttgtaggctatttggttggtgggaggggatagactgggaaaagtcaagcatgaatcccaggtttctggctcggacgatgggtaaaagtgccattcattcagataagaagtccaaggagcaagtggggcatttggtaagcaaaatgatgaggttgggtgcagacaccttgggacacccaaagggtgacattcaataatcaattggatataggagggagatctggctggagacctggattttggaactgtcagcatgtaagtagtattaatgccttgaaagtagaagagaagacagtctagaacaaaaccatgggggatatcagcatttacgggaaggcagaggaagaagagcccacaaaagagactgggaaggagaagcctgagaagagggaaagctggaaagaagcatcttggatgccaagatcggagagaattgcaaggaggaggcagtggccatgccagatgtagtggagaggagagggaagttaaagacggaaaaaacgtccattggtgttagcaatggagagttcattgagggcctctcccacagcagatgtggggaagcaacagggtatggagttgagtggatggagtaaggaatggatgtgagaaggttgcagcctggaggacaagttattcggcagtgaagaggaggaaacggacaacaggctcggggagtgatttttggaagatgggtggatgtagcaagttcatttctagtccaagggctgagagcccacagagaaggtgaagggaggggccagcttccagagcaataaagagatttaggaacaatgaaccaacgcttgtggtccctacctcatggcctctgctgccttttggagaggaaggtagtaggttatagagtttcaagagaatggtgtaattttggaatatctcttgtgggaaatgggagaaagagttgagaaagagcccatgtaaggattttcaagaaaccctggaagattttgtgctcaggagcaaaaaagaaaagaaaaaggtagattgttgtaccagggttaaggttttgtcatgtgcgtgaggtggaaggaatcaaaggccgaggaatctgggagaaagcagttccgatggtgtccgtggggctaacgcatgagggaaagacccaggtaggaggagtgggtaacaggtaggaggagtgggtgacagatgggagggggtgagagggctcggggccctaaaagggcaagtggctggtgttggtagcaaggggtggtctttcctgcctgagtgataattcctgagtgataatatgtttcccttgaaatttcgcttcgatgtgttcttagagtgtttcttttcttctcctgtgttattatgtgaataaatagtaagagtggctgacgtttgttgactgttccctgcgttgcaggcactgtcctaagtgcttgacgtacatgaactcatttcatcctcacatccacccatcggtgcaggtgctattaagttatccccattttagaaaggtgacaatcaagaagttacacagcagtaagtggctgtatcagctttttctaggttatattgtgataacaaaactcccacgtgtcagaggtttgcaagaatgaagcttatttctgtttacgttttttttttttggtcagctggggtcatcctggactctggcctacgtgtctttgtcctactcatggcctagagaggtaggatgaccgtctgtcctgctttgcccgtggtagttccagactatacctgtcccagtgtaattattaataggtctcctttgtactcttagaaatgttccagtttagatgattaatatgtggtcatcccattcaaaaaatagtgagtaaaaacggtggtgaggaatcgtcacttctggaaggcttcctgacagataattccagcagtggtaagaatggaaggcatttcttccttctctagtttcccaagatcatttttttccccaggataacctgagattttcccaaggtaaaatccaaatagagacctgatgtgccactggctcggccgtgcatgctagaatcaccagccagagatgaggatgaaccgcgtgccttcaggacagggcggagacggaggaggaaaggagtgtggtgatcctcggaacatcagcagacaggctgttgatgataggaacacattgcagcggggaaggaggatggctgagatatgaaatacccttcaaggtggacgcatacccaggggcatgtcattcggtggcaggggccagcacggacatgcagcactgaggcgtgtgctagcgcccagtgcgtcgacccaggcacggacttgtttggagcatacaggacagctctgcgttaagacctgtaagccattaaagaagtacagtctggtgaatgaaccctaatctcttgatgatcaagtgatgacatcatattctgtctccgaggagacaccctcttgcacagaaggcagtagaggaagcttgcgtcgagattgcctacctccccagccccaccttcgagggttctttcaaaagttcggactgatgttcaacttcacatcttgtctcaaggcaatcctctctgtttagtctcatagagttggctttgtggaatgtaattcatttttatctttagcacaaatttgtctgtttcttttaaggccaccagaaagcacaacatagactccccacagaaatctcattttatctcctaagttgcagaataaacgtaccttgtttgcaaagggaacattttcctttacactcaaatcacttcaatgtgtattttgcctcttcagctcactgacctcgcccgcagcatctgatgtaagtcaccatatgccatttcccgactaggagagtgcttggcctcttgtgcaggaagtttgcttaccctcatgactcctggcttccgcagagcctgccataccccacagcttggccgggccctgtggaaagccatctctattctcacactgctggggaaggtgcatgactcaggacccgacacacaggcctgagagtctggcgatcttgtgctctgatcccagcttcatgtgtgactcactctggatcaggcgcttcacttcctgtgcacctctgtctgtaaaatagagagcccagctctagtccttctccctcctgagaagcaatgcagagatttagtcccctttgcagtcacccagtgtctaagtaccaaatgcccaagagacaaaaaagagtccaagatagcaggctagttgggattacgactgttcgttaagggcaggagtattttctgtgggatggaatgtgtttagatctctctctcctagtttcctgtcttccttcctttcgcttttctaaatccttccatgtaagaaagtaccctgtttatacagacagttccttgaagatcagtgtcactaccttaccctcctgggctgcttaaataaacggagagcctcatgggtgccaggcatggtggctgcctcctaggcctgcctatttctgaaagcatggttgccaatcatctgcttcaggagcatctggaaggagggtgttagaaatgggaggtgtgccccattccagacccctgaaacagaatctctggaggtagggtccaggaaacttatatttttaatattctcaggggatccttatgcacgcttgtgtgtaaaaagcactacctggggctctgatattgaatgaaagtgtgggatttggagttaggctctgctgcttactgattacgtaattggcccagacatttaatattgctgagcttccccggaggtcgaggctacagtgagccatgattgtaccactgcactcagcctgggtgacagagagagaccttgtctcaaaaaaataaaaaaatattgctgagcttctgcatcttaatttgtaaagtggaaaaaacacttttcggggctggtgtgaaaattaaatgaaataataaaagtgaaaatgtttaaaaagctgtaagctatgacacaaataattatttacagaaagccagctaggcagagagggagagagaaaaagagagagggaggggcagggatggagatctgctgcctgggtgtggacagggaggtggggaagtaggtaaataatagaaaactaattggagagaacgtgcgcatacctgggctgctggtggggagatagccgaggtttgctgtcatggtgctattaattataaggcgttaagtttatttctagaatgtgaaaacaggaggccttaagaggtttctttttttcttcttttaaaaatgtgctatcagtcatggtacttttagagcagcaggaattatttacctcatctagtggagaaaacactcttaatcatttgaagaaactgttatttttcttaaaaaagaaaaatcaggccaagcacagtggctcatgcctgtaatcccagcactttgggaggctgaggtgagcggttcacttaaggtcaggagtatgagaccagcccaggcaacatggtgaaaccccgtctccacaaaagtacaaaaattagccaggcgtggtggtgcacttataatcccagctactcgggaggctgaggcaggagaattgcttgaacccgggagatagaggttgcagtgagccgagatggtgccactgcactccagcctgggcgacagagcaagactccatctcacaaaaaaaaaaaaaaagaaagaaaaagaaaagaaaagaaaaatcacaagttgaaaaattgaggccaaacctagttctgtggagaaggagataagataaaatagcacactatgaaaatcgggccatggttttatatgtgtggcaggtcaaaatgccaaatatatcttgctggctccccccacacgccccggcattaagttttcagctattagtaagaaatctcaaaagaggcttctaagcatttatcaccaaacttaggaaatgtactgaagtataggtgagtattgcatgactttaaatacagcttttaaacatgtcaagatgtgtttccatgctctgaatgcctagttttaaactgtcttgctggctggtaaccattcctggttactaactcaaggtatgatccgcacttaggcaaagctcactgttaatgagaatagaggtaagtctattttccaactagtcttgataatgtttaagttttcttagttcttctttatcaaatccgattagcctgtctttgttcttacacaacatgatgaagagctcatcctggtggaattgtcggccccactgttctcggaaaacccccctgtgcttaggtgttgggatatcttcaattcgaggttactttttaggaactttttaagcctcttatcagtttttgaggactggtgtcattaaaaccaaataacatctgcaaatccttcactcagttggccacctgtacggttagtgattgcacggaaataagcaaggtggaatgagtacacgagcgaaggctccccgagcttccttcaggacagccgcctgccttcctgatacgtgcattcctggtacatgcatttctgctgtatggaccccaggaagatgtcaatgagatttaactctaacacagaacataaatataaattaaaacaaatcctggttttcttcctgcaccctgaggagttatcttgcgttccctgcaggggcacctcactgtgagatggctacgttagagaatcttctcaggaagggctcttttggaaaaacaatgtaaagtgtaaaatactctaaaaattactagagtggctcccaagcaataaagagaaattggaaaatgccagtaaacaaaaaagaagaggaaaaccccttaattccacagaagttaaccaccattactaatgctttgcttcatctcttctgaaagctttttccaaggatgtgtctctctatagaacttctttagaataatatcactgtggaacctatcagttagggtccttgaccataaggacagaaagcaggactcactggaaggcacctgggctgaggaaagagtgctcacagagcctactggagactggggcaccaggctcaggccaacaggagccaagggggcatctgagggcaaggaagcatggtgcaagaggatagcaaacatcacacaaccggaacagcccgtgcagggccgctgctgcaggggatggctttgcactggctcaggttcaaggcctgcaagacacagcccactgagctgagctccgtctggcctgggcaggcaaggaaggaccttgcttctaggcagccatgtggaaggcaggaatcctccaaccaccagctacaccccgctggagggagaaaatactctggtgagaaatcagggtactattggggaagagaaataaataaataataaacacgacaatactacaggatcagaccatatatgctattatgtaatctgctattttaaatgaatacataaggaacaatctttccatgatagtgtgtactcacctaaaacataactttgagtgactggatagtatcttattgtttggagataccttaattaattaattaatttagagacaggtctcactgtgtcaccctggctggagtgcagaggcacgatcatagctcactccagcctcgaactcctggcctcaagcaatcctcccaccttggcctcccaaagaaccgggattagagccaccacacctggcctatttaattagttcctcatacttcataatttaaataattttcagttttcactattataataaattgtgaccaatatcctagtagttaaatcttaatttaattgttcacttagaatacattccgaaaagcagaactgttgggtcacctttaaagtgatggggacctatttttaagtcttttgctaatgtgttttcaatctgtcctgcagaaagattgttcccacattctaaaccctcctcagcatatttttgctttttattttgcaattagatagggaaaaatagtatctcattgatcttttaaaaatttgcattccattgataagtggagctttctaaaggcccacagcaatgtactgaaagattcaattggattagctccaggaagcaccaaattggagcctcacagattgttttttcagatagaaacaacaaacccctcggctgctatgaaatggagcccacaaagcacaacatgacagacagaatctgaattccagagacacagtttctttcagaacaaatattatttgcaggaggcaattagaatgagccactattgcacagtagacttagcaggaaatgcacaaatattcaagcaacaaaataggaactggggaaataagcctgcaaaagaagtgaagaatgtccaacacaggcgggacgaggggccaactggcctcccgcgctcacaccaaaatgccagcttcttaggctgtgacagtgtttcctaatgcaattcatttgctcattcagtcagcattcattggattctcaccatgtgccagacactgtgctgggtaccagagatgccaaaatgagtatgaaacatagcccttgtccttgagagatttcagcctcatgggagagacaggaagaccaataatgacactgagcaagagttgttcagcaatgttagcaaagtgcattggggtcaatgacagcagctggctctgcctgtgggactcacagaggacttcatagaggaagtggcaggatgaactgcaaatgttttatgtgttcacattggcaattctgctgccaatactggggggtgagaatgttctagaatgagatggcttgaggctaatgctgaagtagctttttaatagcatggcttagggaaaagagtgctgaattccagctgtgtcaggtataggatatgtgacctggggaaagtcacgtgatgtgtctgtcctctgttgcccatctgtaagtgacagaaatcatagctaccttgtaggcttactctgagcatgatgggctgtctgcacacagggcttagtaagtggtatctgtcattacaaagtgttcagtaaatatctgctgaatgaatgaatataaatattttctctatatagtaaatatcttcaattatataacgaggttgggtacaggtatttataggatgtccgggagtagggaagtccattttcctaaacttgtgacctcagggacttcatggaaagggtgtacatgtcattttaacttcattcattcaataaaatatttaattagtgatattctatgctagaaacaattctagtaaactggtcgggtgtggtggctcacgcctgtaatcctagcactttgggaggccaaggtgggtggatcacttgaggtcaggagttcgagaccagcttgggcaacatggcaaaaccccatctctaaaaatgcaaaaattagctgggcatggtggcgggcgcctgtagtcccagctacttggaaggctgaggcaggagaattgcttcaacccaggaggcagaggctgcagtgagctgagattatgccactgtactccagcctgggagacaaagcaagattccctctcaaaaaaaaaaaaagaaagaaagaaagaaaagaaacagcgctagcaaacaaaacaaagtccctgtccttaaggaacttgaattctggctgtgaggttgacagtaggaggcagataatacatcaataaacatatgtcatgtcgggattaacactatgaagaaaaatgaagcaggataaggggtgagagtgatggggtactgtcctatctagaatgacatggaagtcccctctaaggaggggatcttgagcagtggcctgaaggaaatgaaggggcatggggaaagggcattccttgtagaggaacatcaagcaccacgtgtttggcagccagcaggatcagcaaggagcaccccaggcctttgtggcctgagtgaagagagagaagcagatgaggacggagaggtgggcagggccccgagcatgaagggccttgtgggccaggaaaggatttggagctaaatgtggagagaagaagagatgccattgaatggtgctgagccagttaggggacattaccagggagatggtgtctcaggccggggagataatggtggatagtgaaaggcggttggatttgggatctatttggaaggtagaagcaacaggatttcccagtggatgggatggaagtagagaaaaagacaccaagaatgatcacaaggtttaggtctcagcaacgacatactattcgttaaggttgagggggaagatcgagagtgtggtttgagacgtgttcccactgagaagccaaccagacatccaggctgtctatataagtctggagctccggagagcctggggttggagtggtcagtgcaccgaagatgtttaaaaccgtggggctggatgggatcccctaaagagggagggtgagtagggaagagaagggctccgagggctgaacctgggggcaacccaaagttagagatagggaaggagaaagatcagcaaaagatacaaggcaaacatagtatcagggcaatcccaggtcctattccgtcccccatcctgtgtccccagggcctccatcacccagttgtttctcttcagtgtccttcggagtccctgaggcaagctggactcacatagactagaaaattctagtgtattttgtgtgcaacccagtggtagcgccgcgtttttcagttgctttgaaatctacgaatatcccttctcatcacagtccgagtgaactgtcctgatgctgtggtttctcagtgtctctgaaattcttgtgaccttcagtcctgaggaccattcttctctgagtagggaggccgggggtcaaggccgggcctgactgccattgttctgactgcagaactgaacggagttcgatccagcggagcccgtgtggcggctgtcgaaagtaagcccttcacaaaaatggtgtgcctaaaggtaactgcagaggcactggggttcttaattttaaactatcagaaaagaatgaacgggcaacatgtgatcctcaggtgtgaaatgcaaccatcacacccttgtcccagaaacaccgtttcattttttctaaatcaagtgtgactccagtcccttactggccagtcataataagaggaggcctgggggtttatgtggtgcctctgaaacctaacaatacggaccaagaacatgacaactgttgaacaccaaaactggctccgtcacctacatcatcgcctgagcagccctgtcccctccccagtccactgctccggaaactggaatgacccttgtgaggaaaccagtgagaagcttgagcagttctctcaagggggggctttttcaacagattgttgaagggactatatcgacatgacgtttggcaaaagcccatagtgagactagaggagagaaagctgagtgacagccagaccctaggacaagggaagttcttccctccagtttgcccgccagccaacagcacagccaccagccctgcccacccttctgatgctgggacgcagccccgccctgccccgacaccaggccacaggccacaggccctgtcaacagccttcccattcctggcccagagaccctacctgctctctccagacagttcagctgtttgttcatgcaaagcctttctgaaaacaaaggcctattaattctgccccgtttgcaagtgaagccccagttctgtgggactcaaagcacacgctgatcgcttgagggggtggtgagaagacgatgtgaggaaggatgacttatttttttctcttttaacagcagaaggaaaaaacaaaaaatagtaactccataaatcatcctgccaggcagagaggaatctcccatttttaagctacaatacacgtttttgtaaaatgttttactatagagagttagtagacaatggtacagtgtatctccatgtaacatcaccctccccgccggccatcaactcgaggccaatcctgtccccatctccagaggtcacctccctcataattttgaagcaaatgtaaggcattattttattttattcataatttttttcagtaggtatatttaaaagatacttaaaaataaaggctcttaaaaattacctataatactataatcgtccctttaaaataatgatggtttggccgggcacggtggctcacgcctgtaatcccagcactttgggaggccgaggcgggtggatcacctgaggtcaggagttcgagaccagcctgaccaatatggtgaaacccagtctctactaaaaatacaaaaattagctggacatagcggcatgtgcctgtggtcccagctactcgggatgctgagacaggagaattgcttgaaccccggaggcggaggttgcagtgagccaagatcatgccactgcactccagcctgggtgacagagtgagactccatctcaaaagtagtagtaataataataataataattgtttaatgttatcatatatccagtgtcgaaaagatcagttttcccgtaaatgaataaatgaccttaaaaaaatactatacagaggcctggcacagtggcttatgcctgtaatctcagcactttgagaggctgaggctggtggattgcctcagctcaggagttcgagaccagcctgggcaacatggtgaaaccctgtctctaccaaaaatacaaaaattagccaggtgtggtggtgcacgcctgtagtcccagctactcagggggctgagtcaggaggatcacctgatccttgggaggttgaggctgcagtgaacagtgatcggtctactgcactccagcctgggcaatagagtgagaccctgtctcaacaaaataaataataataataataataataataaatacttcacagtttgaattaggagtcaagattcaaactgtgaatcttgtgattggctaacatgggttttttgtttgtttgttttttgagatggaattttgctctgtcacccaggctggagtgcaatggcgcaatcttggctcactgcaacctccgcctcccgggttccagcgattctcctgcctcagcctcccaagttgctgggattacaggcacccaccaccacgcccgactaacttttgtatttttagcagagatggggtttcaccatgttggccaggctggtctcgaactcctgacctcaggtgatccacctgcctcggcctcccaaagcgctgggattacaggcatgagccacggcgcctggcctggctaacatgtttttaaagtttcttttaatgtgtagtttttactcccaatctttcttttatccttgcagtttaattattggaggaaccaacttgtttgtcctgtagaatttcccacatcctggttttgctggttgcatcatcatggtatatataattaatgtatttgtctgtcttctctacttgataaattggcaattggatctagagcaaattcaggtttgatttggcgggaccagattactttacaggtgttgtatccttctatcaggaagtacatgatatctgattgtctctctatgacgtcagtactattgttgatgaacactaggtctatattaatacattatggactgcaaaatggtgataatctaattctatcattcttcatttactagtatttccttgatttataagtattttcctttatcagttttcaatattttcaaggtttctcaatattccttaacagcaaccaagtagtttttaaaattattttttaaaattgatacataatagatgtacatgctttcagggtacatgtgataatttaatatatttatatcaagtattttttgctttttagtattataataaagtcatgaatatttggtatatttcaatccattgtcgtcattattcttattgatgttcacagtatcccatttttgaacagtgggagctgcttcaggttggattctaaaagcttcctggatatatggcataagacgatttaggttcatcttgtacctattggtttccaatgacgttatcaatcttttgtgacacgagatcagggccaacagtgggtttttgctaatgatgtgttattaggcaataagtagaggaagagtttggtttgtgttagagatttacagatcattttacttgcttttgcaccgtgcttctacacaatagtgcacagacacacaactcactggttaaatggagaccacagaaatctctgggacactttatgagcagcctaatatctcctgattctacaagctagattggagaatgcgtctggagcctgaggccaaactgtggtcctactagttctcaaatcaagacaggattcacctgtggggaaaacgatgtgtacagaacctctgaatccattgtaataatcagtgtcattaggaactttatttatttatttatttatttatttatttatttttgagatggagtctcattctgtcgcccaggctggagtggaattatgtgatctcagctcactgcagcctccacctcctaggttcaagcgatcctcctgcctcagcctcccaagtagttgggactccaggcatgcactagcactcctggctagtttttgtatctttagtagagacggggtttcgccatgatggccaggctggtctcaaactcctgacctcaggtgatccacccgccttggcctcccaaagtgctgggattacaggcgtcagccactgcacccggccacttttaaatcccagtggcaggagtacttatagatttgccttaaattcccatttgttgggagaacaaaaaacatacaaaacagagtaggaggcaggtccaatacagactttcgaaaagtgataaaatgtggtaaaagcaaagcttcacacatccaatcagatgtcttcctcataagggaaagaacaagtaaccagctggagaggcccagcattgtttatttcagtcctccaccctgtgaggctgacgaggatgagaggtggtcctctatggtcaggaggggggaccagagaggccaagcattgtttatttcagtcctccaccctgtgaggctgaggaggatgagaggtggtcctctatggtcaggaggggggaccagagaggccaagcattgtttatttcagtcctccaccctgtgaggctgacgaggatgagaggtggtcctctatggtcaggagggagaccagagaggccaagcattgtttatttcagtcctccaccctgtgaggctgacgaggatcagaggtggtcctctatggtcaggagggagaccagagaggccaagcattgtttatttcagtcctccaccctgtgaggctgaggaggatcagaggtggtcctctatggtcaggaggggggaccagagaggccaagcattgtttatttcagtcctccaccctgtgaggctgaggaggatcagaggtggtcctctatggtcaggagggagaccagagaggccaagcattgtttatttcagtcctccaccctgtgaggctgaggaggatcagaggtggtcctctatggtcaggaggggggaccagagaggccaagcattgtttatttcagtcctccaccctgtgaggctgaggaggatcagaggtggtcctctatggtcaggagggagaccagagaggccaagcattgtttatttcagtcctccaccctgtgaggctgaggaggatcagaggtggtcctctatggtcaggaggggggaccagagaggccaagcattgtttatttcagtcctccaccctgtgaggctgacgaggatcagaggtggtcctctgtggtcaggagaggggaccggaggagggtggtctgggaagcactgcttgactcagagcttcctagtaccaagcactggatccactaaagaaaaggtggggagaggaagagtggctgcttgtggagtgggctatggctggaaactggtgagaaggtgatgacaaaagaaggcccattctcggtctaaaatctgtaaacaagatcctaagaagggagagtgggcttagggataagacagagtaaaaagaggcggggaagttgcagacggaatacgccgagccagcgacaatgactgggtggttcaaactttctttcctgggacagtggaaataagaagaggtgctcactttgatggggatgtggggatataggagaagagcctgtggatggagcacaaccaaactgaggttattgtgcagctggttttgcaagacactgatcaccagcataggtgattaaaaaaggactttctattaagaaatgttaacccttaaagagtaggatcaatgggccgggtgtggtggctcaggcctgtaatcccagcaccttgggaggcccaggcgggcagatcacctgaggttaggagtttgagaacagcctgaccaacatggcaaaacctcgtctctactaaaaatacaaagagcagccgggtgtggtggcgcatgcctgtaatcccagctactcgggcagctgaggcaggagaatcacttgaacctgggaggcggaggttccagtgagcggagattgcgccactgcactccagcctgggggacagatcgagactctgtcataaaaaaaaaaaaaaagaaaagaaaaaagaataggctaaatggacccccgtgtatttattaggcattgccattaacatatggccaatcttgcttcacctattctccctcaacagtttccctcacctccatcctcacccctgctcgttatttcaaaacaaattctagacatcacatcatttcacctataaatgctttgatgttatctttaccagaaaaggtagagataaggacctccttccccttttccccacacaaccattaaaccacgatcatatcttaaaaagctaacaataattctgtaatgtccgatatgcaatactttcaaatttccgctcttgtctcataaatatgcttttaccattggtttattccaatcaggatccaaacaaggtcctcgtgttgcatttggttgatgcgtatctaaatctttaactttccctccccttttgttcttgtctttcatttgttgaagagcctggtctttggtcctgtagaattgtccgcacgttggacttgtccgattgcatttctgtggttgtgtttaacacgtccctctattccctgtatttcccgtagaccaatttttatatctagaggctcgatcaatgtcaagttcagttttgtttttgttttttctttccttgcaaatcaacttcattggaagtggtgaatttttattgccttccttcaggaggtaacataatgtctggattgtctctttttgtcactcctcatactcagtagctgtcagcctgatctaggctgtatgaagctctccatcaacctgtcacctaatggttgccattaacattattttagtaggagttgcaaaatggtgatttttttttaaaaagattctatcattccttcttcatttatgcagtggaattcctctattaaagataattttctgaagaccagcctgggcaacatggagaaagcccatctctactaaaaatagaaaaattagccaggcatggtggtgtgtgcctgtagtcccagctactcagggggctcagggctcagggagtataacctgagcccaggacatggcggttgcagtgagccatgatcacaccattgcgcttcagcctgggccacagagcaagaccccatctcaaaaaaaaaaaaaaaacaaaaaacaaaaacaaaaacccaagataatattctgccatcaactattcggcttctttgaaatactgtttgttcagaaaaggcacagcagtttgcttcttttctttaatttttcaagcaaaatatttcttgatttctcttgaaaacatgcatttttggctggatgctgtggctcacgcccataatcccaacactttgggaggccaaggcaggaagttcacctgaggccaggagtttgagagacgcctgggcaacaaagtgagaccccatctctacaaaaatttttaaaaaattagctgggtatggtggcacatgcctgtagtcccagctactgaggaggccgaggcaggaggatcacttgagcccaggagttcgaggctgcagtattgcactccagcctggacaacagagcaagaccctgtctctggaaaacaaacagaaatatgcattttactttcgtaagtgtgtgtgtgtcataggtgggccttaaaattgcctgtatcccttatgagacgtataagcctccctttggcttgtgtgctagccaaaccacacttggtaacattcttcttcccttattagtttctggtgatttacagtgtttgcattagcagttacactgctctttctgtcacagtgaatctctctgggaggaagtgaagtgtttggacttgatttaatgaagctatcacagactgataaaacaggtttcaaatatcatagggttataaggaaaaagatgatttagaataattatttagataaatgataacagtacaccatgaattccataataattctgaatataactcttccctatgttaaataattaacatttacaaccatttaaatatatttcaatatttaatatatttaaattgtatatttaaaataatgtatatttaaaaataagaaaaatgttcacacaactcaaacttgcaccttgttatatctatgtttcttccattttaaattttgtcattcatcgatatgaactggttaccaataaatttggatttgtaagctaggtagaaagttggggaaatttctgcaggaataaccaggattaaccagataatttcaagattttcttgatctaggaattaagaattcatatgatatggtggcctggtgcagtggttcacccctgtaatctcagcactttgggaggctgaggctgacggatcacctgaggtgtttgagaccagcctggctggccaacatggcaaaaccccgtctctactaaaaatacaaaaattagctgggtgtggtggcgggtgcctgtaatcccagccactcgggaggctgaggcaggagaatcgctggaacccgggaggcggaggttgcagtgagccaagattgcgccattgcactccagcctgggtgacaagagtgaaactctgtctcaacacaaacaaaacaaaaaacaaacaaaaaggaattcatatgacatgggaactagaactatttccaaacagttgtaatccgattccaaagaaaccctgcacttctggtttcctgatgatgtcacccacataaatggctacgtcaaggagtcggtcctgagagcagcgaggcaggagtgaggtcgagtgggcaggcgtgagagccgagcacaggggcagaaaggaagactctgcacccagaaagcggaaaggaggcaagtgggggacaggggtggggtcactggcccaggcactatgggactgcacatcgcacacaacactaacttcccttaataaacactaagttaatctttacaactcttcagcaaggccgtgcaccccgggtccttctgttctgatcggaggacctcgcctcttattcagcagagagcgtagaacctttggcctctaacaccgccaaatctccctttcacagaccaactggcatctaagagctctaggggcagaagtgccgctgtggggcactgatggggcagggactgtggcgcaggtcacctcctgcctttgctgtctgacgcagcctcccagggctgcttgcatttggcaggggctcctcctccacgctgccctctcctggttctcagtcctgctcggtttccaggcaatcacagccccctgtgcaccactccaggcaccgggctcctaaagcagcccctttttcagagctaccctttagttggtgacactctccactaccaaccccagcccagcccagattccctccaagcacagttgtgctgggcacaatagtcatcatctctaagcttacctgtgatttcatccatcctcacctcgtcaccgctctcagaagctccgcgtcctcctggaggctaactcctcctctgctgttgttcccactccgggctacctcctcactgcccttcctccaccagagattccctccatgctctccccttgactttgtcaccatccctgtgcttatcgctttcagaccacagtcttagtcaagtccaccccgtcttttcaaagaacaccttcctttcctttagacgtctctccccgtcacccacccgtcacccagtctctctttccctccctccaccgccaagcattctgaagaaatgttcccctcaccctgagcttgctgcccctcccttccatttcccagcctcctgcagtctcactctgtctccagtacttactgagactgctgaggtcctcagcgacatgcccattgccaatcccagcagcctgtgtccagttcttcacgttttttgaattcactgcaacattgaatgcttgccagtgatgcctccttgctgaaattcttccttggatgaaaagacacattgtttccgggttatcccttttctctttgactattgcttctatgtcttactgaggcctctttctatttccacccttaaccattagtgttcccaggattctagcctcagctcaacttctttcatctctcccagtagcctcattcatccccgtgaccccagctacacttgcaaggactcccagatccaaacctttgatccagcctttcactgagacattctccagctgaatgttgtgctggtctctcatatgcagcagagtctattcctcctcctctcagctctcttttctgtccaacctagaccacaggcatcagtctctaggacttgcctcagcgtctctggggtccctccttccactctactcctataatacgagatgattccagccctcatcccctccttccttgacagttgccatagcctcctaactctgcctctaggctcagccccatccgatccattattcctctgcttttagaagtatttttctaaatagatatggccatggcttgtacctcagtatgggttttgtcaaaagcagaacctgaaacgaggattctggtgtagttgttgtatttgggaggaaacaatagtatgtgagtagggaaggaagacaggaaagggaagcaggccagtaaagggtgtgttgtcgagccagttacctctgcacgtaactggagctgaatcttgctgggcaactctaggagtctcgtagaatacatgcctcagagatatcctgcctgaggggcgagagagctcggttatttatactccgactctcatcaggcaatgagaggtgtcaattctgtagcagttcattcccctcctgcatgtacttggaggcagggggctcatgaaccccttaggcagtagaagtcaagccagctattgcaatggaaaggctcaaagggctagagaggggcacagatggaaggacagggacaatctctgtctcattaccctcctgcttaataatccccagaggtccccactgcccacagctggcctttctggcctcctcccctgcactgcttccctccattcacacaagggttctgaggtctttcctgaagaagacaagcaccctcatgccggtacgcctgggtgtgcatcgctctttcctccacatcacccttcgcttttaggttaactgataatactggccgcacgtactgggcacctgctacctgcagagtcatttatgtatgttagttgatttaatgtaacccctataatagcatatgagttgactagctaaaaagaatgatcacttccattctacaggtaaggaaatcacagctcggagaggttatctcaatgcctctggcacaaagctagcaagtggcagggccatgttgggagacccggctctctgctacaaagcctgtgcgaggcactaaccactgggctgaactacctcagacttcctgcctcagctcggcggtggcctgtccttgctccttctcacctaaatagatgtgctatcagctctgtcttcccatagcctatggtactttttttatgtggatgtctttattaagcgtgtgttatcttgtagtgtaagtatttatcatctgacttcccttttaaaccataagtccctcccattttaatcttcaatgcttggccaattgcgtaactggagtaaagacttcgttaacttttaaaagagcattaagttgaattctgctgggcacagtggctcacgcttgtaatcccagcactttgggaggcggaggcaggcggatcacttgaggtcaggagttcgagaccagcctggccaacatggtgaaacctcatctctattaaaaatacaaaaaatcagtcgagcatggtgatgcacgcctgtagtcccagctactcagagagctgaggcaggagaatcacttgaacccaggaggtggaggttgctgtgagccgagattgcaccactgcattctaacctgggcgacagaatgaggttccttctcaaaaaacaaaacaaaacaaaacaaaacaaaacaaagaattaagttgaatgaatgttgactttgtttcaataccatgcacacaaatactgaagaatgagacttcttaaataagacaggacctagttttgacttttctgggcatattctgctgggcaggaaagaaataagaacattaactctaatggaccacagacagatggcctgccagccagacagcgccccgctgagggccagagcagggcctttgcccaaatcaaggaggagcctattgtttcttccagtttgtgtatggaaggcaaaaacatacaaacaaaaattctttgaaagctcttcaggctctgcaatttgggacatgtttatagggcatgtgtaagtcacagtggtcagtggctctgtggccacagaaggcattaagaggaaatgttagtggcctcctcaccctttgttccttaaagggcttctgcattgacaccaacagccagaagggtttgctagcttttagtgtggttatagtgtggacttagacactataaaatgggaggaaagaaagctcctttttgggaagaaacttctacctatgtcagctatggtataccagctcacagagtgctaagaaaaaataaattttttaattaaaaaaaaactacatgtgcatgtttatgaaaacctggtttcacaatcagaatactgaacctgctaataaatttataccagaaaagcatgcatgctttgctgttaaaaattaactttataatttactttttggcaataggggataatgagaaagagcagcaaagatatctttaaaaggcagcagggagtcagacctcctcctcctttcttcacccaggtctgcactcgtgggcactgagtcgagaccaccaaatgcatgtgggtgggtctgatacccggtgacctgcagggacagcagcactcccagcctctgcccacctgctgaccgcagggcaaagtgtctagttgtaaaaggaaagtatggctccttctcccctcaacctggccgaatcttccaaagtcatttgcagaatattgactgcacagagcgaagaacactttgtttacaatgcagttggtgcaaaatgaatagactaatgaaggtgacgtgaatgtctttgactcatatttatagattttggcttctttgtttcctcttgaacgtattcgcagtgcctcctttctttgtctgtcttctcttcactttcatcaaaggcagcctgttccttctgaccttgaaatttcttttgtaaacatcatgcctgttggcacctgaacccacctaaagtttaaggggtccaggggtaaggggacttttagaaaaccctgctgtcctatggccaacatcagataactggggtgggacatagtagctcatgtctgtaatcccagcattttgggaggctgaggcaggaggatgacttgagcccaagagttcaagaccagcctgggaaatgtagtgagactccgtgtctatacaaataaaaaaaaattagctgggtgtggcacgcacctgtagtaccagctactctgcaggctgaggccagaggattgcttgagcctaggaagttgaggctgcagtgggaagtgtttgcgccactgcactccagcctgggtgacagagcaagatcctgtctcaggaaaaaagataatctggaagacgttattatttgtttttgtttgtttgtttgttttttagacagagtttcgctcttgttgcccaggctggcgtgcaatggcacaatttccgctcactgcaacctccgcctcccgggttcaagcgatgctcctgcctcagcctctcaagtagctgggattacaggcgcacgccaccacacccggctaattttgtatttttactagagatggggtttctccatgttggtcaggctggtcttgaactgccgacctcaggcgatctgcctgcctcggcctcccaaagtgctgggattacaggtgtgagctactgcacccggccttatttgtttttatggatgatccttattcctttacttatttcatttaaagttacctttaagattattggagcttaaaaaagaaatatgcagctgagtgagaaaaggttattgaaaattttactatatatgtgtgttcatatgcttagagacattgtgaaagcaggtaacttttaaacttctttatacttttacttaactgtggtggaatatacataacatcaagtttaccattttaaccacttccatgcatatagtccagggggattaaataaattcacattgtcgtgcagccatcaccctgatccttctctagaactttcttattccaaatggaaattccatactcctcaaacagtaactcccgttcttccttcatgttacctttttttttttttttgagatggagtctctctctgtcacccaggctggagtgcagtggcacggtcttggctcactgcagcctccgcctcctgagttcaagcagttctcctgcctcagcctcccaagtagctgggattacaggtgtctgccaccacgcccagctaattttttaattttggtagagacagtggtttcaccatgttggccaggttggtctcgaactcctgacctcaagtgatccacctgcctcggcctcccaaagtgttgggattacaggcgtgagccactgcacctggcccctgatactattttgagtgtgattcttacagtagtatcttatattttaaaaaacaggatacaccttaccttggtccttaaagaatatgtttgcttattctgctgtggttccaagattatttttcctataaagtttcccccctaagagcttatcaccgtgtcttacaggcgagtcagccaagtaagacatgatgaaaatgccagtgttatgaggttcccaggcgctccttcataaagatcctgagaaaagcttttaagaatgtatctaagagttgctttcagggatcttaactcaattagtggaggttgctgaccacaggccatgtctagagcacagactatatcgtcacgttactctgttgtcttctcattgttcaattcagcagcattttagaaggcccgctgtgtgctctgcactgtgctaagtactgcgagaaacagaaaagttgaagacgtggttattgtctgaaatggcagctcctgggaaaaagtgccgtagaaagaggagctggctatagaaaatatggtaatttctaacctaaaattaatatgccacttatgatcatacaatacgaacattaacgtgttcaaatatgagaacaggaacgaatgctggaaatatattaaagtaataacaaacaataataatattaacacctaacagtcactaagcatctgtcatgtgccaaacgccacactcgacactttacgcgctttatctcatttaatcccaccaagaacaagaagcttacggtgatggctcttgtccccagtttagttagaaaagctgacacacacagagattaagggcatggtactagcaagtgatgacgtggggctcccaactcagacctgcccgactccacggtccaaggctggtgtttgtcattgttgggacaaccattggtacactgtgatgtccagtctggaaataaaagagagtggattttgttctgttacattttatttttcacagaagtgaaaaggaaaaggaagcaattcattttaaaagcatccaaaagcaggatgttgtttctgtcacgccattgcttgggatctgctaccaactcccttactggtagcttaggcctcactggttgggattcttttttttaaaaattgtctgcctgggccgggtgtggtggctcacacctgtaatcccagcactttgggaggccgaggcaggcgggtcacaagttcaggagttcaagagcagcctggccgatatggtgaaaccctgtttctgctaaaaatacaaaaaaattagccaggtgtggtggcaggtgcctgtaatcccagctgcttgggaggctgaggcagaagaattgcttgaaacccggaggcagaggttgcagtgagctgaggtcacgccactgcactccagcctgggcgacagagtgagactccatctaaaaaaaaaaaaaaaattgtcttcctaagatgtccctagattccttcatgtacaacatccatggggacaccaccatgcaaagccaagtggttggccagcagccggttcctgccagtcttcctgtcaggctgaggactcgttcaagaggaaattcaccgatgcgtgaacagcctgcctgttcgtttggtgaaatagggcagattttttatttcataaaagtgtagtaaagggagaggctattaatcaaggatttaaattatgatcattattatttattatttttgagacagagtcttgctctgttgcccaagctggagggcacagtgatcttggctcggtgcaacctctgccttctgggtttaagcgattctcttgcctcagcctcccgagtagctgggactagaggcacatgccaccatgcccaactaatttttgtatttttagtagagatggggttctgccatgttggtcaggatggtctcgatctcgtgaccttgtgatccacccgcctcagcctcccaaagtgctgggattacaggcgtgagccaccgtccccagctgagatttaaattatttattttattatttattcatttatttattttgagacagggtctcgctctgtcatccaggctggagtgcagtggcacgatctcggctcatgcagcctcgacctccccagttcaagcagttctcctgcctcagcctcccaagtagctaagactataggcacgccacttcacctggctaatttttgtattttttgtagagatggggtttcaccatgttgcccagactgatctcaaactcctgagttcaagcaatctgcctgcctcagcctcccaaagtgttgggattacaggcgtgagccaccctgcctggctttaagttacttatttaaaaaaattattgcccactctttagcaatggggagggaatagtgtttcttcctggatcttcaggagtggctgtcccttctgggaaggtgcactttttagttgagaagtgaagttcagggaacctggtgacagtgggttaatagtttctcaacttacctctttttgccaactctgacatgtaggactcattcattctttcagtcactgtcattcatttatttattcatcagtaagtgccttccttgagcatggcacaccaaactatgtagcagggctcaaagaaccatcgtgcacagtgcctgccctcatagggctggctgtctagtgagggaggtgggcgtgtgaacaggcaaatcacacaccagtggccaacaccagggcagaatgatggacaaagcactgctgatgggcaaagagcacagaaaacaaaatgaccacctgggcctggtgccgtggctcggcaggaggattctttgaggccaggagtttgagaccagcttgggcaacagagtgagatcctatctctttttttttttttttttgagacagggtctcactctgtcgcctaggctggagtgcagtggcgtgatctcaggtcactgtagcctctgcctcccgggttcaagcaattctcttgcctcagcctcctgagtagctgggattacaggtaccatcgccatgcctggctagtgtttttgtatttttagtagagacggggctttaccatgttggccaggctggtctcgaactcctggcctcaagtgatccgcctgcctcagtctctcaaagtgctaggattatagacatgagccactgtgcctggcctaaagatcctatctgtaccaggaaaaaaaaaagaaagaaaattagccaggtgtggttactcacacctatatcccaattacttgggaggcggaagtgaaggctgcttgggaggatcgcttgaggccaagagttagaggctgcagcgagccttgactgagtcactgcactccagcctgggcaatggagtgagaccttgcctcttaaaaacaaaacaaaacaaaacaaaaaaaactttggcttgaggagtctagaaattaggaggtgacatctgagctgtgtcttaaaggacaaataggaagtttcgggtggagctggcatctgcaagagcacaaagccccaagagctagctagtgtccacctcgtcaaacagaggtggcgtcagaacaagaaactctccagggcaagaggaaagtgcctagatttcttgtttgtattttataccatatagataaaattgttatttgttttttgtaaggctttcagtcaccttgagtatctggctaaaacctattttttatcttaaactatagacacaaagattaatgttgtcaaagtagcataaaagctggtcttgtagaaatattttatcaactaaatacacggaagagctgtataataaaatcctgtctccttagctttttcttgtgtgctgtgtagtacaaaatattttgtttttatcttccttctgtggttaatacttataaagccagcaacgattttatctgacattcagaaatatcaatgtaaaagcctgtaagccctgcaaagaaaattgtttttcttcattcttttcaccaatactgggaagctcccaaagatatccaaggttaagcaatttgcattcagattgttgttattaagtctggtttccttctcttttttgtgagacagagtcttgctctgttgccaggctggagggcagtggtacaatctctgctcactgcaacctctgcttcccgggttccagtgattctcctgcctcagcctcctgagtagctgggatgacaggcactcaccaccacacccggctaatttctttgtattttagtagagacagggtttcaccatgttggccaggctggtctcgaactcctgacctcaagtgatccacctgcctcagcctcccaaagtgctaggattacaggcatgagccaccgtgcccggcctggtttccttcttttgataaatgataacagagaaaataaagcacatccacttatttttattttaattttattttatttatttatttttgagatgaagtttccctcttgttgcccaggctggactgcagtggtgcaatcttgactcagtgcaacttcgcctcccaggttcaagcgattctctttcctcagcctcccaaggagctgggattacaggcgtgcaccaccatgcccagctaattctgtatttttagtagagatgaagtttcaccatgttggtcaggctggtctctaactcctgacctcacacatccacttagttttaaatatgcttcagggcaggcacggtggctcatgtctataatcccagcactttgggaggccaaggcaagcggatcgcttgaggccaggagttcaagaccagcctggccaacgtggcaaaacctcatctctactaaaaatacacaaattagctgagtgtggtggtgtgcacctgtagtcccagctgcttgggaggctgaggcatgagacttgcttgaacccagaggtggaggttgcagtgagccaagattgtgccactgcactccagcctgggtgacagagtgagactctgtctccaataaataaataaatacgcttaaaatgggaaatgatgacttccaggctgtgggatgtttacttaagcaaaaacctctattacgctacctgagaattccattactcaagtttgaataattacaaaactacgtgatgggcctgccctgtctgacttcctgcacacttagaccgagaactgaaagaccctagtgtcaaaaatatttaagatctgccatgagaaatagatgagggagaattagagcaaaccctggccctagggtgcattttgagattgaaatcgcagcctagtctcttccattacaccatcagtaaatcttgaaggacagaagagtagccaagaacaacacagggacaggtgcgctgggcttggctggggagggagccaggtgaggttgtggcttcctgaaggccctcgaagtttgcccctgcagctttcttcggagaactgggagaacaccatgtgtcaccttgtggagcattttaaaaacgagtgagaaacctttatcgggaagatactacgtgctgtaaaacaatgacagtaagccgggcgcagtggctcacgcctgtaatcccagcactttgggaggctgaggcaggcagactgcctaaggtcgggagtacgagatcagcctgaccaacagggagaaaccccgtctctactaaaaatacaaaattagcctggcgtggtggtgcatgcctgtaatcccagctactcaggaggctgaggcaggagaatcgcttgagccccaggaggcggaggttgtggtaagccaagatcgcaccactgcactccagcctgggcaacaagagcaaaacgccatctcaaaaaaagaaaagaaaagaaaagaaaagaaaagaaaagaaaagaaaaaaataatgataacaacagttgatgaaatgctttgatttccagaagacattatataaggagagaactttacttgcatgggacagctgatgagctcctcagctagggagaggggagggattgactcattcttgatgatggggcagggccaaggctgtagggaattgggcattgtctggttgctggtggtatgagatgctggcggagcccaacccatgcctctggctgttatgcgagggtgggaaaattccagtttgctagaaccattaataacacaagtggaaatcatgggtaagtttacagtttattcaagcaagtacttctaattaaacagaaaaaaagagtgtgaactcttgaccaaggcatattcatgattttcagtaaaataatttctcacttctagtggtcaaaataataatgaagtgcgaatatgaagtgaaatgcaacattaagggttggttaaccccaaattctttcatcaaagagcaatatacaagaaattggagagtttttttttttttcatactaaaagtaaccattaagggtaaagaactgagcctggcacagtggctcatgcctgtaatctcagcattttgggaggccgaggcaggaggccaggagttggagaccagtctcggcaacaaagcgaggccctgtctctacaaaaaaaatttaaaagtaactgggcatggtgatgcatgcctgtagtcccagctacatgggaggctaaggcaggaggctgaagtgagccatgatcacgccactgtgctccagcctgggcaacagagcaagaccctgtctaaaaaaaaaaaggaggctgggcacggtggctcacgcctgtaatcccaacactttgggaggccgaggcatgcggatcacaaggtcaggagatcaagaccatcctggctaacatggtgaagccccgtctctactaaaaatagaacgaattagccacacgtggtggcaggtgcctgtagtcccagctactcgggaggctgaggcaggagaatggcgtgaacccaggaggtggagcttgcagtgagcctagatcatgcaactgcactccagcctgggcaacagagcgagaccccgtctcaaaaaaaaataaaaaataagtaaataagtaaataaataaaagagcaaggaactgaacccagtggataatgctggggcatcagatagaggctgttggccatttagttaaaataagatggatgaccataatctgaaagatgtaaaaaaagaaactgacctaatttatttttttgaatgaataaaatatatgtggtacaaaattcaaaaggtatgaaggctcatagagtaaaaactaatttttttttataaatgtgtcccaaaaccactcggatccctctcccctgagtgcaccgattccagggaatccttgtgtgaacaggcaggtagcatccttatgcgcccttcacgcatctctacacatcacacttttctcactaagcaacaggtcccatacgctcagttcctaattgtataaatacccacctcatcgatctcaatgtctgtgtagtattctattgcgtgaatgtgccatattttatttaaccagttcccttctcaagaatatggaagcagttttccatctttcagaaactctgatttatttgtttattatttgtatttttttcctgacaaaaatgctgttcagaacagaaattcgagtttaaattgcagtggctgttctggttcatgtagaactagacttcagccttttcctcattttcttttgcctggtagacttttgcttatccttttattttcagcatttttcaaacattttattttgggtgtgtctcttgtatacccaagcagtgattgcaacattttcagcaattgctataatttccattttagatacagagacacctgtcacttcgcaccttaaatgaagagcttctgagctaatttcttcaatgggaaggcacctcgggggtgatacatgaataacgtggaataatgcaatttgggcagattaccagttaaaagcaatgttaggtttggcccactttgccttgcaggccgctaaagcctcaaacaatatgacacctggccttttacaaagaccggacagtggaggtgttgacaggaatggtgttaagccaggttcatctgggtttgtcaagcatagacttctacttttaaaatatttagggcaaatacagttcaaaattaatttggtcaactacatttttcttaagtttctttagttttgaaacctttgtatatttttattaattatgaaactcatacaaatgttatgtaggcagaattttcaggaagttttatgcccctttttataaacctgtaacaaagaaataagtgatataatagggaaatacggaggtgtatttgcagtctttgtattttacaaaattatcatttgaccatagatgtgatcgttgctgttccaagtaacagaaagctcaacccataaaaggaattaactggcttatatgtaacggaagagtccaaaagcagacatagcttcagatgcagcttgatccagggctcagatgccatgatcagaatccaattcttgcatctgtttctttgggttggcttcattttcaggcagcccccttcctcatatcctcaagatggcagagacagcccatggtctttcccttgcagagacagatcaccaggaaacaatacctctatccctagccatgaaacagtcttgaactttattctgacttgatcagccaagtccctgttggaaccatcactgcctagcttaggcctgagacagtgctgcacctctactaccaaaggccgggctggccttccctaaagtgtatgtgctgcgtgggggagaggtacggatctgaaccaaaacgagggctgtccagcgtcagcaaatatctcccgcagtcccagtgcctccagcaggaggcaaagcatcaacccctccgtctggctcctctactgaaaattccctcagcagcctcacaggccttaggcttgtcttagctacttcttcatctacttttttgctttcttaattatttttcttttcttttttcttattttattttattttattttagatggagtttcgctccgtcgcccaggctgaagtgcagtggcgtgatcttggctcgttgcaacctccacctcccgggttcaagagattctcctgcctcagcctcctgagcagctgggatgacaggcacacaccaccacgcctggctaatttctgtatttttagtagagacggggtttcaccatggtctggtgacctcctggtctcgaactcctgacctcaagtgatcctcccgcctcagcctcccaaagttctgggattacaggcatgagccaccgcacccggctgcttccttaactcttgatctcctctctgtatcttgctttgtctagctgttctcttctctccatattcatccaaacatttgcttagaagtacccagaagcatggcgttgaatgtggtacaccttgaacgaagggtgaagaaacgaggcagagtgacttagtagcaagtgacagcacacagtttaaattttaatattagcccatttacaaacaacagcttatataatagtcattcacatacctcaacactcaccatcccctccccactttttttctggagacagggtttcactgtcaccccagctggaatgcaggtggcatgatcacagctcactgtagcatcgacctcctggactcaaggggtcctcgcgcctcagcctcctgagtagctgggaccacaggtgcatgccaccacgcccagctaatgtttttttttattttttgtagagacagggtctggctatgttgcttaggctggtctcaaactcctgggttcaagcgatcctgccacctcagcctcccaaagtgttaggattacagatgtgagccactgtgcccagccaacattcaccccattcaagtgtgcaattcaatggattctagtatcttcacagtgctgtgcaactatcactcctatctacttacaaagcatttccatcatcttaaaaagaatccccatgtccaatagcagttccccttcccccaccgtcatcctcgggcaaccgctaatcttcctgtgtgtctgtggatttgcctcttcagggcatttcacataaacacaatcatacaatatgtggccttctgtgtctggcttctttcatttagtgtaaggcttttgaggttcatccatgttgtaatgtatatccttagttcattcttttttgttaagctcacaaataaaaagcctcactttttatttgaggcaaggagactggctacagggattacagttccagcagtcaaaacgcaactccaagtggcactatttggaccgtaggttttgcttcattttggctggaaaagggtattcaggatgtacttctcccagccggacaagaaaaagggcaaagaaaactggaagagacgtctcgtctacacaaactgctctttggacacagcatcaacctgaccacacccgtgctggccagtctgcaggttgctgacccgccgttaagggacacaggccatactacacttgctagaaaaactgaggcaggaaaaagaggtgcaaggcactgggggaagagcaggtacctatagctttaaagctcagtgttgaaggggtaatccttgcaggaggcacagctcaccaagacacagaccctcccgttcctgttgtagctgactacagtggtcacatcaggctgctcagttgaaagtcgaagtcctccaagttttcagcagtgcgttccagcatcaccaccgaaatgatgataggaattaccaccaaattcctatgcatgggaaaccagatcagaacctgggctgcgtttttatttgtttattttttttactgtgcttggctgtgattgctttggtgctgggatcccccagacctgtcacgagagctgaggggactacaggcagtcaccaccttgcctttggattggcagccctggattaacttctcctgaggtgggtgcaggtggcactcactgtggttaaccactgtttttaagccaggtttctttttttctgtctgtcatatatatatatatatatttagagacagggtctcactctatcactcaggcctggagtgtagtggcatgatcataactcactgcagcctcgagttcctgggctcaagtgatcctcccgccttggcctcccaaagtgctgggattacaggctgagacaccacacctggtcttaagccaggtttctttaccatctcttggagatggctgcagttggagattccaaaagctttcagagcccttcatccaccagctcctccatgtggccacccatgtgacatgaagttggtgtcactaggtaccacgttgtctgtcccatccaacaggaaaaatagcctgttggccagtgaataaggtaggaatccaggtggtcccctgagggtcttctgacaggctcctttatcaggctcttctcatggtatgagcaccgcagcttgctgacagtggcaacgttctcaagcttcacagactccgtcacttggcctggaggggaattctaggtgtccagccccaggacaggcattttggcaccatgattgagcacgatatggtgagccatcctcacaggattaagaagaattctggacagaaatatagttgtaagtaagcatcagtcagcctgcactttgacccacttccttgtaaccaacagtgacgtagcactaggtaacatttgcatccccgttgttcctatagatacaatttctgaccttagaatcacaaggcttttgtttaaaatagatgggatctctgacattagaatcataagatttttgtttaagacttgcttaagatgtttttcagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttaccgtggctggccaagcctgctgtgcttcacagaccccactcaggatcacaccacttcgttccactgtttggagatgccatgtttgcttatcccttcatcagctgatgagcatttgtgctgttttcactttttggctattacgaaaatgttgctacgagcatccatgatattcgcccatttaaaaaagtgtttttcaccatt

SEQ ID NO: 2231 - DNA, 668074 bp, Homo sapiens
agatggcatcctcaaccaaatgttttgaatttattataatcgtgcttctctacaactaatgattcttgtggtttgcaaaccatgtctgcctttatttacctacacaaacacggaacagaatttccaataggagaggttcacacagctaacaaagcatagagtgtgtgacctcaataaggcattcaacaaagacacacgccgtatttccctctgactgcgttcccttaggatgctctgatgttggcgtcgcattcttctaaaagtagaatcaaatcttcaatcaggctgtgttctctgccatgtgtcactctcataatatcaaaagcctaaagagaaaggacggaagagagattagaccccaaaataggtgagctcaggccattccccacctttaccccatgatgccaggggcctggtgaaccccacaggtttacagggtgaacagtctttaacaggcttacagcactgtggttctcccagctggaaagtcacatgaaaagggtgatttctgaatgtggtatttggaaagcagactcactattcgagtcatgctggggcccagtgacaatcgatgatcttcaaagactgtcagtgcacaggtttggtgggtagtcacagggataagaagagttaccaaaatgattgagtcatatgaaagaccatgctgctaccaccttaaaatttttctttattgcacactccattcaattctcatctatatgcaccaggattattatatacatgtattctcacattttttttcatatcatattatagcactggcatttcaacagtcctctccttcactgctcatatttggtccattattaaatcttgtcaactcttatcttcaaaatatttctgaaatctgtgtgggcttatgagtacttcaataatagagtataatagaagtaaagcaactgacttgtgagactaggtcaaaaaggcctctgtgttgtttactggtcagtatgtttgctcccagaaccaagagactccatgctgcaaggaagcccaagccacatagagggaggccgtgtacaggcactctggctggcagtcttagccaagctcatctttcaagtcattctagacaaggcaccagacatgtacataaataaaccttcagacgattccagcacccagctgaagactgccagatctgtcttcccagatgaaacaccagacattgtagaaaagaagaaagccattcttatgctgtgtgccaattcctgacacacagcatttgtgcaataattttgccgttgtttactccattcagttttgggatggttatggaacaacaaacaaccagagtatccttgaaaatatttttgtaataaataagagataagcaatattatcctgccctgcccaaatgggggggtggggtggggtggggtggactggggagaagggagggacaccagaaccactgcatttgatgtaaatgtgcccaggagacttgtaaagatatgactctggtggctgttatgcacccaaagtacctggaagtggcactgaggctctcagccttagctacacagcaggatcaaccagggagcttcaaaagagacaccgagggccagaccctgcacatcaacagctgaagcctgctctccaggaatgaggcctaggccccaggagattccaacatgttctcaaggttgaaaacaactgatagagcaaactctcaacaaataacatcaactactcatgattcagtgttaatttatagccagaagaattaccattttaattgttgtatataatgaatgccatcatgcttataaaccattatttactaagctactcctggaaatttagatcacctccaattgtttattaggatatgatgcagaccttccagaatagattttttgcctttcttggatatttaagagcaattgctaggggtggaattcttgagcatgaacatcttgaaaaccacagagatttcagaccttggtggtcatgtggtgagacgcctgcattttgcaattctgcatgcaggaaaactttccattctacgttggaaaaacgctgaagcttcgagaaacaaagcatttcagggggatgggtaatttcaacctctgtttctggcttcttttttcacctcttgaatgttccctttaggctggaaggaaaacaggcagacagagggggtctagatttgctgctgagagagagagaaagagagagaaagagagagagagacagagagacagagagaaagagaaagagagagagagagaaagagagagagagaaagagagagagaaaaagagagagagagagaaagggccagcgcctcagaccctggcctctcagcctggaagacagctctgctctgagtccagttgtgaccccgcactggcagtctggcccctcaccctgtgacactccagctgcaaagcccagaaggtggctggagctgagatgctggcggtgggaattgacttcctattcatgcgagcaagtctgctctgtgggtgcacagcatctgccagcaaatccctaggcagggggctgtccggagtgcaggggaggagttgggaccagcccccaccttgcaagcagcccagctctatgagattcccctgggcagaagattaaaaacaaatgtttgatggcattcatggagcacatgcctcgtgttttattctcttttctccacactgccctggatcctccgctgctctggacatcttgaggtctgaggcagagacctgtgtgacagcacgattgcggaaagagaaggtttctcagatcagagagccttcatgggaaattttcttacttgaaagcactcttagatgttctcttcccttttactcaacaaagagccagagtgcttgtgatctggcaaaggaagatgaatggggcagaatcactgcctggaaagatctttgcagagagggacgtaaccctccgtcctgaaaaaggccagacctaacctgctcggcctcgcctccctccctgccctcacagaggccctcggctgggtgagggcctggccttgttgctcagaatttccagaccagcctcttttttgccctcctggttacattccccaggttccccatctgaagaatgatctgtgcttctctctgacttgactcagaggctaaatgacaaagccatcttcttgtcacttcaacaacataagttcactggcatgctttgaacatactacaggctccaggcttccttcctcgctcttttcttccagttccagtggtgagtttcactttctcctcttttgcagctttaagagtaaggtctactccccactgatccagtatattcctgttcatggaaggggcagacctgcccatcccacagtacggtaactacttccagttcttcagccattctggaattagagccacagccaggaagggggagtttcctggccttcctccagcttcacatccacacctcacagcctgcttccttgaggaaagaccagaaggatcatctagtccaataccctcatgttatggaaggaagtgcttcctgaggtcacctggcttgagagttagactaaggatgacctctcggctctcaggactcaacccagtgtgtccattccatgactgcattgtgcagcctccccgtatgaacagactgcagtgaccaaggagaggagcagaggctctcctggacatggctgcagagataccctgaggggacacaggtgccttccttgtcaagatgctgctggtcatgttctgtgttctcttacttgatgctgaatgcatcaccagtagcaaaggggaacaggggcaaccctcaggaatgtgtgtgtagagtctgagatactaagtttagaggatctcgtccatagggtggctagaaacagagaggaaatgggtatgggtaggggcagagaactaatctgaagcaactgaaaaaaaaaaaaaagaaactacatcatctgtctagaaagtaaaacgccatatagatttgattaattcacaagcaaacatacttttctctgaaagatgggcagatgtagatgagaaagggagagaaaaacgagaagaaagaagtaggattcagtaatgtgcaaaatatgttagtgactgtgtgtgcggatgtgtgcgtggatgaatggtgtgacacaggtcagcaggaagctgcaattcacacctggtgatgaggacatctggtccttgtcttgaacatcacctgggcctatgggtgagctggggcagacagtcctcaacaatgtacggagagggccctgtgtggccctgggcacagcccttcagcactgggtgagctggggcagacagtcctcaacgatgtacggagagggccctgtgtggccctgggcacagcccttcagtacagcaggaagatgaggagggcttcccctcacattaccatcccccaaaaaagttacaataaatttctgacaaacgagagcaattgtttcaagtagctctgtgtctcccttctcctaccactcccatctgtcacccatgcgcatgtcagagaggacaattctggtttaatttcctgcagtagcatataaaacagattaaggaaatataaaattggagcaggctggtgttgggaaaagcttatctctttccattaaattttattttttttaatggtagcatttaaaaagagcctgcacataatctttcacagagcactcatttgaagcctccaaggagggtgcctgctacacccacatccagactcgaaatgtcacatgagaaaagcagcatagcttgtctgccacattacaggcatacagttaactcagtaatagagaaagggtccccagaattgatttcaatctcatctgtttttttaagtaattttagaattgtggtcatatattaaataaaatgaatttaaatcaaatcataaagttggaaacaatatacctctcctattaattttaatatgaatatattaagcttatcaaggatctcaaacagtttctaccatgagcttgaggaatctagtaagtgacttcccaagtatgatttaaatatggatataaaatcagagggaaaagaaatgtatgcatgataagaacccctggaatcaaatcacgacgggaaaaaataaagcaggttttcttattctgcccaactcagaatgaaagaaaagcagagggtggggcacagggaggaggaagctggtctggggcattcaaaggaggaaatgcaagaagcaagaggtacaacacattaagcagctctggaggcacaaaaagccctttgcaaggacagcagagaatcccaaagactttgatgatccacctcagctcagcagcacccctggagaccccactccactctacatcttggataacttcaagtgtgtattccgctggaggaatatgtccttttgggaggcagaatttccttagagataacatctacccattcattcactcaatactgtctgagcagctttaatgaataaaacttggcccttgccctgggagaagctctggcatagtcagagggacagaatgtaaataccagatcattgcagtggaacagtgtgtgttcaacagagatgcaaagtgctggggcgcccagaggaaggaggaaccaggtggccccacggcaccctcaggaggggttacagatgtggtgagctcaggtctgtgctttccagtggtagtagccattccagaaaaagcatggctgttgtatcactgtttaatcaatcaatcagtacatattaattgaactctgagagactctgaagaagttatgtttcctcagctaaataatgagactggacaatataaattctaagggcaacccaagtcccaatgtgttgtacaatgtgccatgccagacacagctacaaggcgtggatttggttttgtttccaaatattgttactgatttctaatttaattccattgtggtcagataatttactttgtattaacttgaatctttttatgtttattgatatctgttttgtggcataaaatggtctcttttggtattatagttacttaaaaatgtgcattctgttattgctgggtgaagtgttttctaaatgtcaggtcccattggttgatggtgttatggaattattttgtatccctcctcagtttctgtctagttgttctaccaactgttgacagaggaggtctgatgttcccagctgtgcttgtctatttgctcatttctcctttcagttctatcagtttttgtttctcatgttttgcaactgtgttgtttggtgcatacatatttagtactactatgtctttttggtagactgacctttttttcattatacaatgtccctctctgtctctcataacattttctttgctctgaagtctactttacttaatattgatatagctactccagctttcttttgattgtgtttttataatgtatctttttccatcattttgctttcaacctatttgtatcattctatttaaaaagaattcttacagacaacatatgcttgagtcatttgttaaaaatctgttctactaatctctgtcttttaattggtatatttaggcaatttacatcttttacatagactactgacataatttacaatgttattattaatacatcagggcttaaatctgccatttaattttttgttttctgtttgctctctttttctttctttttcctgcctttctgtgggttaaacttttttttagaatttcattctctagtgcttttgagtgtattactttatatagttttgtggttgctccacgtcttattatttatatatattttatatatatatacacacacatatatatgtatatataacttgtatataatatacatgtgtatgcatattatatatgtatatatacagatatatatgtatataacttatcatactttactagtgtcatcattttacccattgaactcaagtgtagaaaccttccctttacattttaccctcccccactcccccatttgtaatacaattgccctaaatatttctactacatacatttagaatcatatcagatagtgttataatttttgcttcaactatcaaacaatctagaaaactcaaggggagaaggaaagatcattttacttacccacacttttgctgaccatattctttcttctttcctgatgttccaagagctttcttttatcattttctttctgtttagagaacttctttagccattcttttacagtaagtctgctagcgataagttcttttagttttccttcatctgaaaatgtcttgatttcttcttcattcctgaaggatattcttgctggacaacatacattctaagggcaacccaagctttgggttaacagttcttttctttcagtacttgaaaaaaatatgctactttcatctggcttctgtggtttctgatgagaaaatcactgtcattcaaattgtttttcctgtacaggtaagttgtcatttttctcttgctgcttttaggactttttttttttttgtctttagttttcagaagtttgagtatgatccacagtcttggtgtgaactgctttcggtttatactgttcggggtttgcttagcttcttaaatctacaggtttatgtcgcctgccaaatttgcaaagttttccactattaattctttttttaaaaacaatatggtaaagtacacaaaacactaatagttaccattttaactatttttaactcttgagtagcattaagtacattcacattgttgtgcaaccattactactatccatatagccataacttttgcatcatcttgtactgaaactgtgtacccattaaacaatagcttcccatcccctcctcccttcacactctggtaaccactgttctacttctgtctctaggtatttcactattctaggtacctcatataagtggaataatatgatatttgttcttctctgtcaggcttatttcactttgcataatgccttcaaggttcatttatgtgtagcatgtgtcacaattttattcctttttaaggctgaataatattcccttgtatgtatatatcccattctatgggttgctttttattttgttgatggtatcctttgatgcccaaaagtgtttaattttggtgaagtccaatttgtttatattttcttttgttgcctgtagctttggtgccatatccaagaaatcatcactatgcccaatgtcatgaggctttttccttaatgtgttcttctaagagtctagtagaagcttttgctcatatgtttaggtctttgatccattttgagttactttatatggtgttaagaaagggtctaactttattcttttgcatgtggatatgcagcttccccaacactatttgttgaagagactgtcatttttccattgagtggtcttggcatccatgttgaaaatcatttgatcatatatgcgagggtttatttctgggctctctattctattccattggtctatatgtccatctattccagtatcaccctgttttgactactgtagctttctcgtaaattttaaaatcaagaactgtgagttctccatatttcttcttctttttcaagactgcttttggctatttgggattccttgaggttccatatatatttcaagatgtatttttctacttcttccccaaaaaagccattgggattttgatagagattgcattgaatctgaagattattttgggtaatattgacatcttaataatactaagtcttcgaacctatgaacatgagatgtcattctccttatttatgccttcttcatggagaataacttattcagttattctcagataataacttacttggttttgtgttattgcaaatagcattattctcttaattttgtttttgaattgttcatttttagcgtttagaaatacaactgatttttgtgtgttgatctgtatcctgctaccttgcttaattcacttattagttctaacattttttggtgtgtgtgtgtaatcttcagagctttctccatatgagatcatgtcatctgtatatagagataattttatttcttcctttccaatttggatgcctccaccattatttcttcaagcactttttccacctcaccctctttttcttttctttctgggactccaatgttagatcttttgttactgattcataggtcccctgaggcactgttcaattttactttttcttcagtatttttttctgtttttcagcttgggcagtttcaattgtcttatcttcacattcaccaattcattcctctgtttcctccattctgttgtggagctcccttctgtttattttgattattatatttatcagttgttaaatttctatttgtgtcttctttacggcttctacttcttaactgagattttctattttttccatttattttgagggtgtttgtaattccttgatgaagcatttttatcatggctgctttaaaatctgtcagactattctaacatctctgttatcttggaattggcatctactgattgcttttattttcattaagattgagatattcctggttcttggcatagtgagtgatttttaactgaagcacaaacattttgagtattctgttatgagactctgaattttacctcaacctgctttagccggctttctctgacatcactccagcaagagaatgaagtgatgacaccctgttactgccaggcgggagtacaagttcaggttccctatctggctccttgttactactgaactcatacttcctggaaggtaaatttctgcttatttcccataatacgacttaatcactgtgtttgcattttatccattattttcttatcttttctcttttttggttcaaaaacacactcttggaactattattctctatttggaggtcagtaggaatcactcataaatattagagccaggggcttccaaacaactctttgaaggtattagtgacaattacgggacatccttccgcatgccctcttactccccctctttccctcccacctccccacacggtaacgtatgatgttaagtgtttagaggagggctttttaacctaggcaccatggatactaagtccatggaagggcttcagggagcctctgaagctgccatccccaccaaatatacaaaaggttgtgtatatttaacttttctctggttagtcagtggccctcatcagattcctaaatagggacacaaccaaagaggttaagaatcactgtagcggattaagacatgggaacaacagaactgcatgctctaaatcagccattgctggggctgaaaatcagggcagccgatgcaggaatacaaggagcaatctctaggacttgcggcctggtgctgtctgttgagatgcagaaaaagctaaaaagatgctcaatgggtaaaatactgcaataaaatcaaatgagaagggaaaaattgtaatacaaaaagtttaaatacagatttttttaaaaaaatggatgccgaggggaaagaagtctaacttttgcaaccagatttttgctgaaaagcaactacactagggccagggtgagggagcctgcagcatgcagggttcacaggaaaaaaaacaactctgattaacaagacagcccagatgggttgtccttgaggtccaagaagtcaaattagtagcaaacaaaagccttctaagaaataaatggaaagaaataaaagtagattagtgacaggagagggcaggagggaagcactgggaagggaccccaggactgtcctgtggcagcaatcacaagaatttcagctgagcccagtggaaatggaagactaaaccaaatcagagctgggctaagtggattcctttcctggaggaggctggagcctaactgaatctgtaataaatttctgtttctgaagctcctctgatttctattcaaactcagtcttcaaaaaccttattcaagtgatttcattccattatttccagggtttctaagacaagaaagagcatcccgagggtgcccgtctgaagatgacatcagtttcaaaaggcaaagagtatagcctcccttttccctctccaggttacccgagtcctgagaaagctcaggaaagaaagactttcttcaggaagaaactgacctgcttctagactcacaggtcacgtgagctttcctagggatggatacattcaggccatccctctgctagcaaatgctcagcaaaggtcatgagaagatctggtccattaactgtaaacagctaaccagcaggcccagggggaggcttttaaagacttctatccattaaaaaaatccattcattcaagcatgtatttaacagaacttgccgtattgggggcatgtgtgtctatgttaggtggcaccagaagacacaaaaggaatgtaaggtcccttgagggattcccactcaccttggggagcaaaacactgctggggagcagtcatagaacataattgttcaccagaggaaccaccgtgtaccccaaactacaaacacaagtactgaacagaccagctagtgggagagtgatcagaacaagagttcctgtaacaatacccatctttaatagtttcagaatgcttgagattggcaagcacactctcccgcattgcctcgcttactcctcaaaacaagtctatgggatagctatcagcttccttttacaaatgaaattatattcagagattaacgcaaatggtgggactggaacctgaacctactgactctaaatccttgcactctttctacaactctgccaggagtgcatgtttgctccttggttgatcatcagaccttggcaagagactcaatgacttttgtagagacacacagcaagtttgggtaaggccaccatttaaccccaggcctcatgacagataatctgatgctgctcccagaatacctttcatttggcatctatcagggtgtatgcctgagcttcaccttggtaccaagaataggaaaagctaacatgattacgaagagaagcttctgaaagaggcgatgcaacctcatcagaagggtgtgagggcagcagaacagacctgggcatgagggatgtaaagggcagtaagagggtcatctgaagggctggtgatggtcagtaccatcagcccaggccacattatcctgaaaatccatagcgagatgtctgtctgggtttgttcaggcttgtccttatagttgagggtattagatgtctccttcagaagttctgtatgcaatagcaatgactaaagcttcacataagaagcaatctaaatcttctctgatttctctcccatatttttccctgagttggcatcatgggttcggttagatcttaagggatttctgcacactgatcttactagagagcctcatctatttaactggaccagtctagaggaaaagagcagagccttggtttctggcctggatttaatgacttgtacatgtctatctcctccattaaattgtacacaccatattgagtctttttttttttttttttttgagacagtctcactctgtcgcccaggctggagtgcaatggtgcaatcttggctcactgtaacctctgccgcctgggttaaagcgattctctcacctcagcctcctgagcagctaggatttcaggcacccgttatcatgctcagctaatttttgtatttttgtagagacgggatttcaccatgttggccagactggtcttgaacccctgacctcaggtgatcctcctgcctcagcctcccaaagtgctgggattatagatgtgagccaccgcgcccagcctgagtcttattcaaagtagtagaagtatttgatcaccatgttgaattaaattgaacaaatacacctggctctgcctctgtgcgactttaggtgagctcttgcatgtctccaaacctgagcgccttcactttccaaataggaatgaaaatgcctgtcccattgacctcacacagctgtcacctgtcatggggactgagtatgatcacggatcacgtacgtacgagcagtattcatagtttctagtcccatataaacacaaaggtctagtctgatcacttacgaacatctacttgcaggtgaccctgtgttgggtgcatcgcacattaggaaatttcctgcacgttgtttttctgtcaggactttcacacagtaggcccttgataaggatttgctgtaccttgctgattcgactggctgacaagtacccccagaccagaaaaggaaagttctccctgaggctgcaacagacggtgcggtgttcttcccccgcctgggtaaacatgccagacatgataaaaagaacagaatagctgagtgccctcagggaatcctagtgttactcccgttggccacacgctgactttatttagagatcaagtaaaggcgctatggctagcattcggcgaaaatgagcactgtggaatctggcttttaagaatcccttcggcatttgtcatttctcttaggtccatgtgggcggctgccagtgttttgggatcagccggcccctggacacgccctgagcaaccctgacgcccgatccttccaccgtcactcttctgcacacaagggcatggcggcccagagggtcctgttaaagtgtcaagcgcttcctatgatacccgcacgccaggtctccatacaacccaccagtgcctggccaggtgagcatgtgagctctcctttggaagggtcacggactagaggagaggaagttctgctgaggtgggaaggcctgggccagacagcagagagccctgggctcctccgggcagaggagactccctgagcgggtgaaactaaccatcgtgttttaacaagctattccaaccctaaaccagttctcccaattagtttcttgacacttattgccagaaccgtattcactgacctccttcgcttcctccctcctccttccctcaataatgaatacttcctaagttccagatcccttgcatggcactgagctggttgccaagataaccacgaagccctcacactctcctgggggcaggggtaagggtggtcatcgggtatgcctactgcaatgtgaaaagggctctcctggcagggtgggcagagagctgtaggggtaggaccacaaagtaacactggaattgggccttaaaggatcagcagagtcctgccaagcccagggggttgtgatgcggagagcacttaaggcagaggaaaaaatagctgtgtgaagatggaggagtgagaagttcagggtcacagtgggtcctggtgaacagcagtgatcactgggtgggtggaaaggaagagaggaagggcggggagaagtggctgcaaaggtgaactgccacacagatggtcaagggcttgccacgcgagggacacggactgtgttccgtgggcaatggggaggaggcacaaacaaggtcaacttgctaaacgtggagagggcacaggagcagtggtgttctcagactggtttgtaccagtggcaagagtaattgttaatattatttttataagaaggttgattttacatttaaaatcagccatggtgggcatgcctgcatcacagaaataggcaaatgtcatgaagcaggttttttccagagtggttgttaaacatttaccagcacacactgggcatgcgtgtgtatgcgtgcacacatacatagagctgctaacaaatcacaaagaggcccagcaacagcagaaaaaaaggatgccaggcagaactatgtgagatcttggcacactcaccagtctcagattcttcattgcttggggaaacatgccttgatgtagctgcagtttgccaactttcatcacttgaacccctctgacgggatggcttcctgggaaaaaaatcctggaagaaaccaaacggcaaacagtgtcagcagccctcacctttgcagtcagcatttcatcaggagactacgaaagtggaagcagacactagctgtgaatgttaatgagctactgaaaggaaatcagctttgcaatccaggagaatgcagtactgaggggaattgacacaggactggtctccagctcctcagaatgtgttttgtgttagggaaaaaaaatgacaggactagaaggtctccctcataaacactagagaagagaaacaaaagtttggagctctgcgttgatatttgggaggggtggggcggggagaacaggtgctaatctcctcctccaagctcttccatgaagcatcagcatcagcactagcacagccctggaacagcagattgcctctcaatatatatttgttgaataaacaaagttttcatcatcccccaactagatcctaccacaccccccttttaaccgcaaagccctttgattgaatctcagctgtggagtccatcatggtacacctttcttatgagcacgtgtgtatttatttatcatctcactggattatagtgctttttattcaggcaccccatctgcgttctccatgatgtctgacatgcaggaggaactcaatccatactggaccctttcacatagaacagaatagaatacggtgttgtcgtggaccaaagaaagaggacgcacacgactccggctatgggctgtttcagaccctgtgaagagctgtattacttcaattcaacaagaatttaccatattggatttaaccaaatatgagcagtttggcctcttctggccccaataccccctacccctactcttagagaatactgagcccccgctgtatatgcagaattgtctctggtggaaatgcctacacacacacacacacacacacacacacacacaaaaccacagtttaaatgagcttttcaggacaggtgcgatggctcacacctgtaatcccagcactttggaggccgaggcaggcggattgcttgagcttaggagtttgagaccaccctgggtaacaaggcaaaaccctttctctattaaaaaaaaaaaaaaaatacaaaaatgagccaggtgtagtggagcatgcctgtagtcccagctacctaggacgctgaggtgggaggatcacttgagccctggaggctgaggctgcagtttcacaccactgcactccaccctgggtgacagagtgagaccctgtttcaaaaaaaaaaaaagttttttccttgaggctgaatcatcccattagacacaagataaacattcctgcaggagttaaaacaatgttacaggacggagcatgatttagcgcccaaataaggcataacttagtataccctagatgtccagttcaagtttgttgaattgaactgagaaaatgatacaagtattgtgaagacaaagaggtgactgatggttggttggactggggaaggcttcctggaggtgggaaattggacttacactggctcccaaggatttggagaggcttggctgggtaggagaagggaagcatatcccaaccgtcagagagaacgagcaagggcacactctaaatgctgcttctccagggacggaggtgcctgcccacagacatcactaagatgacctagaatccatcactcacgcagggcctgccatgtgccaggcgctgttccaactgcttttcatccatgaacccagagaaccccatctaagctctattatataacagtgatgaggcggatttaccaggagagacaggtatgttctctgaaaatgcacacatatctgcaaaccattccctctcgctgaatcttaactcttcctcccatgaaatgtgatatagaaacactttttttttcattcatgctcttaagaagtagaaagcagtacctgggaggaaagtatttaaaccgacagaaagttgggcatgcctcttttaaaaagctgaaaaggggctgggcgcggcggctcacacctgtaatcccagcactttgggagggcgaggtgggcagatcacaaggtcaggagtttgagaccagcttggtgaatatggtgaaaccccgcctctactaaaaatacaaaatttagctggacgtggtggcaggcgcctgtagtcccagctactcgggaggctgaggcagaaatgcttgaatccaggaggcagaggctgcagtgagccgagattgcagcactgcactccagcctgggcaacaagagcgagactctgtcttaaaaaaaaaaaaaaaaaaaaaaaggctgaaaagggagcggaagggggaacaacaaaggagacactgggtcctggatttttcttcatctcttcagtatgccaaggggtcaatcactttacctctcaccccttacgaaatgaacatcattatctatttgtgtagaaatgactttaagatccccagacaaaaggcataagggcaggacgccatcatcagagggtaactgccctggacactttccttgaaaagcacgcctggatttggggtgttatattattactacgaatgtagcatcattaaacttaaaggccaaaaagtgatcttacactaatcatcactccactaagtagatgtctgtcatgtcagttagcagaaggaaagacaatcttcagttctacgatggcagagaaagcggtgtgtcattacgccatgacaggtacctgccccggtagctcagatatttcaaaatgaagtagagcttacaaaggagagcatgaggaagcgcttgtccaggggcacttccaaataaatatttccagggcagcctcacagctctatggggctgctgattgcgggcctggttggtttctggaggcctcccagctgacatagagaataaaaatcatgattccttgctggagtataactccaaggaaagctggtcaagctcactcctgctgggagacattcttcaaaggtgtggccttccatccacttcatggtgtagagcagggatggggagagaagagggcctggaggtagtagtcttgacaggacaaaaagacggtcatcttttgataggattgtcaaaaataaagaccgggattaagagtccaaagtgaagcagcaatcaggtgtgtccaaggaccgtgaggactaaagcaggagtctgagtgagaaggtgaggggaagatgcacctacaagatactggattccgggtccggccccataagcaatctgcagaagtccaaagtgagtccctgcccttggttagcatgtagtttgcaggtgaggcaaatgaaatcatgatatagaaaggcatgtgacagccacctgaccagggcacagtcctggtcaatatggtgaaaccccgtcaatatgtgtgaaaccacacaatgtgtgctctgggagcagccgggaccacagtgatcaggggagtggcagagcctgagtgtgtttccactggagatgatgatgggatcctgggacaagggaagggatggatggttgctctggtgatgggataggaagctgaatgccaaagggcagtgagcatgctggtccggccagcagaggaggggagtgggaagggaggtgcactcaaggccaggctgtgcagaggcacacacacgtgcaaagctaggaactctggacttctcttgccagcagtgaggccaggctgtgcagacacacacgcgcaaagctaggaactctggacttaccttgccagcagtgaggcactaccaaagggggctgaagatattttatcacaatagaaaaccaagaaaattggaaaacagaccctagaggcaaaaatacttgaggtaggatagcagcaatatcaacagaaaagaaggacttggtacaagaaaggttatgcagctgatttaacagaatctggggatccaagggggtgcagtggagtctgagttgactccatgattcagaaatagaaacgcttccacaaaaacatacaagcaaactacataacaacaaaatcattcaacaaggcagtttacttgtttgggtgatataaattttcctttcacaggtataatgctagcaatcacatgttccagaatgcttggcctagattggaaaaaaatgtttttggtgtttctatggtgaataagtgcataagaagaaatgggtttaaacaagcagagaaaagaaggaaatgtacacaccagctttaactcagacccacaagcaccaagatcttactgatatattttacagggaggctgaaagtcagggaactgggatctgaagtcaaaaggacatggagaagaaatatctgatgccaggatctctatcagtctggctgaggttgctgatctctattggtcctacgtgacacaattaccaatcacattattccgttacagatggcagctttggcattcacagggtaggaaaaggcctttgttattcagggctactgctttggtttgaatgtgttccctccaaaattcagatgctgaaacttaatggccaatgtggtagtgtttggaggtccggcctttaagaggtgattaggtcatcaaggctcctccccttgtgaatgggattaaagcccttataacacaggtttcacgaagtgttcagcttgtttgccttccactgtgtaaggacacagtgttccttccctccagaggatgtagcaacaagacatcatgttggaaatggaaagcagccctcaccagacaacctgctggcaccttcatcttggatttcatgacttgaacttcccagcctccggaactgtgagaaaaaaaaaaattctgttcttggtgaattaccgtctatggtattttggtgtagcagcacaaactaagttaatacaattattttttaaaaactgatgcaaaacatattactgaacctgaaaggagaacttaacctgcctatttaaattgtatcttagagtaactaaatagctccagttgtatgaattttagctgataaatgtggaatgatgacagaattagaaaaatcattttgcaactcctggagaattattggactgaggggagaaaatatcacttgatgaaaccattagataaaaggatggtaaagaattttacagtgggtggattaacttgtcaccatctaaatccactgatcaatcttagcaccaccgaaggaggacaactagacactaagtgccatccgacgcagaaggaattatttttgaccacccctcaacgatccttgtgaaacaaaacagaaccccacacactgaagctgaatctaaccaaggctgcaaagtcaaatcccatttcatgcaaaaaacaagggacagagggacaagtagagcagtcagctgaatctggggtacgggaaattctacaaaagcccggacccgggatcttcaacaagtcaatcacatcgaaagaaaaagatggtagcgggagaagaatactgtagattaaaagagatgtaagagatgtaacagccaaatacgaggtgcagaccttgtgtatccttactcagccaagacaactgtaaaaacatatttctgggataatccaggaaatctgagcatgaaatggcattgcgcatggaagaaaaaatgtcctcatttttcagagatacaaaactgaggtacgtatgaattaaatgacctaatatctgagatttcacttaaatatagtcagtcctctgtatgcacaagacgttagttccaggatccccacaaataccaacatctgtggatgtttaagtctcttacagtcagcccatggtatcgctgggttataaatccccaggtccagcatctgcaggttccaacaactgcagatcaaaaacacagctggccctgcatatccacatgttctgcatccagttcaatccagcagagatcactcaacgcagaagccatgaatttagagggccaactgtatcttcagcagattttcagcttccagcaatggtggagtagcttatttcagaccaagcagcttatctgctgctgaaaacacgaaatgctgtaaacaggaaaacatagacaaaaaagtatttttaagaatctgtttgaaggtatcaaggagccactgaggcagcaagatcttgaaaagtcaagatcatggaaagagtggaaggtgaaccttgtattcattggtacttttccctttgatgatcttagagacagagaggctcaccagctgagcaatatttttggcagtctcatagaaaaggagacacagaaactggaattcagggatcaacaatgataacaaggagctccagtaaacattcctggctttcgactctgaccaccaaaggactacaatctatctaggtatagtaaattagaaataaagcagccattacaaagaatgaatcacttcaaatcctgattggattaaggtacgaactctttctatcctgattcccagaagcaaaagtaaacatgtctgaaggagataacatcatcctcagcctcaacttatctcaaattttctgtataatgttctgcatttggtaaaattataacccggcatacaaaaagacaagaactctctgaaaaccaagaagaacaatatagacagtgacataagacctacaggtactgaaatggtaaggttctcatacacagactttaaaatagctcataaatatgtttgagaacttaaataatatgtaagaattttagcagaaaaatcagaaattatgtaaaaaataaccagtggaaattttagaactgaaaaatagaaaactaaaattaagaacttaacagtctaacattagattagtcagagctgaggaaagaattagtgaactgcaaggtaggtcaaatgaacatatccatcaaagatacagagacaatgtaacagaaataaacaggagcagaggtctcatatgtgtcaactggaatctcaaatgagagaaaggagagaatggggcagaagctatatatatacacacacacacacatacacacatatacatacatacatatatatacccacatatatacatacatatatacacatacatatatatacatgtatatatacatacatacatacatacatatggctgtaatggcggaacattttcaaaactaaagacagcaagtcacagattaaaaaatgctaagaattgcacagaaactacaataattcagcaaagggaaaaagaagaaggatgagggataaggtaggcgtggcaaaatcttgataagaattactgaagctggatgatagacatatgaaagttcatattattctatttttgtgtacatttgaaaattttcataatcagggcactggattttactttttcacttttagaaatgatggacttcaggagatagcctcaagtttcaaaagatttggaattttactaaattttgagccttctgtagaaataaaatgatacattcaatgaacagtatataacagccttccaatgctgtttcaagacattagacagacatagacttgatagctagaataatagcagagggagcaacagcccacagtgaacattaaaaggcttcgctttaggtcttaaagcaaatgtagaaactcagtgtcatatgccaggagtaaacgggacaaagaggcatgaagaggcacatagagtcagtcttctgatgttccttaggctctgtttaatttaaagcagctgttttatggaagttatttatgcctttgtggtaggataactttattagtaatatgatatatttttgttgctgggagggaaaaaaaaggtcctaacatcaggaaacaaaaccaaaggggaaaaaaaaagatgggccccacagtcatgaaaccacctcagaacacggagaactacttcttaccatgaccttaattcacccaggctgctactctggagaggtgctgtttcccaagtgggtgatgaatcactgcttctccatcacctctactgctgtgctttgttggtgacagggagatcagggccgtgaattcttgtttccaaaagaaaaagaacttgggttccagcccagactgaaccctcagctcttgtttggtttctgatatgtactattggcctcatatcattaagatggatctgcactcccccatctctatgtgagtaacagaaagaaaattcgtggtgtcacacaggatttgacaacatcacagtgagattttatctaatgcaatgaaatttttcttgcatttcttttacttcataaactgagatacatttctacttctcttaaaaccttccaccaaataggtccttcactcaaaaggtggggtttaggccaggcgccatggctcacacccttaatcccagtgctttgggaggccaaggagagaagactgctccagggcaggagttcaagtgcagcctgggtaacatagtgagatgccatctctacaaaaggaaaaaaaaacaatttaactagtcagccatgcttggtgttgcacagctgtggtcccagctgcttgggaggctgaggtgggaggatcacttgagctcaggagtttgaggctgtagtgagctatgatggtgctactgtacttcagcctaagtgacagacaagactatctctacaaataaatacatattttttttagaagtagggttttcttactcttattagtttgacaattaagagttactttgcacatgatccattattagaatctttaatcagataagaataaaagagactttcaattatctgaaatgtccatgttattcagactcaggagcacagagggtaggaaagcagtagataaattagaatgaaggagatacaagatttgggctgaagacatggctcttccagttagttgaatgactatttcacaactaatgtgataagagattggagagcatctggaaatgtatacaactccatacgaacacaaactagtattattaagtttccagggctagtaaatgtatggtaattagtggaatgcactgttgcacccacatggagattacacactgggttgggggtggggagaatcactaaaaaaaaaaaaaaaaaaaagcatgatagcatcaaaatggtcattttccacagccaaaaacaaacaaacaaaaaaacagaaaaccacttgaactactgctacatttgcctgtttcttttaaaatacaaggggcttgggcagcaacacacaggaaagcctggagtagttgagatgattctgggtgagtgtcctcattaagggaaagacttatgttgcagataggactaagcatccaataatgaaccaaactggggttttggtctttccttctagaaaacacactgagaaactcttgcctatatttgtaacttttatattaagtgtgttcaattattttcacttcacactggacttaaaaatttcctcactctcatgcccgcgagcagcctggctggcagcagggaaacctcaggggctgtgtggatggccctcagtgtggcgcaggggtgaggactggccagcatcttccaggcaggcaggacagtcctccacttcatgtaaacagtttcctcttgaagactcctaacagtgataatgctgtccttttgcctgtctcatatatgacagcactatttttttagagtgtgaaacatttgatgacatcttgaaggatttcaaaaaggctggctagcacaactgaagtataaaataaccataatttagtttaatacatccttgagaaaaaatggtaatgagatattccctacaaaaactgcatttattctgtatagtctatccttgtgtgggataaagttctgaatgtacacactcaagccctccaaagatggtcatatcattcagatcattcctcaagaaacttaacagcagaaagtttaaaattttcagaaaattttaaatttatttgaacgttttagttcaagtttataaaagttggtttatattctactcctagaaatgcagcaggcatggtagctataccgattcaatgggagcatactgaaaacaatgtagaacgctcgatgaaatattctaaaaagcagtaagatgctggcaagataggaaggcattgtcaggccagaatgtgagtgaagaaggactcctgacaaataagcagaatagctgaactgctggtctgctggagtctctgtcctcctctgctctgtgggacttgggggacaaaagagcaagcccactgtctccccagcaggatggggtctagtaggaaatccttcctttcgttcaacttatttggaatggtaagtaagacatgattgccggtaacagaaggaaacagattacatgcaagagtcccagagagctgacaagcagttgcagagtggaagctgaaagaaagccagtggaatgacatcttccatgttctgaggaaaacaaactcctcctctagaattctacatcccaaaagacatctttcaagaataagattgaagagctgaagggtgcagggcttctgatgatgatgaaaatcttctgaaattgactgtagtcatggttgcacatatattaaaatatattgaaaaccactgaagtatacactttaaatggataaatccctctccctctccccacagtctccctctccctctctttccaccgtctccctctccctttcccacggtctccctctccctctccacggtctccctctccctctctttccacggtctccctctgatgctgagccgaagctggactgtactgctgccatctcggctcactgcaacctccctgcctgattctcctgcctcagcctgccgagtgcctgcgattgcaggggtgcaccgccacgcctgacgggttttcgtatttttttggtggagacggggtttcactgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctggctacaacctccacctcccagccgcctgccttggcctcccaaagagccgagattgcagcctctgccccgccgccccgtctgggaggtgaggagcatctccgcccggcagccgccccctccaagaggtgggggacacccccacccggccagccgccctgtccgggaggtgtacgcagcaggtcattgagaacgggccatgatgacgatggcggttttgtcgagtggaaggggggaagtgtggggaaaggaaagagaaatcagattgttgctgtgtctgtgtagaaagtagacatgggagactccagtttgttctgtactaagaaaaattcttctgccttgggatcctgttgatctgtgaccttacccccaaccctgtgctctctgaaacatgtgctgtgtcaactcagggttaaatggattaagggcggtgcaagatgtgctttgttaaacagatgcttgaaggcagcaggctcgttaagagtcatcaccactccctaatctcaagtacccagggacacaaacactgcggaaggccgcagggtcctctgcctaggaaaaccagagacctttgttcacctgtttatctgccgaccttccctccactattgtcctatgaccctgccaaatccccctctccgagaaacacccaagaatgatcaataaatactaaaaaaaaaaaaaaataaaaaaaataaatggataaattgtaagctgtataaactgtctctcaataaatctcttaaaaaggataaagatgaaataaaaatatctttagacaaagaaaaattgaaaatttgtcaccagatcttcacaaaaggaatttctaacattttagttgaaaggaaaatcatcccagatggatggtctaagatacaagaaaaaatggacaaagagaatgcttaatatgggcaaatctatgaatactgacaaaataatttttgtgggttaaaatatggtaaaaattaaaatacacaacaattatagcatatgtatcagtaggagaaacagtagtattcaagcgttttaaagcctctctacatccacgaagaccgtaagaaagtaacatactttctttacaattctttaaacagttcatctgtgacttatatatccttcacaatatgtgatttatttaataattttaaaagtcttaattaagactttttaatgttctgtttaatgtaactgatttaatgttctgttttaatttctgagtacaaagccagtttgcggagagcagtcaggttaataggtaatctagggatttaacgatctcaaagattgagtgttacatcagtaagaaaggagcattgtcgttaaaaaaaacccataccttttccttgtttggaaagaaaagaggagagtcataaaaattaaatatgaataaaaagctgcacaatttactttaaaatagaagatgaaatatagtttggcatcaatgagcttaccaagccgtatgtatctgtatctacaatgttgtttaacaaccctatactcatgtgatgttgttgacatagatttcagtagtgttactggtactttattgaaatcaatcactacagatgccaagtactcagagcccacagaccttgaagaagtcataggatgggtttccatagcacaggtgttggaaggtgccgtattgtggtgctgggaagcagagatgttctcttctttgaagattttcaaagaaaaaatatagcctgttgtagcagagcagctagcactgcttagatgcagaatcatgagaaagtgaggcgatagcagaggctggtaaactccacctcacaagccaaatcccatgagcaacatgcttttgtaaataaggtttcgttgggacacagccgtgtctattcatttacatattgtccacagctgctttcaagctacaagagcagaattaagtaggaggatgtatggcttgcaaagctgaaaatatttactacctggctcttcacagaacagttgctgacacttgctctacgacaaaggagttactaaaaataagaggccaggaagaggatcccttaaaaaaatgatcgtaatggacaaccatgaataggtctgggaggtggggctgcctagttgtctgcatcactagtaagaataatggtaattacagtaacagcagttcatacagttagtgcctttgcctcatgtcaggcactgtcctaaggactttgagttgaatttattctaaaaaaaaaatcttattcaagcagactctggtaatgatggtgtaaagtaattagtagttcttgtccatagaaaatgagtacaaaactagtcaaaattgccaaaggcaaccactttagggcatcagaaattgatctaaggtagacaaaaaattgagaagtgtttatttttttaaaaataactatattttaaggtaagaaaatcaggattctatggtcttcttgcctgaggctattcccatctaccattcacccccaagtcagccttagaaggaatgagaccaactctccgtatcacctggataactgggaaattgcatgtacacaagggagacccaaaagaacctcatcaaaagtaaaaatcagaggagatttgaggaccttaaatgtatcttctcacacacaagtgaccagcagagtggaagccttataggctcaaggtatttcctagaggtccccctgtgtcttctgcatagcttaatggtctgcccacatcacaaaaaagaagaaaaagaataagacactaagcaaagacaatactgatgagctccactgcgtactccacactctgcagctgaagtccaagcaagttacaaaacaatacaccacaaaatgctcaccaactactctcagaacaaaacagaatgcagttataacacattatttaaaatgttcagttcccaaaccaaaaccaccagatatactgtctctacaccctgcccccaccccccaaagaaataaagacagagggcaggaaaatgatacaaagtgtcaaaagaaacaaactattaaccgagatacctatatccggagaaactaccatttaaaaatgaaggtgaatatagtaaagatgatgagtctctttaaattgacttagtgaaactgtaataaaaatccaagcttgatatttgtagatatagacaaactgtttccaaaatttatatggaaacacaaaggaattacaagagtctaagcaattctaaaaaataataaaattggagggctcacacaatccaattttcagatttactagaaagccacagtaatcaagacagtgtggcactggcaaagagatagacacaaaatgaatggagcacaatagaaattcaagaaattgattcacacaaatgtagccaattattttttttttcccaaaggcataagaacaattcaatggagtaaggatggcatttttaaccatcttcaacaacacctgttatctaccttttctattatatccatcccagtgggtgtgaagtgctatctcactgtggttttgatttgcatttccctaatggttaataatgttgaacatcttttcatgtgtttatcagccatttgtatatcttctttggaaaatgtatagtctagtctaggaagaaaaacgaacttcaacctgaacttcataacttatatatcaaggtcaatgatgaggccatgaactcaaatagatcattgacctaaatacaaactcgtaaaaattttagaagacgtaggggaaaatcttcatgaccctgagttaggcaagagttcttaaatatgacaccaaaaatatgattcataaaagaaaaaaatggaaaaatttcatcaaaattaaaaacatctactctgtaaaagatacatttaaaaaatggaggcctggcgtggtggctcacacctgtaatcccagcactttgggaggccgaggcgggtcgatcacttgaggccaggagttcgagaccagcctggccaacatggtgaaatcctgtctctactaaaaatacaaatattagctgggtgtggtggcatgcgcttgtagtcccagctaattgagaggatgaagcacaagaatcacttgaacccagaaggaggagggtgcaatgagccaagattgggccactgcactccagcttgggtgacagagtgagacactgtcccaaggggaaaaaaaaaaaaaaaagaaaaagaaaaagaaaatggaaagacagcttacagagtgaaattatttgcaaaatatacatcagattgaaggcttgtatccaaaatatatcaagaactcaataaaacaaagccaaaaagaaaaggaaaagaaaaaatggtcaagagacttgaatagacatttctacagagacaatatatgaatgccaaatatgtacaggaaaaaatgatcaacataattaggtaccaggaaaatgttttccaatgagcaccaccacgtaccctttaccacaggtcaacaggctagttctccatcctccctctaaaccaaatatatatgacttctcccagattgtggaagtatatatgcatttcctatgcttaattagataatcaaatccctacttagagctcaaattactcaaattactcaaattacaagttcctttagtcttgttcctagaggtgcctctgcagctatgaatcttgttttatacttatcaacttatcaacttgtaagattttgacagtttttggctaaaatcaaacaaactatcaatactattcttttgtgtttgtgaagatgtggaagaactggaaccctcatatattgttaataggaatataaaatggtaaagcactttggaaaacattttggcaattacctaaaaagttaaacagaagactcgagtgagatggtcaaaagatctgactagatatttttccaaagaagatacacaaatggctcataaacacctgaaacgatgctcaacatgattagccatcagggaaacgtgactcgaagccagtgtagtaccacctcacacccactaggatggggataaccaaaaagacagataataacaagtgttggtgagcatgtggagaaatgagaaccctcataccctgctggtgggagtgtaaaatagtacagccactttggaaaatgatctgtcagttcctcaaaacattaaacgacagagttatcatatgacctagcaattctacctctaggtgtgttcccatgaaaaatgaaaacacaagtccatgcaaaaacatgtatacgaatgtttatagcagtgctattcataatggcccagaaatggaaacaatccaaatgcctatcattttataaataaacaaagttgatatctccgtatggtggaatattattcagccatgaaaaggaatgaagtgtttatacatgctacaacatggatgaactttaaaaacattatgctaagtaaaagaagccagacacacaaggccacaaattatatgattccatttatgtgaaatggtatatgacaaatcccgaataggcaaatccacagagacacaaactagattagtagtttccatgggatgtggccaaagggggttggagatgactgctaacaagcatgaggctttttttttgcatgaggcaatgttctggaattaaattatggtgatggttgtacaaccttgtaaatatgctaaaaaacccactgaaatgtacacttttaaagtggattttatggtatgcaagcgctatctcaatttttttaaagattaaacattatgcccctgaattccattattaggaatcaatctacttatgagaaataaaaatatatgtccatacaaggtcttatatgtgaatgtttacagcagcattactcatcatagccaaaaaagtggaaataacccaaataatcaactgggagtagataaatatgatgtactatatccatacaatgtaaactactcagcaataaaaagtaacaaagtactaatacatgttacaacatgaatgaaccttagtaacatgctgagtgaaagaaagcagtaaagtaaggctacatatatgattccattgataggaaatttgtagaaaaagctgaactatggagacagtaagcagaaatgtggttacctggagctgggtatgggtatgaactgactgcaaacaggcctcaggaaaactttggagatactagaaatattctaaaaatggattgtgagaatttttgcacaaccataaaaacttctaaaactcagaactgtacaacttataatggttgaattttatgatatgtaaattatgcttcaataaagctgttaaaaattaaacaaccttatgagacagatactattattgttgccattttagcaatcaggaaactgaagcatagacagattaagtaacttgctagaaaatggcagagctattatttgattccaggcaaaatgattacggaattcttaaccactaaatcaaatccagtgtaatttgctaactataaagtatagtactgggaaaattgagaaaaatgccaccttcttccaagagtcaaagaatgatcacacattgagggcactatttatatacctaactctctgcaagtaaccccatttccatcctctcttattagcacaccaatttgcaaggtagttgctattacattaaaaatatacaatttaaaacagttcagcacatgtgtcttataatggtctcctccaaattccatagcgaccattaaagaaaatatgtctgggccaggtgcgctggctcacacctgtaatcccagcactttgggaggccgagcactggggtcaggaggtggagacaatcctggctaatacggtgaaaccccgtctccactaaaagtccaaatttagctgagcgtggtggcatgcatctgtaatcccagctacttgggaagctgaagcaggagaatcacttgaacctgggaggcagaagttatagcgagacaagattgtgccactgcactctggcctggatgacagagtgagactatgtctcaaaaaaaaaatattaactaatcaaaattttttttaaaaaagaaactatgtctgatacctacgcattcagagctttctttgctcaggcaccctctcctctcacagtctctgaaggccaggcaaaaaggctagttctttaccctccctctaaaccaaatatgtatcactccttctacattgtggaagggtatatgcatttcctatgcttaattagagaatcaaatccctacttagaggtcaaattactgtagttcctttaatcttgtctccagaggagcccctgcagccatgaataatcttattccattcatacttatcaacttgtaagattttgacagtttttggtaaagcacaaacacatagccataagtactgctcaagcagtatttttcaaagggaggaagaaagggaaaaagatgagggaagagtaaacgttcatgaaaagaaagatttctcccctttgggaatctgtttattttgccattgtcaaagtgaggcaggaattcaaacacctgacggcatggaagtggcaaaaccatgtgggtttgacttgatggtcctgagaagctgctggcaatgctttttaaattctgcaaatataattaatggcttgtttgctattttggcaacttaaagcaggggctatgactgcctgtgacaaaatcagtaattgaatgattaaactagatactcacagtcaaaacggcatctaacaatttacctctaatacaacattcccaattaatttttaaatacctattaagatataaaaagatttaaatataaaaaaattaaattcaacttaaaacactttaaaactagggccaatgcctgagtctagaaagagactacctaatgccagagtctaggagttcttctgagccacaattttgctgagggcaatgcatagtgaaacgctatgagggtaagactgcctggctgaaaagagtgacaaggacccttcacactgtcagaatcatggatcagaaatcaagtctgcaccaagcaagaatctgcacaactgtctgtgcaccatgtggggctggcttctacagcagacatacgcagtcattttggtccctctctcctcagccaatatgtttattccatatacagactttaacttctgggaaaatgcagggtagagagtggagagaagtggcaggaatggtgtcacattgaatacgggcataagcaggtatcatacataacgtgataagagaaggctgagatatgaggagccttcacagaagtacattctacagtattcagttttcaaggtactttgtttcatgtaccagaaaagcaagctaagagaagatgccatttcagtcaaccagttcccaatagataaaaatacactggattgtgagaaccagctgtagactgagcatatccatctgttgtccagttacagatctgatgagggaatccaaagagcactaagccaagggcaacttgtgtaccatttccaccagcaaacattaatgctgaatgctttcacactaaaatgggagaaaaagcaaggatggctgtcatccatactcatattgaacataatagtggaagtactagccagtgtaataaggcaaaaaaaaaataacaggatatagaatagaaaggaaaaaataagctgcccctatttacaggtaacatgattgcctatgtagaaaatcccaaggaattttcaaaaacatttctagatctaataagtgaattaagtaaagcagcaggacaaactcaacccacgtaaattaattatatatctacagactagcaagacatacatgaaaaccaaaataaaaaacacagtaacacaaaattacttaggtatgaatgtaaaattgaatacttagatacacacctaaaaataccatgtacagtatctgtatgctaaaacatacgaaacacagatgaaagatctaaataaataaagagccacactgtgttcatgcattggaagactcaacacagtgaagttgtcaattctctccaaattgatatataggccaaacaatttctatcaaaaccccaggaagagtttttgtagctatagacaagagtattgtaaaattagcatgcaaaggcaaaggaactagagcagctagcacaattttggaaaaggagcaaaactagaggattgatgtgatctgatttcaaatgtttctagagaagtacactactgaagaccagaagtagcaagcactagttctcatgctaattctgcgatgttcacttaccacactgctgccctgtttccagttttccactgtactttggaaaagctagtttggaagtgttgcaggagaggtatctaagcatctatgtatggcaaatggttgttctagtcatctactgctgtgtaagaaaccaccccaaaatgtagtggtataaaataataaccattttcttatggtcacatattctgtgggtcagaaattcacgaaggatacagcagggatatctcccctctgttctattatatctgggcctcagctaggatgacttaaatggccaagggtgtctcaaaacagctgcagctcaaagatctatttccaagatggcttcttcattttcacctctggcacctgagctcaagtgaccaaaaaatgaactcaagcagggactatcaacaagagtacttaagtggcctctccttttaggttctcaaaacatggcagcttggttctaagagggaatgtcacaagaatgacctttctggaaagccaagtgttgccaaggaccaaggcagaagctgcaggggttcatccaccctagccttggaagtcgcattgattcacttctgctgcattctagcagttacaagagcttcatttagggaaaaccagattcaaggggagggaatttagactgaatttttttttttttttttttttttgagatggagtcttactcttgttgcccaggctggagtgtagtggcacaattttggctcactgcaacctccgcctcccgggttcaagggatcctctggcctcagtctcctgagtagctgggattacaggcatgtaccatcgtgcccagctaattgttttgggttttagtaaagatggggtttcactatgttggccaggctgacctcaaggttggatcgggtggatcacttgaggctcaaactcctgacctcaagtgatccacccgcctcggcctcccaaagtgctggaattacaggcatgagccattacgccaggccagactcaattttttgatggggaaatggtaatgttacattacggagaatgtggaggaggagatattgtagtggacatcttttgaaaataccaattgtcacaatggttacagtaaaaaaatacaggagcatttaaaaaaaatcctccactaaagtaatttccactttatccaggtattatgttataacctcagaggctctctaagtcctttcaatcaacagactaagtttttatcactcacatggaaggttctattatacttgcagatgcaatactgtgcctttcacatgctgcccgctaggtgctcaaaaggccaaagaagcattaatttacactcacttgcctactcccaccttttgggtgggtgattcctcaccataaggatccctttgcccaacccctccccatccccttggtgttttctttcaagagacagggcacctctcccccagagagagagcgagcgagagagagagagagagtgcgtgagagagtgagaaagcgagcaagagagagagcaagagagagcgagagacaggcagacaaggtcttgctctgccaccggctgcagtgtagtgctgtgactatagctccctgtaacctcaaactccttggctcaagagatcctcctgcctcatcctcccaagtagctaggactacaggtgtatgccaccatgcctggctaattttattttttttattttttgtagagatggagtctccctatattgcccaggctggtctcaaattcctggcctcaagcaatcctcccatcttggtcttccaaagtactgagattacaggtgtgagccatggtgcccagccagaattttctaagagccttttaggatgcagctataccacggttacatttattttaacttgtagaagttttgctttttttttttttttttaaaaagcaatcactcttggagatactagatactacaactattacctaaaaacttaccatgataactagttgagaacaaagctttgtaaggataagcactgagttgagttggggtgtggacgggggggggatggtggcaacagaatattaagaagaaaaagaagcctacggaaacctgggtatgatatcaaaacaacaaagattatactacctaataaatgtaagtacagtaagtatggcatctttatacaccacaagccaaattcacatccactacttcattgattaaaactgtacagtttatcatgttgctaacgcaatgtagaacccaaagttccaagaggcgaggtgatttggccaagtcttcacggcgtgaaagggctgagatcggaactcagcctgtgcttcctgaacccagctctctccagccatctcattgcctcactgaacctcacctaacagtcatgtacgttgttaacttcttaactgaaatatttccaatcaatgcaagaaccctaacacactctgagaccactgagtacaaacaagctggcagcccagcatcacccgtcccacagcgcccaccaggagttcacacgtgaagcctaattcatcccttaaaaaaaaaaaaaaagtgttagaaaaatgtgaaaccaatgaatctgccagcatggttgtttcacatagaaaatctggaatccagcatctaaataaacggtagaatactgttgctaccagctgtgattccatttaagacaccatttgtggaaaatatttattatggtcttccattttctcagcacaaaatcaaagaaaattgagaaatatgaaattacattgtcttcaaaaatcctgtcatagagtaactcagctctcacagctatcctctgaagatgttattgatgttctaccaagttgatggagtaatataatttgctagcaggaaaaaatgctggcaaacagaattgtgttcattagagcggtatctttacaacgccttcttccactttcattacttttcaagatcacacatcatgtcacagggccgaaccacagccttgctatgccctggatatttcagtatttttttacagttggaagcagattcttaacgcttgtgcaaattacagctatttttgctaaaatgggctcatttatgctgctggggaaaagaagcctctctgtctccctctctctgaaggtctatgaggcagctctttacatgtagctcccattacttcaggctcgtaagttcccgcgggggcagtctcttccataaccaatcatcagacctagcgctggaccagttcacatccacactgtgaagtaagcatcgtttgtctttactccctttccatccctcttagttctgacaagttttctctttcacttgggctgaaggactcaccaacggccttcttagtgtggcctcacaaatgctgccttctccagagcagctttctccagaagttccctctttacccagtcaaaacttccaagcctcctttagaaaagtctgatcccatcagggtgttaaaaaaaaaaaaaggcaaccttattagatgaaattacaggtgttaatgattaataatttcatagatgagtttagattttgagggagaaattcttatcaactcaaaacaatttttaataggtaaaatttgaaacaacacaactacgtgctgcattttcatccgtgggaaggaaaaggatttttgggcacaagcgactcccagattcctcaaaagcaaaccacggagagttgagcttcatgtgtgtggtagaggttcaagcacggtatagggagtcgactttcgaactgggcattgtactggtcacatgctcaaccttgctgctgaagtgtcctttaaatcacttagtcctgggaagcaaatgcaagatgcatggatgggacctgaccagattagcacagggaacagggcaaggagaatggtgagcagattaacacagggaacagcgcaaggagaatggagtctagattagcacagggaacagggcaaggagaatggagtccagattaacacagggaacagggcaaggggaatggtgaccagactagcacagggaacagggcaaggagaatggtgaccagattaacacagggaacagggcaaggagaatggagtccagattagcacagggaacagggcaagaagaatggtgaccagattagcacagggaacagggcgaggagaatggtgtccagggcacctatgaagcattgcttctactttctgagctgctggaatagactacaagctttgtggtctgcattcctctacttctactaagcgttcacatgactcgggaggccagatgttattcctggctcatgcctactaggttaaaggagtgggggatgctttacttccaattattgaaatgaatcacagactgtttagagccagaaggaagcagagatcacctgcttcaaccctgtcaccttaaagatgatgaaatagcctagaaaagttgccctaggcccactcaggccatgcagcaagctctaagcccctcagctctatcaagttgggtacacaaaaggtgcttaataagtgttggctagcctagtggctggattcctgaggtctgcttcctagttccatgctcctttcattataactccctcccatgcccaccatccccactcccacattcttcgttccagtctctggtggaaaacaatcacagaccatgccagagtccagaataagaccccaaagtgagttaggggacggtccacttactcagttacttatgactctaattatgtgccaagtggtgccagtgtgccactgctaattattactacacaggcttcagaaactgggccaattctttcttccttccaggaggaggtttggactaggggaccgagaaggtggctctcaggaaagcattccgaaagtttctctatcacggagtatcctttgaaggtgaagtcaagaactcctcttggaacacggcaccaggagcttttggagtcccggatgcttgcggatgactccccttaatgaaatgtaggtatgacaaggtgtacgtggcactaggttcagaccatgataatgtgccatttcggggacctgaattcctattatgatgtaagtcctttcagagagactttcataggcagctccctaatgaggcaaaggtctccgtagctcctcacgtataaatggaaagttgttgcacagaggaacagggccctttctaaccaagctagcagggacaggaatggcactagaacccagtatatttctgcacagactcaggatttttaatagtctgcaatacggcaagctgtaagcaaggaaatattccaataaaaaaataaaatacagactaagaagaaagccacagtcaatatttgattatagaattcaatgaatgattggggtaatataaacaggggatgacccccaaattcttgatgttggcctgaaagtattgtttttatttatatttaagtacaattgtgtggtctgtattctggaaatttccttgaaactaaatattggtgccaaatgaagtccacagagaattttataagctctatattttacctatttccaccattttccaattctcctcaacacgaatagctgacttctttcactgctcccaaaacattgttgggacaaagatggtctatgggttaatggatttccctgctcaggctttgtactttctagctggcaattatagctccttacatactattgattaaagaaaaattccatctctggtgttgcatccacctttggaaaagtgaaactagaattcattgaccagtttgttcatttatttgttcattcattcattcatgcattcacattacagattccacatttactgagcacccattatgggccagacactacagggataagctgggaaataagggagaccacggttcctgtcctcatggatcttacatcactgtggaagggccagatactggaaagtattaacaagtctggtgagtactgggcaggcttcaaaagggacctacagtagtcagagctgctctagagagtcaggaaaaacttagaagagacactttcattgggggctggtagatgagtaaaaattaggctgatgaaaaaacagtaggtggaaaacccccaggggcacaaaacagcaacactgagaattcaacgaactgatggaaagtcaagagtgtcccaactatagaaggagagctgcagtgaggaatgaatgaatgaatgaccctacttgctagattagtggaatcaaccccagtgatgaatggggcaacacgggcagagcccactcttatctacccactggggcactaggtccaagtgaggggagaacccccagagtcagggtcggcaaagcttttcgagggcagcatctgcaccttgagggcaattgtactttctatacttggctccaaaccaggcacacagtcagcacctaaaaaatgtggatgcttttagaaaagacagagtcacaagcacataattagagaaagcctcttttggtcagagggagagcctcatttctgaagcaggaatttctgccacagataagccacaatgggggatgagtgtactctgtgattctttggctaactgaaccatttgcatggacactgctaattttgggaaagatgactgaacagctttatgggtcaaatttgagactgagttgtagagccagatttgaatccaagactggatgactctgttccatctaatcatcaggctcattcatttccagataaaatgattttttttctgcttactctgctttcctgagcaaactgtacttttcagttgcaaaatattacatttacctcaaagcccagggaaaataaaggtaggtgatacaaatgacccttttttgtgactgtggatgtgaatttggtctctgtcctaagaaatgatgtgcaggaactggggagaaaggaggaggccatggtgaagctcaccacccaggctgcatgtcttcaataagctacaccatgaaaaagctacatccctaccagacaagcaattcctcccctggtatccaaggtctcagtgatttcatcaagctggccactttcttcttcatccacatgggatacctatactaaactactctgggcatcttatggggaataaaatcagttgggggaaagagagcctattatgttacctaggaaaagagatctggcaagtatgagatgctttccaaattcctcttgggcactaaagtactacttgcaacacttattaatgcaacggatcagtttatcctgctaacaccatgaggataaattgcaaaacagcatatggaaatggcaggagtctcaaactcagggcatggtgacactgtgtctctgctagtaatcaaggtttacgtgctcactgtctgtgtttttcttgaacagagctgtggagcacgggtcagccagacagattatcattttctgtaagtaacaagtttatctacctcttaggaaaggaatggggggagaggacgggagaaagagagaggggggcagacagggggcctgtgcatgctcatgagtacatcagtcggtatttgttctgtagaaattcaatttattcaacaaaaattctggtctttttagccttcagctagattgtgtctgatacgcagaggtcacatgtgtttggaagccactgaaaacctcctcctcttgccttctctgatttctgtctctagaattatcgctgcctttcttttctctgggccactcccttccccattatcagctctcctctcatgctttctggtagttctcactgtcatgccaatgacagaccatctgattagactgttttaaacattctaattttaaacttgtgtgtgtgtgtgtgtgtgtgtgtgtgtgtgtaagcggtatacgtattcccaaaaggctgttcgatgaaatttgatttatgtcctctttctgggcttactctcaaatatatatgaaagagtgctgactttgtacctagagggtttacaactgagccaactcattcattcattcactcattcatttattcattctcttcaaggaatatttattgagaacccacaatcagccaagcactcttctagatgctgggtaccgctctagatgagtgttacctcaattaatcctcacagtaaggtaaacattattactctcattttacagatgacaaaattgcatctcacagaacttaaatataataattggcctaagccacatagctagtacactgcaaaactgctctgtatctaacttggatctttttaagatgctctcaactgctagcagatagggattctcttggtaatcagattttgtaaattaccatgcctaattctttatgccacaatagactccaaaaacagacttattaatgatgacagactatgggcaagattctgatcactttgagaaaaagacagaaaaaaaatttttttattccacaacttctcagttagcatggaattctgacattccatttgtttatccactttgggggtgtcatgataatggggaacatagtccatcaacatatctgtaagctaggacttcattaatatttgttacaatgaacagataaagttgtctatcgctaacatatagcttctttacaaacagtagctctaatcacagttaagggtgcagacatgatctgcagggtttgggtggacgaagggagagggcatgagggacgacgtcgaagttcaaagacaacgaagtctcctcgggattttatgctggctcagctcggtcatctcagtggctgctgccatccagtaccataatgatgacaaaatatgctctcctaagttataaaacactgtgctgaaagtaagaatctctgataaagccttgagtttcagaagacttgcctcctgccccttactgcatttctagttagaaatatcttccatataggccaggcacagtggctcatgcctgtaatcccagcactttgggaggccgaggcgggtgatcacgaaatcaggagatcaagaccatcctggctaacacggtgaaaccccgtctctactaaaaatacaaaaaatgagccgggcatggtggcgggtgcctgtagtcccagctactcgggaggctgaggcaggagaatcgcttgaacccaggagacggagcttgaagtgagccgagatcgtgccactgcactccagcttgggcgagactccgtcccaaaaaaaaaaacaacaaaaaaagaaatatcttccatttaaagtttcacttgcatacttgcatgttttcccgctggcagacagagtgtaacaacactaatttgaccatgctttccagagcatggcggggcaggaatgaaaaccgttgtagccacttcctccctactgccaaggctccggcttgcttcgtctctcaaatctccacctgtcactctgtaatgaatgccacccagaggtccacatctcattttacccatcagtagcacacactactgtttaccatcactttcttcaaaacaggcccctcttggtctctcaatccctgccctcccctgctctgcccagtgcccccccaactgccctcacctctatgctgtacccgccacacctctcaaaccttgccctcccatccatatagctattttctgcagggaccaaccatattagcttaggctaacgtgcaaatccctgaccatggcccacagccccacatgacctggttcatgctttcctctcttttataaagagttttatctccacaaatgcttcatctgccctaaagtctatattgtttgataatgacagttaacccagctttcctctgattaatgtggtcttgatatatctctatttcatctcattatttttaaccccttggtgcagttttcttcttaagcagcatgcaactgggcttaaaaaaaaccaaacaaaaaacctgtctcttaatatttaaatttcatcttaatcatttacatgtatggtgatatatgtggatttatactctccttatcatttttacctagtattttagtttcatctttcagtctcaacacagggaaagcagttgtgttcacattcattagtaaattctattttctgacatttcagcaatttctatactcaacactgttctacgcattctacaacttctctctgggtttacttttcttgtaatacacattctttttaaaaaattattttaacaagattccttgtacctcttaaaatatctttatttcattttcacttttgagagacagtttaactatagacagaattcttgacaattctttgctttcgcacattgaagacattccacgtgacctgacgtcactggctgttgagatgttctctcaatcaaattgaaatcaggttgtaagattctctgccagcgatgttctgaagattcactagtgtgtgtgtatttacatttctttgtattgataccactcagtacttgggggtatgctttgaatttgagggttcatgccttttaaaaactctgtcaaattgaaaatttgctggtcattcgttctactctttcttaaagaacttcttattagaaacttattggatagtctcaaaatatccctcctgcctcagctgcttttgcataattttaaaaaatgtctttttcctctgagctgcattctgggtaaattcctcaccactatctcttaattcaatgtatctttgtgggtttttttatttcaatgactatagttttcatttctgagatttctgattggttctgttcctattctcctgttcttgtttcacatatgtttgtcccccaatcccagtggatattatccatttttttctctttaaggatttggaataaattgaaaacttttattctataattttatttccatatggagtgaatttctgattgtgaatctcagtggttctctttttgatgctctatttctttatgtgttttggcatttaggtgtgcatgttcatttcagtggcaggttctctcccatctgtctctgtccctgtctccatttgcatcctacccccacaagtgcctacgccctcatcttgaacaggatcttaaatgctagctcaaggatcctatccccagtgatagggacattgcaaatccagtcactgaaccagcaggtggcttggctcaggccctggtcaggatcctgtgtctgggatcttatacctccatagactcacaagcttcatgtcgaccatcattccaggcataggtcagcagttacttttatcagcctcccatcatagtgaggatgtcctctctcatttatcaacatccccggttttcagtagtgagcctgactccacttcccatttcacagagtacatatctagtccctgttacattccaggagccaaattcccagccattttgcctcctttatccgagagccaggtagccagtggcttcagctccatcacttctttgcatttctcttctttttcagattcactcgctttgagcctagctatatctttttaatttcccattgttatattttgtctcttgtggcctaaagcatgatctaaccatgccagctcaccaaggagttccctgactttctctacaacctcacctcatgccacgggcccatgcgctccagtcacctcctttgctatctcttcagttctctggtcaatcaagatttctcccacctcaagaccagacacatgcatgaagagaaagagccaagcactgaacgctcttgtcccctctctccctaaatactattctcggccttttaatttcagcttaaatacagtctctctccctaaatactattctcagccttttaatttcagcttaaatacagtctcagaaggcacttttctgatcactctatcttagtaaccctatctcccaattgtttattaattggatccagttagttgtcttcagagcaaagttgcaaacagtcacaagatcgcccaaaccacagcttacaggccacacttctttttggtaagatgtacctacaccactaacattgacagtggtgctgcctacaaatataaaggtcaaggatatgtacaggtatggcccaatgtgaaagacagcagacttcttgggttgggaagtctgagtttcttttcaggactcagatgatgaaattacctggaacttaaggtattatgtccaataatcaaatagtctcttgtttcaatattttatcaaaaataaaatataataaaaccttattgggacgaattgggatgatgaaacatccaaattaatggagatttggaattctagattttttttttaataaaatggagactgatttcttgtaaccctgtacaacagcacagagtaatggtttacaggacactgccaaatagagaccctgccaggacctactttaatgaacagtaaagaactgtctatgatcaactatctttttagcggggatagcatgctgtaaaggcagcatgaatgggctagcatttcccctataatttcctacatatttatgattttcacaggaaacaatttttttccatctacagacactggaaatgtgagtatcagctctctctctacagtaccataaattcaaaatcagtgaggccagatcaatgaaatttgatacgcacaaaactcttgcatattctcatgtgagtgtggaggagagcagagtgtcatcaagactccactccacagccatagtctccgcatctgcagttagctcttttaggacagctagatcactgctccattctattagctccaaacatactgcaaccacctgttgaagctgggaaggctcagcatttttttctctttctcccactggctctgcagaaagcatcacaattccaattagtctgtcaaaaacgaaaggccatgacttaaggtgcaaaacacctatgaaataatgaatttggaaggacaggaggagacatatctgtaccggttagtgtactcaagaatcaggctatagaggaaattgcttctttggtagtgtaaatacaaagttttcaagaatagttactacaaggcactttctattcaagtaccaaattgtgagatacagaatatgaggggatttggtgaatgttttcctttgaacagggctttacttcaggtccatacccaaaggaatatcaatcatgctgctataaagacacatgcacacgtatgtttattgcagcagtactcacaatagcaaagacttggaaccaacccaaatgtccaacaatgatagactggattaagaaaatgtggcatatatacaccatggaatactatgcagccacaaaaaaggatatttcatgtcctttgtagggacatggatgaagctggaaaccatcattctcaacaaactatcacaaggacaaaaaaccaaacaccacatgttctcactgataggtgggaactgaacaatgagaacgcttggacacaggaaggggaacatcacacactggggcctgtggtggggtggggggagggggtaggatagcattaggagatatacctaatgtaaatgacaagttaatgggtgcagcacaccaacatggcacatgtatacatatgtaacaaacctgcacgttgtgcacatgtaccctagaacttaaagtataattatatatagatagatagatagatataaagaaaagaaaagaaaagaaaaagaaacggccaactctaaggagatttcaggtccactgcagacgccccctactggccggttttcaaagctatgccaagacatgtcctctcaattgcttccgggttccaaaaaaaaaaaaaaaaaaaaggtggatcaagacaccagcgaggctcattgcttgtggtctgcttcttatgtgttctagggaattttattttcaaaagctacaaagcttttcacaatatgggtttgaggatgctcagtacgtgagaattttgggttgaggtacagaaaccagataaagccttgttcatttgctcattcggcatcaacgtccagtgtgtcccaatgtaaatgaatcactgtctagaaagtagaaacattcttatttttttttttaaaatatgcaactcttggctattactggctatttcatattccaggaaagcacagaggattctgcactgagctgctgcaggcgagctcactcctacccagctccttagcctggcctgcgccatcacccagtagtgcctgtgtcgagctggtctgcagtccctgagccccttccctaccctcaaaagaggaagcaatttccagtgggagccagagcggccccggcccatggggaagggcagactgagaagccttctgagggaaggatcttgacctgtcaacacacacacgcgcacacacacacacacatacacacacatacacacccccacacacatacacacacataaaaatatgcacacacatacacacacatacacaacacaccacacacacacacacacacaccttgagccttccccatgcttaagagccacccagcttcttaatctgcccaccccagaaccaggaagaaagagggaaatttcaagagccttgggctccattctttgtgatgcccagatgtgttttctcaggctgggcttgtactggacgaggctgaacaggagcggggcagctacccctccgctaccactgctggcttttcctgtgcctcctgttgctcccttattagatgaccactcaaagcttaattcctctcttatgttgtttgaatctcttcagatcacccttctggccttcactacctattttcttcttcctcccactttctctcattcttttccccctagaacaccatcaacccctcagcccagccttgctcaggcccctcagaccatgccttagtgttcccggcaggccctgcttccaactggactcactgcagcctgatgatgtccttgttactttttcacacagcaaatatccatccaacaggcactcttctcttttcactcctgtctgcaccctcgatactcttcacagaacaagctctagccctctccatagcagagaacctgcctactcctctgagagatgataaatgctcccagagaggaatcagagctataggtgacagctccttattcctattaggtacagagaggttgaagggagagggctgggcatccagccttccctggtcctcctacacagctgtgcaaggagcacagcaacaagagcaacatcacagagagagaggggccgaggggaggggttgcagcagctcagcaggaaggtctgccatgtcccaccatgtctgatgcactcagttctctcaattctgattcctacactcagccctgctctcaactgtgtaggaccccaaaaactgggttctctaaagggtctgaaaacagccaatccaccacaatcaccagcaagtgctgttatagtccctctcttctcctttccaattaaatgaacactaaatggactcgaatgcgtgaagtctgagatatcatgacaagaagtaaatttagttactctgaagcaagctaggcaatgtgtgagtttatgcaaacaaacatttttatgttttattataaagtgtaacgaatgttagtcatgtgagtaaactgggtacagcacattgttctctttgtattttggctgctgacgctggtagaggaggcatctgtctgccctggattaacttctctgtggtatctgctaatgaatcagtgaggcagagaagcttcctgcaggatctcccgacctcggcacacctgtccacctgtccatctgcccacctcatgctgcagcgctggaattcacaccaatgaaccagtaaggcagagaagcttcctgcaggatctcccgacctaggcacacctgtccacctgtccatctgcccacctcatgctgcagcactggaattcacaccaatgtgcaaacagttggcatcactttgaagccactccaaggtggcatctgcacttaataacaaacaccctgcaaaaaccgctgtgcagccgtgggcctaaggtatgtgcccacttcatcagcctcattctgggccacttgtcctgtcccgcttccttcatctccccatgcctgtcaccaccctagctgttgtgcaggttcttgagtgtggtattttccctcctgctaccgggtcagggagagctcttctctgaggctggccagcccctccggtagttcactttactctcacaactgggctcccttcccatcacctcctgtttctacctaaaagcaggtccttccatcggaagctcttctaacagtgtatctttccttcctagctcttcatgcagttcataactatacactatattttggtaatgatgtcattgtctctcatgctagagtgtaaactgtctagtgatagggttatatatgctgggttttttttttaaataatgctatatctaatagtgcttggcacataggaggtactcaatacatatttaaatatttgtgacattaatgaacaaatggtattaaggatacagaccaagagagctcaagcagaaaacagaacacagccctgtcatgcagatgtccctacgtaaataagccattaacttctctagatcaagctggttgggaaaaatgacatctgtggataacaaatgatgaaaactttgttcttaaagactgttttgtacaaatgcataagaaaagactaagttttttttcctaaagcaagtagtggacatcccaacaccatccatgggagaatgagagacatctgtcacagggccccaggaacttggggaaggattcgggctggctgacaatgactcttttcttggccagtgtggctaaagagtaataccaccttcctgatgacaaagaaacagaaactaatagcagggcatactcatggttagttggacataattgtgtagaatgaattttatacagttttcattacagaatgtggggtgtagtaattctctgcaaattctttgttcattacataaaatcctgggttgaaacagccctctagatactattatgcaggggggccagaactgactacgtcttatttgacttttaaagtcaagtttctggtggacaagccaaataaacagccccacttaagagaattcaatcctaaagaagtttatttttgtctgggtgtgctacgtattatactagagccaattacaaatgtttaaaatagctaaacttttaaaaatgtgtttgatgcttttatatgcaaaagtgttttcaaaaacaataatagtgtcaataaacagagtatcggatttgacaaggtggattgttaagtggttgcaaactgttcccacaagacgctgatgagtgcatccctctggcctggagggcatggaatcaggccatcatttctagccacggtaactaaacttacttcttgtcataaatatctcagacttcaggcattcaagtctaagtccatgatttagatgaagatatttaagacatgtttatcaaacctgcagctgctacgaagctcagaggaagggataagagctcttataatcttggccatggtagttaatccagcagactctccatttcttcatctataaagtgtgacaatgatttcgattttgtagggttattgtaaagaattaatgagccaaggtatataaagtgaaccagtaaagttagttatcttcttttacacaaagaatagcagaatcaggatttgttaaaaaaaaaaaaaaaatcacaaaaactcaagttggaaaaatgggctaaagctaataattgtatcaataaaaaagggaaacccagcatgtagctttaaaaaaacaaaacaaaacaaaactctgtggaaggatctacaaaaacaacgacacatgaataaaacaagtaagttgtttaaaaaaacaccaaaacaccaaaaaaaaaaacctttgagtaatgtcaccaaatcgtgttcttccaaaatataataacgccatttgtagactcttaagacttgttatatataatcaatcagtcctactgattaaaggaaggttgcatgttttacaaccttagggcagagattcctggtggactgacgttaggaatgcgtaaacaacattgtcaccaatgtattccactgagttctattttataattacttatttaaaataatttgagttgctctcatagtaaacctgcatttaagcaacaaaattactgaatacccacagaatggggagatttgacttggtagtgttcctggcatggagttctagaagttctcagtggccacaagctcagcaggagacaactgctgtgaagccattgaagtcttcacctcaactacactagtcctagggccagagagccaaacgctgacctccccctctccccaagtcataagacaactctctttttcctttactacaaattatgaaaatagctacttgatatcaaggtcacaactaatttcattttattcaacttaatctcttgaaaaatgattggttttttaaaaagatacattttgcattgcatacctccccaaagcaggagtattgcagtactagagatggaatcaaccatgcttcagctacccctggttagtggcttcaggctatagcctagggcctggctttgggctccagagctttctggataataaggtggctccagtttccaatgttccctcatggtgcctgttggtggcctaaaattctgtgatttcttttaaaacaacaaaagtcaagctatgaagagagtgaggaatgaatctgccaggccagcattgctcttcaagataatggaataatcggaagacagaaccagactggaaaccttgggcctcgtcttaagctcttatcttgggcaaatctcttaagtcattgagacttgttgaggggctgccatcagatcacctttaaagtcttctctagttctgaaattctatcagctgccaactgccttggcacacaggcaacattggcctttatgaatctgtggacaccacttgcctctcaaaactgccagaaatgagttaaaaagcatgaatgttcaagactcacagggctggcagagaagctctacagcttctaaaaatacttcttctctttcttcattatctgattcacaggacctaatttaatggtgaaattccggaatggcgtgccgaaacctctgactgtgacatgaaagatggtcatcttgcacctgggattcagttatgaatggcttgccgtatgtgcaagcactctgtcatttgcctccagctgtttattcgtcacactggggcacaggagaggtgctaggagcaaaccaacagcaaaataaaaacattaatttatgcaaagctttctagacacaactgctgttgctgagaaacaattaccactacaaacctggtgttttaggttgaaccatatgaactggccaatttcacgtatgaactggccaatttcacaggtcaacaatggtgactgtcaacagtttcatatggttaaatacacacaaagccccccagtggctggggaaagtggtattctacaggtttttctctgagtgcaatgatggtgggaagaagatggacgacaactcaaatgcaaaccccagccacgtggaggctaaaaagttattatgtaacaaaacgacattatagaaatgccttctggaactactagaattaggtgggaattcttaaggaaaggaaaatcattatttctagagttaacaaaagctggaaggaaaatgacaaacacacaaacctatcagcttaagaaaatttctaaaatttgatgtgcctgattttgaagccaacagaagagggaacagagagatgcagagaaacaatgtcctattggatcctttgagccctggatccaaccaggcttgaggccagatatccctggactttccagttacgtaagtcagtattttttttttttttttttgagacagagtctctctctgtcgcccaggctggagtggagtggcacaatctcggctcactgcaacctccgcctcccgggttcaaggattctcctgcctcagacttccaagcagctgggaccacaggcgcccaccaccacactcgggtaatttttgtatttttagtagagacagggtttcaacatattggccaggctggtcttgaactcctgtccttgtgatctgcccatctcggcctcccaaagtgttgggattacaggcgtgaggcaccgcgcccagctgagtcagtatctttcttattaaagcacatactcatgcatacacacacaatagcactcactgccgtggtctggatgttctcccaaattaatgtgttaaaacttaattcccggccgggcgcagtggcactttgggaggccaaggcaggcggatcacgaagtcaggagatccagaccatcctggctaatgtggtgaaaccccatctctactaaaaatacgggcgcctgtagtcccagctactcgggaggctgaggcaggagaatggcatggacctgggaggcggagcttgcattgagctgagattgcaccactgcactccagcctgggtgacaaagcgagactccgtctcaaaacaaaaacaaaaacaaaaaaacttaattcccactgtagtggtagtaagagtggggcctttgggaactgattaagccatgagggctctgctcttataaatgaattagtaccttataaaagagctagagggaactaacttaggccccttttttgcccttttgcattctgccacgtgaggacacagagttcatcccctctggaggccacagcaacaaggaaccatcttgaagttggagcgagcagccctcaccaggcgctgaacctgccagtgcctggatcttggtgtctcagcctctccaactgtgctgagtaactttctgttgtttataaattacccagtctgtggtattttgttgtggcagcacaaagatacccaccacatacacaaaagcttatgatgctggaccaacccatctcaaaatgttgaactgaatcacaacaagcaagacccatttcatatcaaaacttcaaaaaagctttggcttctagtctgattcacaagtacatgcgttcaaggcccaagcagttaaaaccctgcacagataaattgtaagagcctgggtaaaagaaaatagaatttcctggtaagtgagaatgaaaaaaaaaaaaaaagtttaccacatgtgtagatttaaccagtacgttactaatgcagagaagggaagaatcaggctatttcataatcaaatgttgataatataagagaggggcaagtttattatgtcctcatcagaagcaagaagctggatgtcaggtatactgtgaaaaattgcacaagccaagacctaagactggattaaaattatcaaattgttattagatgaaagttactagaatattgtcagattatcctaaccataagagtagcagaacagtactcaatgtttctaatcagttttgtctattttctgagctggttaaacatttgctgatgtgcaatttgtaaagtcacagccatctgttcatttgtgtcttaagtcttcctgcataaattctgctcttttacctgttttggggaaataaaagtttattttaatttactgccaaaatttgtggcacaggaaagggataggttgaaaccaaaaactattttgcttttttaccatctattagtcatcctttgaaaaatcaatattcagtgctcaccccgtctgtggctccaggcaatcaaaagaaaattgtgtactgtccccattcagactgatgatgcattgtgccattatcctgtgagctaatatgagattcagtatctgctgtcttacctgacaaataagccttcagaatccaggcttgggcacattatttgaagaatctgcagctttaatataatttatattcccaagttccttctactgcttcagtatatgcagcatatgacttgagatagaaggataaagaaaccagaatgattctcttctttcctaccccatcatctgatcaattctggacattcctttcaaccctgtggccatctattacaagttgagtgcctactatgtgtcagagaatatgttagctgctgggaagacagttatgaagaagacggggtctttccagttgttcaactttttttgctactcataaagaggataaaagaaagagaaagaagagaaagaattccagtctgttaggaaatattataaaattactccaaagtggggatgcagaattaaaatataccagaagtaaaaaagagaaatgctgatgttctatttcatgatcaataataaaaacagtaacagcttatatttgttgaatgcttattttttgccatccatattgctaggatttgtcttacttaatccttatcacaacgctgtgaggtaggtactgtaaataaatccattttagaaatgggaaaactgaggctcagggaagttaaattccatgtctacaataaaatatctcaaagcaatggagttgccgcagaaacctacctgcctccgatacctgaacccttccttgctatgctatattgcaggaacttggccctaaactgacaccttgccaacttgggatacgtgttatttctaaagatgaactttcaaagtgggttaaaagagggagaaggccgggcgcggtggctcacgcctgtaatcccagcactttgggaggccgaggcgggtggatcatgaggtcaggagatggagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagatcgcgccactgcagtccgcaatccggcctgggcgacagagcgagactccgtctcaaaaaaaaaaaaaaaaaaaaaaaaaaaaagagggagaaaaatggtaagacatatcttcctaacagttagaaatgaacagagaaatgagtcaggattgaggacagggctgaaggtgtcttctgggaccagtcaagagtggggtgtggtcaggctgctgctgctcactcctcctcccacgcagcacccacaggctgcatggtgcaactgggaggcttgctggaaaatggcaagtcctgctgcaggcgggctacagtgggcagccctcacctccactcctggccaaactgaccagggccactctccttacacagagaccatgctgctgaccaggtctctctggggccatcagcctcaggtcagcaaaaggtcttacaaaagtcaagaaattgcttatgattacagctctgcaatgcaaacgcgtttttaccaacaaagaaaaaaaaaaggttggagaggaagaagaagagagaaaaagaaacatttggccaaggccagaaagggtccaccgaagtcagcctccgaacttccggtccaatgttgacaccttgttcactggtgacaactcaggactgtaccccaaattacacaatgctacttgagggaagcaggcctggcagcagagagagaattaccggcacacattagtgagagcaatcgcagccaactcaaaaccgcactcgaaaacggccttgcattcatggactggtagttacttcctggtttctaagaaaccaaataaaattaaaactcaccattaataacaaaacaacactttacagtccccccttccctttcagagacgcatcaagtgacggcacctgatcaaagctgaattattaaaagtctatagattaatcctgtaactctcaagagcccagagtttgtaatttcccagggaaaaaaaaaaaaaacaaaaaacaaaaaaacagaagcaatctacaccgtgaaaaatttaattgcactttaattaccagttaagctgaatagcatgagatatgggtgcctttaatttttaatagtcgttatgattccaagagaattttaaagggaaataatttaatctcttgagagtattctcctcttctgccactgccaaaatcaaaatgaggacagaaaaaaatgtaaagggcgattcaaattcttccagatcataacccaggacggcccccagcaataataaactggctgttcccaggcagctgcactgcacattttcatgatatgctaatatagaaatgggtttcctgcagttgagttctggtacattaagcagataaacgcccttggctggggtgtttcttttttaaaatcagatctaaagatggcatacttgtttctttgtctctcagagcctggcaccaatatgggcatgcatacccccacctacgtaacacacatacacaaacctgggcacccatatacacatactcttccacatgctgccatgatgccccaaaacatccttttgaaaggaaaaagggaagagggtaacacaatcacacaaggctccaacaaaaatggaaatcagcaggtctgagaattcaaaaggaaataagcgtagcctccactttcactttatctgagaaccacctgactcaggaaggagctggcctcttgagagctggtgcaggagggagccgcctggaccgggtgaggctggccactttcccctttctcaagcacacactggccttctcaacttgctgaggctcttgaggtttgcctgttgtgcaggtgtagttgtctccattgaggctgcagtgtgcctcagcctcttcttggggatgctgtcccatcccaggacagtgcttttttttggaaataaattaggttgtgatttcttttttttttagtttttatttgtgagacagagtctcattttgttgcccaggctggagtgcaatggcacgatctcagctcattggaaccactacctcctgggttcaagcgattctcgtgcctcagcctcccgaacagctgagattacaggcatgcaccaccacacctggctaatgtttgtatttttagaagagatggggtttcaccatgttggccaggctggtcttggactcctgacctccgcccgcctcggcctcccaaagtgctgggattacaggcgtgagccactgctcctggccggttgtgattttaagaagtcagactgggctcaaaaggcttttcatgaggtctccaaataactcagggctctgtactgcctctggttcctgctgctcactactatcaaacacataacaagtatgggccttgttattagtgatcatttggtaaatcaattacaatttcatctgtcaggcaaataagagaagaaaaaacctgcagaaccatctgccacttttctcttctccaactgtgcacccatttcctttctccaaccctctgtatgaaacctgcactgacagacagtgctatgccaggctttcggggatttgtctgtgtctccctcagggaccaatagcacccacctcagttgggacccacagagaaagcaggagaggcgctttcttcccaagcccagtgagttcaaaaggaggaaggagtagagttctaactttgtgaaccaaagaagtgcccctccctgagaaccctgctgttgttcctttgtgtggcagctggtcatacagacaaaaacactcaggtgagagagaacaaggagtgcaacgtcaggaaggcattgtttagattcccaagtaaaggctgaaagcttggcgtggttaggaggcaagacgcagaaaacatcctagtgcgggcacaattgtgcctgaccaggacaaaaaggggacaatgaaaagaggatcctggccaggccagcacagaggagcttcccagggccacactgctcagggacaattccctagtgagacagaactgcagactggtggcagaagtttctctgtattatccttgacaacttattattgtaaagatttggaattagctgtactgagtcttcatcatagatgacaggttctctctcattgtcattttcacaaagtcccaagataaagagaccctccaggtagctgaaatgcaggtacccaatttaccactggagccaagattttggtttcagaggggacaaacgaggtaagtagtactcattgggtaccatccatttcaccaccagaaaccaatttcaccaagtttaacagttcttcctgctgcctgggcaggaggcggccttgtctctttccgcagtactctgggagtctaccacaaggcagcagagccttcgagttagagcagctctttggaacaaacatcacctctcttgctaggtgaggcctctcacccaacaggctgggagaggctgtcacagaactcagaactaagagcctacaactcattctgcagctcaagtatgagacaggctcactgtacagcaatttgtactggtgatccctcccctggggatgacccccatgactctggcgccctgaggcagggcacctgtttcagaatcccccgctaatcctccttactcccttcccagaactctaagcatccttgtacagatggcattggtactggcaagactgtggtctgtgagtagtcaggaagccagtcgacagcacctactctgttattcacccaaagcctctgtctccactgcagccacggagttgaaggctggtgggggcagggtttggggagtgattcaagaactgatcatccctctgacctgcgctatggacctgagcagcagtttcaggtgtgaggagcgtggaaaagggaaagcctcttagagcttatgtgtctagcctgggtaagccccaggaccagcatcagaattctgtaatttgaatgagaactgagctgagaactgcagagaaagacgcacttttcaaagaattccccaacagcaaattgaaatatgggcacgatgctgaaaagagatgaggctgccaaagccacgtggccgagcagacggagggagtgcagtctccacactgaggctgactgaaaacataaataactaggcaagatttttcagtagctagtgaggttatcacatactctggacaaaatccctagtgctcattacacttctgatatgattttctcacctctctccaggctcactgatgcatcttccaattcaacatggcttcttgcctctgaaaggagagctagtccctcctggaatttgtaagtgtgaaggctgtgtttcagctgtcacgtctggtgtatcactgatgcctattcctgtggcctttccagtttcccagggtgatgcaaatgaacaccgtgcagcaggtaaacagagcgctgaagtgcaaagtacagctcttatttatagatcaaacacctgccatcaatttaaacagtagttatctctaacttgaaagtttagcaagatactgaatgcccccttgaagcaaataattttgaagcagttcaggtatacagatgtgtttccagcctacttaagaatgctataattatcatcaaaaagacagattccattaactatctgttatgctttctgtatgtgtactcccagacagatttgaaatgttgaaagtcttgggtttcttagcactatacttttaacattatttttttaaaggactgggcttaggatcttctgaatttggaaaaacatctgatgagaggtttttggaacagttaatgatctaatgtggccgttcttgtcattttgcctttacaaccacagttccatttccaccctctctctaccagacacataaaaatttcatatttggaaaaagctatcttcctaaacacagatcagtgaggagtgaacacatctctaatcacaaatggccaataaccactatttcttgaaagttaaaaatcaggtgatgtgctgtacaggtgctctatggatactgttccattaatctttttgatgaattcttgaaaggttatcttcattttactgatgatataaactgaggctctgaaaggttaagcatgctgcctgaaatcacccacctagtaaatggaagaatttacatttgaacatgggtctgtgtccactccgaagcccgttcttcctactgcatacaacacactagcacagaagatggtcctctttctttgcttagattgtttcaaaattgattttccattttcagggatatggaatgtcattctggaagtaggtgataattatgttcggtggcttgagattggcatgatctccgggatacgagtctgcaggccacatcagccagtcacgtgtgtgggcaactcactttacctcggtggacctttttctctcccagaaaaccataaggatggattgaaggactaaagtccaacagttaaaactgttccttttaattctaaaatcctctgagtgtatgaactgcttcacctttgcatagaggacaagcttgtgctcaggagggcctgaattatttcagttccctgaatgtgctggccctcctcatgcaggagctgccccagggtttgtaaaccttcccctactaccaggcaccaccactgctatctgatggccgcacaaaggaatgagtgaacaccgtcaggaagacattggtcctgtgctctacgagagggtgtgcccaaccaccactgtcctctcagcatcctccattgtgaccaacgtcaccagggctgcccgaggaaaccctaagagagggaggggtattttccgtgaaaacacacctggatgcaggtctaggaaaccaacccctggtcagagtagcccaagagagaacaggcccatgcccagtgctttggtaagaatgacaaattcttacttctaaacaacagttccaaaaaaaaaaaaaaagagaaagagcgagcgagagagacagagaaactcactcagtagcaggaactgagaagaaaggggtcactcactcactcagagtgggctgggagggaaggcttcatcatttatcaggatatagtcatgaatacctctttttcttctttggaaaaatacagactactgtgggtgagtaaatctcatctagtgggcaagccggagtttgatttgagcaaagaatagaggggtagttggggtgaggaggtgaggaggagaggaaggcatggagccatggtcatgagacagcttctttttttttttttttttttttttttttgagacggagtctcgctctgttgcccaggctggagtgcagtggcgcgatctcagctcattgtaacctccgcctcccaggttcaagtgattctcctgcctcagcctcccaagtagctgggactacaggcgcccgccaccacgcccggctaatttttgtatttttaggagagacggcgtttcactatgttggccagcctggtctcgaactcctgactttgggatccacctgcctgggtctctcaaagtgctgggattacaggcatgagccaccgcaccaggcctagacagcttctttcatttgaaaatgttctcttagataaaatgtataagggtcaacatgcagcacacaagcaaacctccttcccccaggtgcaagcacagcagctggcctgaagataagagttaaatgaatccagccccctgaaaggaaggttgtctatgctacagaatcaaatcaggaagaaaggaagctattctctcacctaagggcattgagaaaggtacatgaatagtaattatctaaaaagagataatcaacaaggagtcagaagggcaaaaccctgtctaactaatctacttcacctttacagcaaggctgaagactaggtgggcaacagcgctgcatgtcaaagggtttactgtgatttcacaaagctccatagaaagcctccaaatgaagactggcaggctgggaaagtctctgaaaccatgaagaaaagggactagtggaggagctgccctcaagagaaaggcaagatgttgagtttagatggcctcagaatattaagcacctaacctgctctgtcatttaggttaattcatggagccctatatatatatatatatatatatatatatatatatatatatatacagatgaatcactggcatgagatcagctaaaatattcattgtagttgcttttaggtgattgtagatttcttcattgtttcaccttttccgtatatttttaaatgacagcaaaattttataataaagtttttataataaatttatttttataataaagaaaaataaacagaaggcaaattgatatcctcacataatgtgggagctacaaaagggatcctaagtcaaagttagtgcccttcctgtctagcctgggaggaaaacgtgactattaaattaattactgaatatgatgtgaactgcagttctgaggacaaggacctgcatttctggtctactcctgttttgaaggtaaacaatttaataatttcagtgtatagctacctccaattatccaaaccactgtcttcataggaatataagaaaattaaggtagatacctgaagcagcaccaggaatcaggacagatagagctcagttttttaaaagaagattctttcctggtcttcttcaactgggggcaaaaaaaaaataaaaacgaaaaaataaacaataaaaataaataaataaaataaaaagaatgctactgttacaccacatacttgttttaaagtcttgcccttctagtactgactacacgcggccccagggacctgtgaaatggatgctgctgcaagattttatttaaacaacatcttgatcttctgtgccatgtgactggcattgcggagaagctgctctttctaaaggcttcaaggtcacttaagcttgtgccggctctgctaagagctccgatgaggaataaactttaagatcttctactagacagaattttggaattcccagcagacctgtttcccttggcttccagatcctctcaaatgaccttatcccttatcccaccatgcacacacacacacgcacgcacacacgcacacacatgcacgcacacacacgcaagcacacacacacgcacgcacacacgcatgcacacacacacactctatcttcactgaaggctcccaagacatcttcctcacaaaacacacaaaacaaagacagctgtccattggtgctcaaaataaatgaagggtaaactaagcccacagacaccatgaggtgaggtgatatcagaaagccagagcaggacaatggtcttgatccatccgctaaatctttaggtacaacctccaaggaaaatgactttcagtcaagccaggcaactattgctaccaacaataaaacagaagatgcttttacactcatggccccagcattgtttctcacaactaaaagaggccaaacatcccaaccagaaaaaaacacaaacacacacaggaagcaactgttaacaaatggaacgtgatagtggcagagcccagaagagctgttggttaactcaacacgaaggagtccttgcctctcattcaggggtgcacacagacatgaccctaccatgcttttccttccatcccaatctccatggtcatctagtccaagctgtacgctctagtttttctcaaagtggagcttatgggtaacctccatcagaatagctggggagctaatgacacatggatcccagatcaaccaaggggattttagagacatggggcctagcccccaagtgactctgatgcatattaagacttgagcatcacaggtcaagaagtacacagatcccagttatcaacatagccagatggctggtggtagaagcaaccctgtccctgtagcacctctctgtgtcctgctcaaaagcattaaaacatcattcttagataagaacagagacaaaggatatgtctttaacactttacagtctataaagtttttccacagccactgtctcactgaatcaacccctaagagacagaaatgaaaatcgctgtttttacaaactgagaaattacgggcctttgaagtgtttcacagccttcacagcctgctggtaagaagcagagatcaggccttggacctgggtcttgtgattccaaagcccatgatccttcggattcatcaaagctccactccaagtgcctactgggactgccttgcagcactcaccttctgtaggtgagtaggtaagttgcggcatgccattctttcaaaagaacagtgcacctctgtgaccgaatatgggccacagtatctcaaggatattttggtcaaagccctggggtgtggggcagaagataatgtattcaatgaagcttctagagaaaagcataataaataaagaagctcctacctgtcgctagccttcctaaatatcccaagaaatcaagaattttctcccaatggattacagctgagcatctactcagaagagaaaatcaagtccatttcagtttagacggcagcagcaaactccccacagagagtactcccggggtggctagggggtggacagtgccattactgtatcaatcaggccaaggagtggggcttgcactactgtttgctagaatggagcttggctctaaaacaggattctcagacacatttcagaataggacgactggaacaatgcaatactcatctaagcaactgcaaaagccagctacaacccaactcaaggtgccatctattatgagaggtccccttcatctatgtaaaaaaaaaaaaaaaaaaaaaagaggagccaagatggccgaataggaacagctccagtctacagctcccagcgtgagtgacatagaagacggtgatttctgcatttccatctgaggtaccgggttcatctcactagggagtgccagacagtgggcacaggtcagtgggtgcgcgcaccgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcgcttttcggaccggcctaaaaaacggcgcaccacgagattatatcccgcatctggctcggagggtcctacccgacggagtctcgctgattgccagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaacacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagccctgcagctgagggtcctgcctgttagaaggaaaactaacaaacagaaagcacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgatgacctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagccgatgtgatcaactggaagaaagggtatcagtgatggaagatgaaatgaatgaaatgaagtgagaagggaagtttagagaaaaaagaataaaaagaaatgagcaacgcctccaagaaatatgggactatgtgaaaagaccaaatctacgtctgattggtgtacctgaaagtgatggggagaatggaaacaagttggaaagcactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaagatcgggttaccctcaaagggaagcccatcagactaacagcggatctctcagcagaaaccctacaagccagaagagagtggggagcaatattcaacattcttaaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatcgaaaggaacaaccggtaccagccactgcaaaatcatgccaaaatgtaaagaccattgagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtgctgtattcaggaaacccatctcacgagcagagacacacataggctcaaaataaaaggatggaggaagatctaccaagcaaatggaaaacaaaaaaaaggcaggggttgcaatcctagtctgataaaacagactttaaaccaacaaagatcaaaagagacaaagaaggccattacataatggtaaagggatgaattcaacaagaagagctaactatcctaaatatatatgcatccaatacaggagcacccagattcataaagcaagtcctgagtgacctgcaaagagacttagactcccacacattaataatgggagactttaacaccccactgtcaacatcagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgatcacatagttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactggatacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacaaatccagcagcacatcaaaaagcttatccaccatgatcaagtgggtttcatccctgggatgcaaggctggttcaatatacgcaaatcaataaatgtaatccagcatataaacagagccaaagacaaaaaccaaatgactatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacaagtcaaattgtccctgtttgcagacgacatgattgtatatctagaaaaccccatcgtctgagcccaaaatctccttaagctgataagcaacttcagcaaagtctcagggtacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgcctttcttcacagaattggaaaaaaactactttaaagttcatatggaaccaaaaaagagcctgcatctccaagtcaatcctaagccaaaagaacaaagctggaggcatcatgctacctgacttcaaactatactacaaggctacagtaaccaaaacagcatggtactggtaccaaaacagagatatagatcaatggaacagaacagagtcctcagaaataacgccacatatctacaactatctgatctttgacaaacctgacaaaagaagcaatggggaaaggattccctatttaataaatggtgctgcgaaaactggctagccatatgtagaaagctgaaactggatccctttcttacaccttatagaaaaatcaattcaagattgattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaacaccatcaaaaagtgggcaaaggacatgaacagacacttctcaaaagaagacatttatgcagccaaaagacacatgaaaacatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctcgaactagaaataccatttgacccagtcatgccattactgggtatatacccaaaggattataaatcatgctgctataaagacacatgcacacgtatgtttattgcggcattattcacaatagcaaagacttggaaccaacccaaatgtccaacaatgatagatcggattaagaaaatgtggcacatatacaccatggaatactatgcagccatacaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtagggggaggggggagggatagcactgggagatatacctaatgctagatgacgagttagtgggtgcagcacaccagcatggcacatgtatacatatgtaactaacctgcacaatgtgcacatgtaccctaaaacttaaagtataataataaaagaaaaaaaaaaaaagccaccgccagcatgcctctagttgctgcctcagtctgaggagctcggctgttttactgctgacaccatcttatggtatcctttgcacgatgctaacttcctccgctgagggtgaagcctcacttaccattctctgcagcaatcccaccaacctctcatccagtgactctagtggggccctttcactgggcccactttgtacttggctctccatagttcctcttaactccgtgatcaaaagacatttttacatgtgttataagcctcttttaaaaaaatcttcctaggaaagactctcttcaaatctctactagaacagggctgcatccaagtgagtccttaataaatagaatttgatcatggtaagaagacatgtcccctgctcgtgttcttgtcagtcctgaatgggtgaggcaaagtgctcagacactgtgctagcaaagggattttcagtctctgcctccctaattatgacattctttttctgcctcccacaggcacaagggccctgacgagggagtgctcagttctttggtgtgaaatatagtaagatagaggccattggcttcagaggaatagagctggataaaaaagtacaaaaggaatgtgaccagtaacaggaatggcatttagaggacctgattcatctcttctacattgttcaggacgattgcaaaatccatttctccttctctgtccctgcttctctgcccttcccccaagctttcttgctctctgccacacgtgcgtgtgcacacacacacgcgcgctcgtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatttcctgggccaaatgcattgttcaggcaaagctcccattcatgtcaacagtctcagcaggatttaccaaattcagccatatggacaatattcacagatactcattcaagaagctctcacagttccaacttccaccttgttgactctctctcatctgtttttcccacaagtcgttcaattcagttgttgggcaaccgttcagggaagcctttaagtagagatttctgctctctcattgggcagaagagaggacaggcaaaacagtgagaccgccaaatgaggaaagaaaattggaagcacttctctgatttagtaccaaacttgctccaggataaaactgcactataccaaaaactctggcagggtatcaggtactatggggtgggcaaagttcccaggttttacttccagagctgactgcaccagggagacccacgtgctcccgaaggcaccgcacgcagggcagggcatggccagaatgacagcagatgtcagctctggactcttaaggacccaaaggtccagggtcacattttttgttacataccagcttcctcccctactcacgactggagagttgtggcttctgcccccttcagtcacagctacttggggtgtctgaaagcatcagggccatgccatctagcaatcttccccaaagtagggaaacagcggtaccctgcacaagcttggcatagaggtgttccctcaaaattatctttgcacacagttggaggatgaccaaaatataggttgccatttaggcaaatgacacgaaggaagagatgctttgtagctaagtatcttttccatactgggcacccactaaaggttagctgtatacatgaatggatcgatgattggatgaaacgacacatgaaaggaaggcattgttttctcaaccaagccaagtactaagtaatctttgaaaatgaaaactcaggccgggcgcagtggctcacgcctgtaatcccagcactttgggaggccaaggcgggtggatcacttgaggtcaggagttcgagaccagcctggccaacatggtgaaacccccaactctactaaaaatataaaaattagcagccaggcacgttggctcacgcctgtaatcccagcactttgggacgtcaaggcaggcggatcacctgaggttgggagttggagaccagcctgatcaacatggagaaaccctgtttctactaaaaatacaaaaattagccaggtgtggtggtgcatgcctgtagtcccagctacttgggcggctgaggcgggagaattgcttgaacccaggagatggaggttgcagtgggccgagatcgcaccattgcactccagcctgggcaacaagaacgaaactccgtctcaaaaaaaaaaaaacaaaaaaaaaaattagtcgggtgtggcggcgtgtacctgcaatcccagctactcaggaggctgaagcaggaaaattgcttgaacccgagaggcagaggttgcagtcagccgagatcgtgccactgcactccagcctgggcaacagaacaagactctgtctcaaaagaaaaaaaccaaaacaaaacaggaaaatgtaaactcgccaagagctcagcaggaatggacgtgttactctcagagtagaccccataacagccacccagacacgtgagaatgcagctttgccttaagacagacattaaaggaagaaattccaccacctctccctgtaatctttgccagcgtgtgtcagccatcactcttgggaagctttttccatctccctacgttctcttagatttggaaacccacaacggctcccaacaagctcctctagatggctccacaccttcggcttgtggtttaagtccctcttcagttgttcctgagtctcatatctagaggaaactactacgggggaagttactgggatgagattggcaagcggcccctccacctgggatgagattgacaggcggcccctctatctggcctgcttctctgtcttcaggctggaaaggggctcactaggtgggcggagggcttctgtgtcttcaggctggaaggggctcactaggcgggccgaggccatgcgtggccctccctgggcatcttgtccccctctctgttcagcttttaaaaatgcctttgtgggctttgttgtgggtagggctttctcctacctgttccatgagtctggaagcccctgtgagagaggaattgatgagcacagcaagaaacagaacttcactgagcatgctgaacatgtgtcattattctaaatacatttttctttaattcctatgacaatctgtgagacagatactaattattcctattttacatctacagaaatctaaagtttagaagaattaagtaacttgcccaaggtcactgcctgagtaatgacgtatctgggtctagaattgaagtcactctacgaaaactccacgtcattttctcctaaacgaccttcctatgaaggcaaagacctcctctgccttaatcatctatctctgctcctacatctagtacctagcatctgctttctatgttgtatttaattaaatatttgttaaataaaaatggaagaatatgcatcatgtatttgtgccactaggttttaaggtgtacagttcagtactattaagtatattcacactgttgtataacagtcatccagaactttttcatcttgcaaaactgaaactctatacccattgaacaattccccatttctcctccctccagtctctggcaaccacctttttacgttgaatttgcctgctttagatacttcatataactggaatcaaatagtgtttatctttttgtggctgacttcacttagcgtagtgtctgcaagcttcatccatgttgtagcatgtgacaggatttccttgtttttgttttgttttggtttttaaatagagaaggggtctcactatgttgcccaggctggtctcaaactcctgggctcaagcgatcctcctgcctcagcctcccaaagtgctaggattacagccatgagccgctgcatccagccaaaatttccttgtttattaaggctggaaacactacattttatttcccacgccaagtttcttaaatgacccatttcatcaagttgcttccttaaaactctctccttatattagttcgttttcacactgctatgaagaactgcctgagactgtgtaatttataagggaaaggggtttaattgactcacagttccgcatggctggggaggcctcaggaaacttaagatcacggcaaaggtgaaggcgaagtggaagcaaggcagcttcctcacagggcggcaggaaggagaatgaatgcaggaggaactaccaaacgcttacaaaaccatcagatctcaagagaactcactcactatcatgagaagagcatggagcaaactgcccccatgatccaactaccaccacccagtctcttccttgacacatggggattatggggattataattcaagatgagatttgggtggggacacaaaacctaaccatatcactcctttaattcagcttcactctcggaagagctttaatacaatgacagccaccgctgctacctgttgagcactcacactgcgctaacggagcctctcacacgttttcacagaaacttcagggttatgactgtgatctgtagatgagaaagttgaggcccagggagattaaacggcacgttcaaggccacactgcttccaagtgcagcaatctggacctctgaccttccccagctccctctgactctacagcctgttgtcagtcactaatctttactgccttccagtgagccttagagatgatcaacacaacagagagcgacactgaggcccagatacatgaggtgacacctgtggctgcgctgcccattagctacagagctggggtgatgcctcgaactcacgatgcctggcccagggctctctgctccattccacttgcctccggcccacgtgacctctcccccaatccacatcccatggtttcctcaagatgcagctcaaggctcacttcttccagacagtaaaatcctcccacacgcactcccggtatttcgcttctcctttgctctgctggctgaattcggttggacacacactctcatagcagcatcatgtcctactctatgatcttccaaggaggaaagtgtgttccccttcccatcccaccacctaagagtgtcctggaatttggcagggcacttgatgaatgctttttgactggctatgccataaatttatgcaatctaagagctgggtgggccctgccttatcacacttattttccaggtgagaaactgagacccagagatgtgaggtcactcatgtggttacagagctaattaatgaggagccgagtccagaacccagtcttctgtcttctaatctgtcctctcctgctgctgagcccatctaaccaggattctttatcattttgcagcacagagttgtgccctaaagcctgaagtgggcagacacgaggaaagaaaggttaaattctacatttagtcattttaaggagatatgaaagtactacctttttatttccatagggaaaaaaagatgaaaaggaatactgaacagaaagaaaggaataaaaagcaatgcaaattcctagtctttatccacatattaaataaagacactctgtccttctccctctgtcccctcccacctcaatattgcttgctccttaagacgggccagggaaaatgcaattctctccagagtaaagtgtgaaagactagagaggtgcattaacattttataacctcaaaattcttcaataaattaacattattaaaggatatctggttcttcagtaccttgaaaatgaaatgacaccttctagaaaatatagattcacctcatttgcaggtttgctgtattgttagagccatctacatgtccctttccaataaaaagaaaggaagtcatacacctctgaagcattttatagttaatgaaacacttgaacacattatttttttttgatgataggtcattatgtgcttattttttgacattttaaaagttttattgtatgtttaatagacaaataataattgtacaaatttatagggcatggtgtaatgtttgggtacatgtacacatttttatcccagtaagatgtaaatctttggagaaaacctgatgcagatagaagaggcttctgatacatattaggacatggatgtcagtttttctgatttttttttttttgagacagggtctcatgtcgcccaggctggagtgcagtggcatgatctcgggctcactgcaacctccgcttcccgggttcaagcatttcttgtgcctcagcctcccaagtaactgggattacaggcatgagcccccacgcccagctaatctttgtatttttagtagagatggggtttcgccatgttggccaggctggtctcgaactcctgaccccaggtgatctgcctgactcggcctcccaaagtgctggggttagaggcatgagccaccacgcccggccagtttttctgattctacttactaactcacacttacccaagagttgtcctcttcaccttcttagcctggcttttttttttttttttctgtactgccctccagaaggaagacaatcacttttttttttttaagataggtcaacagattttaatgtgagatagtatgaaaagttcacttatatggtttcagaacaccttataactaacctataagaagctaacttaattctagggattaaataatggaagtattgaatatttaatcaatcaacaagtatttattgggagcctattgtacactgggcactattctaggccctagggatataagattaaacacagcagggggagtttccattctcctgaggttccacactagggccctttcacggatgagacaacaggcaaattcaaattgaaaccacagtgagatactaccgcccatccactaaaatggctaaaatcaagaagacatgtaataacaagtggtagcaaagatatggagaggtactctccgtattactctcatatattactggtgggaatgtaaaattatgcacccactttggaaagcagtttggcagttcctcaaaatattaattgcatacttaccatatgatctggtaattccactctagatatacacttgaaaaaaattaaaatatatttctatataaaaacttgtgcacacatgttcacagcattattcttaatagctaaaaagtagaaagagcccaaatgtccatcacttgatagataaatatgcaacattcataaaatattacttggcaaaaaaagaaaatactgatacatgccacaacatgcatgaaccttgaaactatgctaagtgaaataagtcagccacaaaaaagcaaatattttataattccatttatataaactgtctagaataggcaaatctagataaatagcagattaatggttatctagggactggggggctggggagatggggtatgactaatgagtatggggtttctttgggggtgataaaaatgttctaaaattgattgtggtgatgattgcagaactctgtaaatatgctaaaagccactgagtagtacactttaaatgagtaattatatgttatatgaattacatgtcaaaaaagattgtacataacatagtatgaagatatactgagaactagtggaagatgatctcagcagtttgttctcatgctgctaataaagacatacctgagactgggtaatttttaaaggaaagaagtttaatggactcagttccacatggctggggaggcctcacaatcatggcggaaggcaaaggagaagcaaaggcacgtcctacatggcggcaggcaagggagcttgttgaggtgaactcccacttataaaaccattagatcttgtgaaacttattcacttccaggagaacagtatgggggaaactgcctccatgattcaattatctccacctggccctgcccttgacatgtggggattattataattcaaggtgagatttgggtggggacacaaccaaaccttatcagtgtgtgggtaggcaactggcctgggcaccatgttgctgtttttcttctgtaactctatagagaatacccctctggggaagtttctgggccaaaaattggtgacagatagtaatcaacagatattgctcagactactgtaggaagtagaaagcttagcgataacagattttcctggcaacacccacccactaataagatttacagtttgctagagtggcaccagctgtatgaagattcactaaaatctcacttgagataggcaacacctatctctaaaccagaagagacaggtatttctttcttcttcctctcctcatgtcacctcctaacctccacagtgcccatgttgagttttagaattggcatttagagcaagacatagattcttggtgggtggcctcttgccagctggtcctgcccccctcctcgctacagatcacaagtgttggcctggtttctctcaccacaaacagcagtatcaacaacctcatccaaacttcacgtacctctttaccaaactagagctaatcccaagtaaacagcatttggacttcagaaatccggttccacgtttgtgtgaatgacagattccccaatattttagcagggcctcaccctcagttattcttttccatgatgacagttctgtatcttactgagactaataaattactgtccttcacaacagaggtacacaaaaggcctcaaacgatgagctggctaaaatgtagctgctctgttaacaatgatggaatgctagccatgacatatgcatagcaagcaatttttcctcatcttcaccaatgggaaggagctagcatttggccaagacctttgataagtgccatgggtcctctcacaccctcagacatgaatatttcggggtaaaccaggtacctgggtaactttctcatgtgctattctgccacagcaggggcaactgcccttacagtcttgtcccagaagaaccactaacaacttgaagtttccatcagtgagaaacgcacctgccacacagaccactttctagcatcactcacacaaaggttgtcgatgtttggaccaagttcgccagagtattttttcatttggttgaagttgttttcaatgttttccagtgactggaggtcaagtctggagcagtggcttgtattaatagatcctttgtgagggcagccgctgaaacgacacttcaactcatcactgacaagggaacagaaaacacggccaagtcaggttttgtggccacccctcaaactggccctgaaaatggcactgattctggagatggccaaatgatttaagtgtgcatgcacgtgtgtgagggataatcttggttcctaatttgggcgttttgaattggaaactttgccggacattgcctaaatcaacggtcaaagagtacagtttgttttttctctgagtaacagatatcagtttcctaaagctcactgcctttcttggaggagggaggggaggcctttgccaactttgtctacctccacgctttttgggcttactttctaatgaatgggcaggtctggggcatcttttaccacattcagtccagaaaggatctgtctgtctcatctaacctaaagcctggctcaataatgcctggtcaagaggctgggtctcacccttcggggctcgtttatataatgagtgtctctgggttcagatcttctcaataaaagatgtctgcctagcacaatccttctgaaatttaatggctgcaaccctgacagccttcaggctgggaatttatccgacatcaaatgaacaggcagcaaacaggatggagcaatctttcccaaagtgtgttccatggaactccagggttccatgggcagttaagtttgggacaatgcattccacccctgtcttatttctaagattctaagacatcatcagttttaagctcctcatcgatttaatgttttttttgtttttttttttttgagagttgaggagaagacgacacctgattataagtaatatagttttgtttttaacacacagtaagagcctacatttatctagatgagcactcaggatttcttctttagtatctcagttacagtttgcatctaatcactctttgccatctgagtctaagggttcactgagtcacttttgaccattagaagttatatggaatcttagagggacaagttgcttttcataaacttatgatcttggtctcctttgtatccttagaataaacaacataatgttgaatcctgtaaagaaatattcaagtttcatgtgcctttttttataagcttattgtttcatattttccttaattgaataacgtgactgaaaggtattgactttgctaagtgtcagctggaagctcttgacagattcttggagatggagtgatagttcttcataatgggggaatcagcattccaagaactgtcaaaccaccttctccgcacagtgaagcttccacgatccattcctagacatttggcaatctctgttgcctttaattactgcccggaatatgtgacaaaaaaaaaaaaaaaacctgcttttataatgctgattcataacaatgtttttaaaatacacattttggaataattttagatttacagaaaagttgcaaagatagtagagtgttcctatacaccctttacccagtcctctgttgctaacatcttacattaccaaggaacatttgtcaaaactaagaagcaaatgttggtatgtgactattaactaaaccccaggctttacttagatttcacccgtgcatctacccacgtctcttttatgttctgttctgacaacaatgcattcagttgtcatgttgcctcagtctcctctgctctgtggcagtttctcaatcttttcttgacagtcttgaagcgtcctggccaaatgtactgtacaatgtactctgatctgtgtttctctcttgcttttctcaagactaaatggaggtatttttgtaaaaaatgccacagaagtaaagtacccttctcattacatcctatcacaggggacgtggcagccacatggcctcacttgtgaagctaacctgatcccttagttaaggtagtgtttgccaagtttttccactgcaaggtgtagcaaatgaagggatctaagttaaattcaactttggtggactccctattttaagaactcacctgaggtgccatcaaatgggcaagcatgtacaaagactggctaggtccctgcatcttgtgcaggcagggacaacctcagcgtcctggccagggccgggagctcattggcgtgagaagccagacacactcactctcagggtctcacccgcatgaatcttgcaccccatgcacctcatttaacttgctctatgcccatccccgcttctgacactgattccaaagtttactctaattttagaaacattgaagtataaaaacatgggctttttattttagaatcaagtgtactgtaaaggttctgggacatcctgcagtaaccttatttaacctacagtttcccaaactaatttgatcacagagtcctcttttcacttaaggccctttcttcacctgaacctatgaatagaggggaaggaacagggctgagccagctgaatctgctttgagtcccagctgcctgactgtggcaagcttcctcataaaggaatgctcttcagagcctctgacatcctcagtcacaattctgatgcatttaaatgcatttctttgacctctcatacacccctgggaaggctctgcttgcacgtctgtgagctatgcacggatatactgacagtcctatggaagtggctgacctttgtcacgatatccgggagtaaaaatggtccagacaggcaggtaagcatgcgaacactgagttccaaaatcgtatcagagctgcctgctcattggaccactgtgaatgaggatgggctcaccccagccccctactaacctttgcatcctttaactgccaggactcatacctgactctaatagaatgaacttctgttctctgatactacatcttaacgtcctctgaggaacactgtagtggcaggtgggtaagctgaaaatttaggaagcaaattataatagacatcctagccaacctcatttcacagttctgagcagccccagtggagcaatcttcctgttcggaggatcacggcaacacagggagtaatcaccatttcagcccgtacatgggaggccagaaagggagatcctagtgtcatttaggcccaggctctgccttggctattgacaaggtcttttagggtatggggttacatttttgtcccactaaatgacagcagcatttggtgggtaacatgcatacataagcgcatagggccatccatcaaatcaacaattcatatagtgagtctcttggggaagacattcccacgttataggaacatgggccttttccattatatgagaaagtgaacttacagatacataagggcaactattcctttcatttttaaaaatttgtcaccttttaccaaaagaagagtggcacggtagaaaatgcatgagacttggagttggatatgcttgggctcaaatcctagttcctggggcaggtttccttttttttttttttttgagagggagtcttgctctgtcaccaggctagagtgcaacagcgcaatcttggctcactgcaacctctgcctcccaggttcaagtgattctcctgcctcagcctcctgagtagctgggaccacagacttgcgccaccacacccagctaatttttgtatttttagtagagacggagtttcaccatgttggccaagatggtctcgatctcttgacctcgtgatctgcccacctcagcctcccaaagtgctgggattacaggcgtgagccaccgtgcccggcccctgaggcaggtttcttaatttctctgagcttcagttttctcatgggtaaaatggggataaaaatacatacttgacaaggatattatagagctcaaatgagacaatctgctgaaatatttttagcctggcacagagaaaattagtaacaaacatggaattccctttcactccaagctccctttacactagggactgtctcatggttgataccagatggcccggtctcgattctgcacaagcttggtactctaacaccccagttttaggaaggcctcaagaacaatctgcaggggcaggggacctttctaatgatcccacacactctctggactgtatgggatcattaggaaaaacaggtatcagcgccctgatgcaagtccttctgaacaatccagggtttagcaggaggccaaggtgtttgatcctctctggacattatcatggctggtcttccttctgttctccgtcgacgtgacttgttagcgttaacagtgcctgtgggcaggaattaagaggacagcgaaaacttgctttgctagttaatgctctctctgctctcagagagggtcgagagacaacaaaggctcattcctgccagaaccaagaacccccacctcaactcccaactcctaccaaacattagccacccatctgaccctcatagacgtctccaagatcgaaaaatatcctttggcaaaaacgaatcattggcaatttggttattttaactacttctgtggccaggagagaaggatgagagtttcagctggatataaacagaagcaggagcttgaagaggatgagagaaaatgaagccagtgctatgatacagtccaagacagcctggtttcagttgagctgaggagaaactgaagctgatttcaaacgagtctgaaaacccgcatccctgtgctcccctcgcatagccactggccttcccatcctccgtgcggtcctgaactgaccatgcactcacaatagcacattcagggctggccatagggagccgtcttcgtgcaaggcaagttcttgagagaggagtctgtgtttatgaaggttaattccaggctcagccaaaggccacctaaggcacaaatgctccgagtcggttggggtttgtgtgttccatccgctgctgggcacctctctaggatgcgtatttctagtcagtggaccgtcctaaacatgtgaagctgctgacagatgaaagctggccttgcttgtggcatccattcttcagggcttgtacctgctcttataaggaagtagaactcagagagcactcactggcagcaggggactggtcctacactcacagcaatgtcccgactcggtttcagtgatggcttcaatgtctcattttgtgtcaccagtgttgatgaaaccttgacaaggcaaagcaaaacgacaagcacgccctgagcagagccccgggaattcaacctttaagtggataacttggcttctggtttgccaaggaaccagggcatcaaacagatgaaacagcctattgtccatttcaacaggatttttcaggagtggggatgatctttcaaattatccacaacttaattatttaatattttgatagtcaattacctaagacacggcatcgtcactgaccaatcagaagagatgccagtagttgggcgcagtggcagcactttgggaggctgagtggacagatcacctgaggtcaggagttcgagaccagcctggcctacatggtgaaaccccatctctactaaaaatacaaaaatgagccaggcatggtgggcacctgtaatcccagctacttgacagagtgagcctctgtctcaaaaaaaaaaaaaagaagaagaagaagaaggagaggaagaagatgaagaagagatggcagccacagctgggagacgggtcctagaaatcccccgtagtgcagggcatcctccctgtttgcttcttggattctgggaaagtcctcggtggcaagcctgagaggctgggcaaaggggctagagcagtggctattgacctccagggaagaggcattctatggcctgaacaagcagcaggcagcaccaggtctgggtgattctctgtcctgcagtcgtgggagatgagggcacgtacacgagggaagaagcacagaaaagaagcctctgcaaccttcgcattttttatcacactgtgttagtacccaggagactttagccttcccaaatctcactggatcaataacttcaggaaaaagaatttccaggagccaatttccacattagtttaggtgccgggaggtctttggaaactcagcccgagacacccggagacttctagtccacccccggggaattcagttcaatcctctgaaacactcagactatctcctctaggcaccgccagctcaggtttctactcagaacacatacatttgtgtctggggaaaggcaaggcatgaaatatacttcactgaaaggttgaaaagcatggagggtaaagttaattttcaaagaagaaaggaagtcaacggcataacacaatggaatgtgtgattcacctctgcagggcagacattgattttcccaccagggagtatcatcgaattagttggcagttgaaaatatgatctctgacttttttttccattccccttaggtcctacattttattttaaggccatgaaacaacatgagattaaaagtgtcatccagaaacagaagtggaaaagatgcagtatttcttttgttcaaagaaaatatttttgaagttatttcacaactaaaattgcaatgacaggtgtgtgggtggggtgcatgggctctcctcgcttggttcatattggacagaggggaagcctgtgggcttagggggcacagacccctcccatgaagagtcagcatcagggctgctctgggtgtaacccaggtcctgcaccgtttccagtggctggtgtcctgggaataggcatcagttggaagccacaccttcaccctgcgggggatgaggagggctaatggtgggagaaatcattcaggtaagaaatgttctcccacctcctagatgtgtggctttgggtgaggtgctcaactctctgagccacagctttcagagctctaaatggggactcataatttctgctatatctagatacatgtaggtctaggtttaggtgttctgatgcctaacattttgtataccttctttaagaatgccaagttgacaaatgcagaaatgggaacagagttttcaaaggggctcctgcaagtggaaggccctacagtttaagtctcgttagtgtcatggtgaatctaactttgcacacctgcctatctcaaataagaggtacgtatataaatgtacatctcaaactataattatataaatacatgatgttgaattactctataaatctgtaatacttaatgtatgctatgtgaggtgcaggaaataaagctgtgcaggagacatacaatcccacccgtatgaaacctaaaatctagaggcgttgcattatcatctatgggaggacatctattcagaatgtcctctgaatcctgaacttggaagtgaggcagatcacagtggaatggcttgattgctcgtctgcagcactagcccctctcagggctctctgaggtcctgatgccacacctggctttctgggcggtgagctctgcttgacctctgtctctgccctctccttgccaatcactgccttctcactcactctcattttgaaaccctcacagcaccaggccagcctttttattttattttaatttttattattttgagacattctcgctctttcgcccaggccggactgcagtggtgctatctcagctcactgcaagctccgcctcccgggttcacgccattctcctgcctcagcctcccacgtagctgggactacaggtgcctgccacagcgcccagctaagtttttgtatttttagtagagacggggtttcaccgtgttagccaggatggtctcgatctcctgacctcgtgatccgcccacctcggcctcccaaagtgctgggattacaggcatgagccactgtgcccagcccaggccagcctttctaacctttattttcaaacaggaatggatagcggtttcctggggaggcgggggcgacagtaagagaatgagggggtgacagccaaggagcatagttttctgggggagggtaattaaaatgttccgaaattgattgtgatgatggatacgcaactatgtgactacagtaaaacccagtgatttgtgtactttcagtgggtcagttatgtggtatatgaatgatagctcaataaagttgttaaaaatatgaacggacaaccaagaagcatctaaaattcaagaaaagcttggagcaagagaaagcagaattaataagcagggggaaaaatgaagaacactcagttcattcagaaaaaaaaaacaattttttaaatgaccaattatcctttgagagactcaagaagatgctgcatccacaaaataagaatagggagccatgaaaaaggaactatccaaaaacaagaaagagttcttgtgaattattaaaacaataagtttcctaagagataaaattttgattaaatgtctgcacaatgaagtcagggataatccctagagcataaagcaaaaggcccagacactagaaaaagagaagtttaacatgtgataaccagcactttcagagtgaaagaacagaaaaacagaggaaataaaattaaaaaggaaaaaatagggaaaacttttcccagagctaaaggaagacaagaatgtttaaaataaaagggtcttgtaggaatgaaaaagatacccatgccgaatacatcagtgtgaactttcagaacatcaaagagcagagcagagcctaaaaccttacagaaaagataaaacgggtgattgacaaaggatccagaagccaagaagcatcagaaataacagatcttacgagaccgtgtaataggcttttgaaattttcattgaaaattattttgaatggagaattttatattctaattctccaccaagaacaagagtactaaatctcaatctaatagtgggaaatcaagagatactgcctgaagttgatggaacaagaaatagaaatttcaatatagtgtttgaggtgtcacaggttgccaataaaagaattaaagtactattaccttcatggaaaaagagatgtagaatagagaaaagaacataataaaagctagatctttatttttcatacctaggaatggaccacttcttcagttgtaagaaacttaaatctaaaaatactacatagaggtaataaatataactctgagaagtattgaaaacagacatggttaaaaaaaaaaaacaaagttgcagctaaggagcaggtctgaaaggaaaagggagggatcccagggggagaagaaacccactgctttttattttaaaaatgagatataaggccaaactttttttttcaactaattaacgggacttttaaatacagatcctagaagcagtgcagagagccaaggcttggcatttgggtagctgcgcacttccaaactatactgcatgaaagcatttcacagaccgtgagttgtccagttacttaactttgggagatactgtcattcttgatgtcccttttacagattcaaaacatacattaagttattaaaagctctgagaagttctgtagaatataaaccattttgacttcatttaaatacaggtcaatttgctgaaagaccaatttgatgaactgttaatttgccgatgttactaaatttaccaacttttttaaaataaagatttaatactcacaatgggattgttttcaaagttttgataggaatgtgcaagttgcaaaagaaaattaaatagccaaaaagtgagtagagcacacattaatataaacagagaagattttacaaatgagatttttagactacttctggtttcttttggacatttctggatatcatttttaactttgcttaaaattttaagcattctaaggtttactttccctcatttcctccatgacctactggcctttattgtgtatttctaacaattaaacatttaagttaaatgtaaattcaaatgcatctcaaggacatcagaattttaaattaacttagatctaattcaaattctaaacggacggaaacacaaaattaaggttaaactatttacaaattggtgaaagaacattaaaaattctttacaaaataaaataacatttttaaagcatataaaaaaataaaatgtagttgaaacaatcctgtcacatatgaaatgccaaaacttcaggtagaaaaattgtatttcatataggaattgttcaaatgatgccgaattctgttgtcagccttccagcattttagaattttcttttctactgatacctcagacaggaaacatcttaatattagttaatacagtcatgtgccacataacatttcagtcaatggactgcatatgtgataatagttgttccacaagattatactggagctgccctatgcacctatataattttaaattttatgacatatttttgccctattttttctatgtttacatacacaaatacctgccactgtgttacaactggctacagcattcagtacaataatgtcctgtacaggtttgtagccaaggagcaccatatagtctagttgtgtagtaggatttcacaatctaggtttgtgtaaatacatttcatgacgattgcgtgacaacaaaatcatctaatgacgcatttctccgaacgtatccccattattaaacaatgcatgactatattcagaaaagcatctttcattgtcagcaaaacaggatcaaacacttagtagacagggctactaaatcgtcatgggtaaatgtgcatatctgaaaactaggctcttcgtggacttggtgtacagtgaactggcttttgatgaattggctttccataattgattttcggccaactgacctgaagccattttacttaacctagcttttcccaaattcatttgaccaggattctcttttcatttcaagtcaatggaacaattatcctgacagaacacactctggaaaccactactcaacaggaaggaagtcatatgcttgtactacaggccctggggaacagcaagccgactttgataataataattagcaactgctaacaggggaattaatgagaaaagaaacttaacttatatccagatgccatacttctataaatcggcagactatatattctattcactcatctccactggtgaaaagttccacgttttatattaatttttattttacttttttttagagatggggtcttgttctgttgcccaggctggagtgcagtggtacaatcaaagctaactgttacctcgaactcctggggtcaaaagtgatcattccacctcagcctcccgatgagctgggactaaaggtgcaccctaccatgcccagctaattttctaattttttgtaagacaaggtcttcctatgttaccccaggttgatctcaaacttcttgcctcgagggatcctcccactttggcctcccaaagcactgagattacaggtgtgagccaccacacccagcttatatgtatttttttaaaataaaaacattttaatagaaaattcatgggtgggaatgaagtgtttgtgttttttctctctcatgttctttgggtctgagaaagccttacacagcatgcttccatgtcttaatactctcccactcatgatggctgctgtgggaactgccagcagtgagggctggtagggaagaaagcaacacaggccagggatcacacacttacgagcccactggggtagacaggatgtggacgagtaaagccagcctggtggggaactagtggagactttggcaaactgacagagaatacgccaggtttaagaaggcagctgctacccagcatagctacagctgctttggggatgtggatccactgtaccagtcttctgattccccaggcaaaactagaaatctaagttaaaaaaataaaataaaatctcctgctttttagaagttagcaaatatttcattaaaatatccaccatgtggctaatcagaaatgtttcatatacatgaatgtgtatatatatatgtgtgtgtgtgtgtgtgtgtgtgtgtgtgtgtgtgtgtatgtgcatatacatatatgtgaaacaaagtaacatcagttgtattaccttaaaccaccaagttacacaaaaaattataagcaaccaaagctatactaactcctcaggatgttgtcttggaaccagtcggaggaaggaaagggtatgtgtggtcctaaccttatggaccacatgataactcatgacaagagaggcagtgagaattggagctgagttagtttgttttgtactttatttgtggctgagactaaagaagttttggaggattttgaaactcagaatctgaaagctagaagggacattacagtcatgtgggcaacctcctattcaataaaggaattatttgggtacaattccaacaggttgtcaactagttgttatgtaaacacttccaacgatggagtgttggatgctccattattgggtacctgaggtgttacaaactgttcttcctaatttgctggcatgaaatgtgtctttcctcaattccaagtaacaagtcctagttcctcctcctctggccaggaggaaaactcttcttccttcctacaagacagccttttaaaatgtttggaaatttacagcaggtatccctctccttcacagtcttttaaccttgtgatgaaatacctccagttctcatcagccatttctcatcatatggctacagaattcttctcatgatggtcatcctcagctagaaactgtctagacggggtgatggatacatgtaccccatcctttgatgttgatactatacttaaaataatgcagcctaaggttggattagctttactgcactgcactgttctctctggaccccccagatatatgttatgatttttatgttgtatgaacgaagaaatccaattcaaataggctgacgaagtaaaaataaagtttatcagcctaattgcttatgcaactcaacagtacaggagtaaatgcggtctgaggcagtgtttaaacaatgtgatcaggatccggttttcctctttccatttctcacctctacttccttggtttctttttttttttcttctgatctcttttagtcccaagaacgctaacggcctgcagtcttagggttctatgctcccttagttatgagcagtagtaaaggagaagtcttctttcttaatagttcgaatgaaaggccaagaacggacgaccatcacggctccaacatgaagccacctggctaacatgggtcacatgaccagggaaacatgacttttctagctttagccaatcacagacagactgcctctgtggtcaatcacatacacacgacatggctaggacccatttgaagttatattaagaaagaatgcagaaattaatgttattggaaaaaccaaaaataatctactaaacactagaaaaatttctccagcctattattgaattttacttccaaatgaagacttttccgtgtacccctactcactttgatgccaaatgcttctgattaaggaattaatttgaactttggttcagctctccaaaagattcttctctgctttgaatcccttccatatttgatatacataacttctacgtattcttctcattaagtctttgattaatgagaaccattaagaccaaaaaaacactgagctttgaggcatataccccactgcgtatttccccaaaggggtctatcaatctgtgaaagactatggttcagaaatagctatttaaaaggtataaattaacctcactaactcctatttttccatccataggaaatgtgccaggagacactatcaaatgccttgctgatatcaaggtgcactgtttctgtagcatttccaaaataaatgctacattttgtagcattctggctatattacttaatgcctgtagccagaaggagatagcacacaggggaactggagaacctccatagagtatgtcacacactgccatcaggtacatcaggtcctgacataatttctttgctccaggtaggacctcagctgctttctagagatccatcttttccttttccagctctcagacttcctcctaaatggctggcttgtgctctggtccaagtgggtcctgctgttcccttggaaattctaagaacctgctcttgcaaagctcaatccccagtgcataacataatggcggagagctgctgcttccttctctctcatgtaattgtcctttcatcagtctttttattggattctctttaccatctttgagtcgttttctatctgaaatgtttattagactatttctgagtggaatagtacagtggacatctattcttctggtttgtccagagttcacccaccctcctaggttttcaagaatgtctgtcccatttcaaacctgcatttttggcagggctgccagcacctcatctccctcggtccaggcagggttgggtgtgagacccacaaaggccaaagccatccatcccaaatacacagtttttaaatctggagctggagggaatagaactttttcttttgttatacagatagcagaacatgaatggggtgggggggaagaagctgctggaagccatctgtctcaccacgctgtggacaagactgtgaggaagaatgaggacagcatccaggaagggaaggaaggagggagagaaaaagaacgcaagagcaagaaagcaaaggagccagacgtcagtccgacggcccagactgcatccctgaattccatcgcagtagatctgtggctggctgtgcagtgtgtaggcaacagattctactctgcgtgaaggtgctcaggtggatttctgttacttgtattaaaattagcatcacagagtcatatggtaggaaaacagaatggtatagtggaaagaccactagagccctctgtagtgtagtaatagtttatacttttctaacaaagccaatctgggttcaggctgactcaaatgctttaaaaaattatagccaaaataaaataaatgaatccatggcctgagtttgaatcttggctccgtcatggagtgtgcaagttactaagtctcagcctcagcttctgccacagaggacaagagaggttaacatccttctcactctggctgtgaggattagaaggacaagcaagttgcttggtccacagtagcctcttaataaataacagcaattacttttcagttaaagaaagttgaaaggtagagtccttaaagtcctttcacctactcccctagaaagatgatgctaaccaatagctggcagatgcttttatgattgttgaatccagtttatctcacgttgggaggacattacggtgctatttccaattacaggtgagagcagatttgttcctctttcatactgaagggcagtgttattatgattggtgtcctttatgcaggaagagcaatttccatcatctgtttccctctttgcagagcagggcactgtctccactcctctcactactcccaagcccctgctctctccctgttcaaaggctatggctggccacccttgctacttcagttccccagaacctggctgggccatttcccttaacacatctaacaataagaatagtacacatttttccattctatctcacgagctcaagagctttatactaaccagcccagaagatattttccttgctctaaataactgtaattttgggggtcatttataccccactttttatttctttcaaggacctcttactgctcattataaatgccattatccttctctacaagcgatcaaatattataaggtctgacaagttagttttatgtttgcattgtaactgaagtcccatccatctatccttcgggagtttctgaaaactctatatgaacttcactcaaaatacacaagtagcatgtaagcgtgctgatcatattttcaaaattatgaagtgtgtcctttacataaaattaaaatgggttttaatgtgtttgagtcattcaaagttttatccttcattacccatttttcaggcccacctgatttcttttggctccctacaggggaaatgggatttctttttttcctactttctcttccacgaggtgagaaaaagaaaagagagcagcttggtagctgcacggaagccaaacaagagactgattcaacaggagaaattcaatgcatcccaaaagattccctaggaatttggtatcctgctgcttagagtacaatttgttgtaataagaaactgaaaatttttctatcaggaaagtcaaagtgctcagtgatggcttgttcaagttaaaaaaaaattgaactacaatggaaaatgtcttattctggaaatgctttcacaacataggaagcctaaacacaatttctcaaatcatatatattgctcatacacactggtcaacacaaacaaatgttttcctgttcaggtgacctagccccatacatactggtgaaccacaaacaattaaatgttttcctgttcaggtgacctagtcccaggagtggagtgtggcttccatcttattccacaaggaagttgtttatactgaaagtcaggcaaatgcaacagagataaagtctttttttttttttggagacagggtctcatgctgttgcccaagctggaatacagtggtatgaacatggttcactgtagcctcgacctccatgggctcaagtgatccttccttccacctcagcctctgagtagctggaactataggcttgagccaccatgccgagttatttttttctgtgtgtgtgtgtgtgtatttcttggtagagatagggtttcatcatgttgcccaggctggtcccaatcctgggctcaagtgatctgcccaccttggcctcccaaagtgctaaggcctacaggcatgagccaccttgactggattttttgttgttgttaagagacagagactgactcttaacccaagttggagcatgtggtggttccctgcagcctcgaactcctgggctcgagggatcctcctgcctcagcctctcaaatagctgggactacaggcaccaaccaccaccacgcccatctactttttttatgtttagtagagatgaagtcttgctgtgtcacccaggtctgtcttgaactcctgggctcaagttatcttcccaccttagcctcccaaagtgctgggattacaggtgtgagccactgtgctaggcccacaaaaggtatttcttatgtcctggcctgggttggtggctcaagagccaagcaaggtagacggggaataagtggggttggtccacagctgtgggattttggagtaaagggaaacaggtatccttgctgcaggtagggaggagcagcagaggagaatgtagaaggtagacagtgagcagagagaaagtatatgagccagaatgaaatatctccaaggaggataggccagacagaaaaacaaatggattctgaagacagatcctggaattagtatctaaaacattagagttcaggaagccttttaggaccacgagcatctatgggctgggtgaaagctatagctgggaacttctgttttccttggatactgcaaccaaggaggcacaggactggggtccctccaggttggacaaaaactttcactaggaagttatccaaaggtacaaagtagattctagtggctccctcctggtctgaacttttcccagtagactactgctacctagaatgactcatgctgttacaggaaatccagcagctccccttagcacatggttcttgactgggagcttgagtgttaaaagaggggattggattatcagaaagagcaggatttggtgaaagtcaaatggaggaatttggcatcgggaggatattttacaccgtgctttaagataaaggtttgaagacctccagttaccttgagggggtttggggggcagatcttccaacttccagcagagatgagttatgtgtatggaccaaaaggggagtcaggtggcactgccacttaggagagttctctagaacccagtgttgatcagtgtacttcttaccagaacttgggcctctctaaggtggtaatagtgcaggattatcacttctgatttgaaattaggagctctgctatttaccatctttattttatttattttattttatattatttattttattttgagacagggtctcgctcagtcacccaggttagagtgcaacgacgtgatcacagctcactgcagccttgacctcccagactcaagcgatcctctcacctcatcctccctggtggctgggactacaggcacatgccacctctcccagctaatcttcacatttttagtagagatggggtttcaccatgttgcccaggctggtcttgaactccaggactcaagcaatatgcctgccttggcctcccaaagtgctgggattgcaagcgtgagccactgtgtccggcctattcactgtcttgatgacagagagaaaaggtatgggtttccagggtcctggcatagccagggaagagtataaaaatgggtaggaattatgtataacttggggtttggggggaaaaaggaattgatatccttgtcccaggtaaggatgggaggcaaaggaggggcagaaatgagaaatgcaagtggaatcatgctgtcacaggtcgccctggccagatgtaaagccactaacttcatattacaggctttcttggctccaccccacacggtcctggggctctcagaaatgccactgcacaatttttgttgatacttaatcacttggtcagctgtaactgtgtataaagaacccgaaagtgttttaggcagattatttctcagggcagaacctctattttacacattattttatagtaaaggtaggtgagagtttaagtttgattctaaagctatcccaggctgggttcagtggctcacacctgtaatcccagaactttgggaggccaaggtgcgaggatcacttgggcccaggagttcaagactagcctgggcaacattacaagaccctgcctctacaaaaaaaaatttctttaattagcttggtgtcagggtgtgtgcctgtggtcccccctcatctactcgagaggctgaggtgggaggaacacttgagcccaggaagtaaacactgcagtgagaagtgtttgcaccactacactccagcctggacaacagagcaagaccctgtgtctcaaaaaacaaaataaaaacaaaatgaggctaccctaaaatagctgcataaacaaagccatgtcaaatgatgatattcccccatcagtgtcccctggactgctggcttctgggagaaggcatcctctggtggccaactagcacccatcaagctggtcatgagcacagcctccagctttacgccagtcactccaaggcctgagcatgctggccctggcttctgggtacccttccagctcagaggatgacagtgtggagctaaacaggggtttagccatagggagggctttgggaaatcagaggcactagattctctatatgaggctttaaaatagtagaatgatgaatgaaatcctgaaaatcaatcggggacctccaagagagataagtacttgatccactgcagggcctcctactctagcactctaaaaaccttgtccatcactggccaggccggatttggtccagcaattcctcctcaggttgtcaaaggcctggttttctggagatgctcacaggtgcccctcagctggctgttgaaggctatctgtaagctccaccagaatgaggactttgtattgcctgtttcgtttaccacagtgcatttaagtaggtaggtctccataaatatttttgttgaaaaggatgagtaaaagtgcctgacccaggaatgtgagatgtacccattcaaatcaactatgatctatacatccaggaggccatgcagtaagctgagaatcaggtagagaagatgggcaggcttctttagtccaaatgatatctcttgctctgtctcctaccggccaaggcatatctaaaggccatattcgacttcttgcatacaaataagatggaggttcctacagagatctgatttcctaaagccccatgcctgctagcattgatgtggaaagacacacacagacttggggcaggacgacagctgcacagtggagctcataacggggacaggggaggaacaagcagcttctcaattctcttgtctgaaagtggctgtggactatatctagcactcttgctacagggagagttaccagaataaagttcagcagcaggttctggcaatgctgtccagagtgaaacagaagatggggtcctctgaaagatggttgagtagtggcctctactagccaggagtgaaacactatagagatgtatggccaggaggtgacggaaagcacaggctttatgcatgttctgccatgtgcagcagcatgttggaagcaatgaatgggtcacctccccttcccagtaggggctacacatacatcagcagcacccaatcattttgtttcatccttaagacagatgggaaataggcaagctggatgaaggcatggtatgtgaagctgccagatcacctaagcctgtctgctgtcatccaaagctctgtcagaatgtgcaacacttgttcaaatgcctgaggtgacagcaatggtcagaagagctgctacattcaggagaaggagtaggcccaaggcaccctgcctcctctttttcagaggtgttgaagggccagagcttatgccagttccatgcacagagtgtcctagatttttcttccagaagtaagactacaaggctgggtcattctcacaccaaccagtaggttcagtgctggaaccactccacaaagctgggcaatgaaggtctttacccaaacgtacaggtggcatctcaagcaaggtgattagggctaaaggaagtcaaggtactttagaggagtagatggctgaagcagagatgttctcatttctcttgttccaagaaaagaagagccagagaaatcggtcataatgttctccattacctcctacctaaaccctcatattagccttggattatccataaaagtaaaacataagtaatgaggcctaagcgcaagtcagtggtgtaataaatatctactagtcattgtcatatcttctttccttcttcttcatcttccctctttctctattttcccctctttcacctcctttttcattggattttatgtctagattctgcattaagaaagtctttcagaattaaattaaaaggcttatatttaaaagtttttaaaaatgcttgggtcttgacggacccttcgcccatcactgtgcaggtgatcacggccccagtgtcccagtaagaaataaaccttacaaaatggacagcaaacagaaagaggccctgattaggcatgccagataattcagtatttcacacatacgaacacacgcacatacagagctcagagtcttgtatcgagggtcttccactaaagatactttaattgaaaactacagcatggaaaacatgattaagtggctacaagattactgttcactttaataagcagagaagaaaacatttattcatttatcaggtgaaataattctctaaatctcatcagagacaataaatggcaaacaacatacgtggaaagaatgttggatgaagttcagatagttatttcttcttctggggtgagaactggctctgagttgttctctaggtcctactccatgagcatggattaggaaaagttctaaactagatacaacagccaaggacccagcctgccctctaggaatgagcttcgttgtcagagacaatgacacaagcgtcctcagagagcaagctaacaacatctgagcaacaaggagagatgcgggattgggagaggcagacccaaagcaagcgctgggtatgtgacggcatcgaacgcgcgctcaggtcctcccactgtaatacgcacctgggatgcggggtcaggaaggcaggcccaaagcaagcgctgggcgcgtggctgcaccaaacgtgcgctcaggtcttcccactataacatgtacccggcaagctctgcagactcctgtaccagaatgtcacactgacaaaaacccatgaaagaacaactggagttcttcagaaaagcctgcttgaaaacagtagaaggtactgttatgaggaaatctcatagtttatcaacctatcttccaaaccttctcaaaaaaaggagaaaaaaaaaatcccccgcaaaattaaaaacgaatggggctgctatgtaattaactgacaatctctcagttacaaacccctgatttgtaaccatggcaggtacacaaactaccagctgcattatacttccactctctccacctgcccccattttttctgacaacaaagcacagaaaactatctgagctgaaatctcactcttatcagctttcttctccttgatggagatttcatagcccacctcccttgcctctttctctgatcacaacttaagtctcttcatcattcttgttcttctgcctttttcccaggtacgtcacaaaagtgtcattcccaccagcacaaaaatactatttatggacaacaaaattaatatcaacaaatcttaccctataatgtgggctttgatgaaagaagagatgaaggccctaatacgttttgaaatggctttagatcagaaacaacggaagtcaacgtcatctcttctcatattttcttgaggaaagagtgacattttagtgtgtgtggtgggggaggtacaatttggaaatggttatccaaatttaaaataaatataactttcactttaagagcagggggacctaacttttgatgtaccaagttaccacttaggaatttctcatgtggatttaccctatggattcaattaatcatggcactgtttgacacagtacacataaatggaaacgacagagattgatctaaaaattatggcatatccatgagatgaaatactatgtatctgttaaaaagaataaggtagctaatctggagctaatctagacagatgtctacactctcttgtaaagtgaaaaaagttacagaacatgggctagggagttatccttttctctctctctctctctttttcccgcacactaaggaggacctttggcttggcttcccttccttttctctaatccccactcctccatacaccacctcagcaggcatatttaaaagacctattggaaatgagtctttcccccagcaagacaagcaggaaaaacgcagaagtgcaggagaaagtggaagagcccacgtgaacagttctgaagggaagagagttgagagtaactgggaaagcagaataaaaggaatgggggaagcagggctttaaaaaaacattctgtgtattatgatggaaccattgttcatgttttctggcgaaggttaggattactgtttactttcaatcctctgacaccatgctaagacggaggtctatctggctctggaatatattcagaccggccactctcacacggaacatttccagaaggaaacttttagccatgtttatctttaaggagtgggacaacagtttgaagatgaggctgatttttacctttctgtcctcttaaattgtccttccctacaagcatatgttaatctcgcaacagaaatgaacagaacgggcgaatgtcctgaaagtcctcttcaaagccggaaacaccctctatatctccttatcactctctagttccgaaagaaaagtcaaatttaattaatattcgacgcacaaaaattttaaaacaatgtgctcaattttgtatttttctctccgtttttaggggctggggggggaatttatagcccatacagtggtgctatcaaaggctgagtagactttcatgggttagtctggagacatcaccataatctgtaaccatctttaataggaaaatgcatcccaagttctgaactactaattggcgaattaacattagactaagttaaacttttaaataaaatttatgaagtattttaaaattatcttcattctacttcctgtttacaatgctaagggacagatgagtttccatattagtcacatatatatgccgatactatcagaagacatactatgggctaatactaaacattatacattttgttgtatgtgatttctaacttgttttatgaaacatgaaggatgtaatgttgagttgcgtcataaaaactgagtaaaatctattgagtaaaaataaatgagagtagcaagaagggagctgaaggccataatttggattaaaatggaatagcagcactttctcctctaaggtcagcaattaaaatttagccaaggtcaggagtgacaaaatcatcaagaaagacttgacctccatctagttgttgcaaacaatatattaacattgtaaaactgttacagcagatggcaatgcaatcatcccttggtaactcatgcctagctaactgtctgtgtccttggctaaaggtgagcaaaaggcccacctcctgcgtctgcagggagccgatgcggggggctgagagcactcagtgtgaattccctcatgcacatgtgagaggtgaaaaccactgccaacttctccattcctgcctttgttccaaaattgctaacagggttgcagggtacctgacctatttgcatacattccttatttttacctctgcctgagctaaaggggaaaaaggcaaagtatgacaacatctaacctgcccatttctctcaactttgttggttctggtttatttatagccttttcctcaactacagctttaaaagcaaatgattcgtacctcactcatgtgaagtggatcaatgcagattggatttcttgaaataccaccaaaaagcaactcaacacacgccagggaagagaaaccaagggaggcttggaaatttgtcacccagcataagaacacagcacacacttaaagagattgtgacctgccaaacaccatgtaaatataaccaaacgtttcccaaacataatggactgtattctggtggaggacttggcctcacttacaagaaaggcctctttgtttaaagtcagtcaaactgccagctacttaaggtgtaagttagtgcctcaaagaggccctggtagatgtggggaagagaaggttgcaaaatacgtgcagaacagacacccgtgtaggtgtgtggtcttctttatggatgtggtggacccatgtaaagtttctgtgcttaagagtggcccgagcagggcagcctgagtgtcgaaagggaggatgaggcagaagaatcagtgcagcgctagccaagagtgaggaaccagcagctgctgttgggggcctggagaaagaagggtatttttcagtctgcatcttttggatggagtttatccactcacccagaggctgtttggcttcctcagagcaagccctggagttcagagaggtaacgccaaccatctgacctgcctctttttgcaacactaaggctcagagaggaagccttatctctttgaatgcgattcgtattttccgagaacccacaagatcgatcactctgagcaggcatttcactgctcatgggaaagtctacagtctcagccctcaagccaatccctcatacatttgattaaagctgactcacagtctggattccaaagctgttcacccacaggcagtggaggaaaccatctacagaagtcccgaaaacatgctcagggtcaggctggtggcactggctggccagggacctctgccatccgcctggctggtggagcctctgccgtcttcggggtccttgtggactgcaccaagctcctggctcacgcctggcttcctgaccaaacacctcatttctggtttactacctttgtccaaacaaatatcctagaccctggactcacttctgttcttatgttgaccctgggaaattcctctccctctagcgggaacaggaagtaccctggactctcacgtttccacctgctcctcttcgcttacagccattccctgcctgttgtcctacgttgcccctttgggctgacatggtatttgcacagtctgcaaagctgggaaattaaagatctgcccaggttggagcccctgttctccagggacctcctccctctgccatcgctcctggtcacaggtgctttcgaggtaccttcccgccagcaaccttgttctgtgctagagactgagccattcccacctcagattatggtccacatgtctccgtgcccttccccttgggctgctctccgtctcaccttctagaattatgttctcagccgactgcaaatcagggtgcagcatccaccagcgcctaactctcagcagttcaacactacccccttcaatgcttttctgagttataaaaacatctcagggcaaaacacctactggtctccaggagctgagatcagtcaagaagcaattacctatagttccttcacctgactcaaggagaagctgaggcagggccgtctccctgctgtcctccctggctcacaaggtgattatgaaggcaaatgattcaactgaaagcataaatcctgagagagataaaggaccattcttactgtcagccagaccaagggccccatatggccatcctcacctggaccagcagaggctcatgacacagcctctcaagctaggtctgagcctgcgttcctctacagctcccccaccaccctgagcccgtctttgtcactgcaagcgccacatcgtattgtaatcatctgctccagatagagacagcatctaattagtttctgtacacccacggtgtctgacacatggaaggaactttacaaatgatgaatgaatgcataagtgaatgaacaagaggagtgaataaaataagacttggttttaaacaatggttgagaagcagctggaaatgctccatgcaaagtagtaatcagaatgacttcacaacatggatcctttgcccaacgtgaagacgtcctagcccttatgtcagccctctccctgggacttgcctgtatggctccatggtccgagtaccatagaacaaggcttcctccaacaggccgaggttgatgcaggcatccatggcgcagtcgagcaccttcagctggtagatgttgatatcgggaagccgttcagaattgctgcttatgattgcctggcacatggccagaacctgctcccactctgttattaaccttagttaaggattcattgtcttcatcaagaaaaaaacaaacaaaattagattctctaaaaggctaaagagctcccaagcacaggagcgagggaagcacccgttatttttcacagatgagctgcctgaaaacacacttgagaagcaaaagcacagaagaggcatctcagtgaagtgaattctgtttacatcaacaaactatctcgtaaccaggcctgtgctttggagttttaaaacttccaaagacctgttcttgcttcatactcctagatgtgttctctttaaatctagtcataaataaatgcagtcctttattaaattggactaaagattaagttaattcgattttaaattatttactctgttagcttctgtttaaaaactgtttgaaattaaagatgctttagagagattcctttttcaaaaggaagagctcatgtttgcttctgtgttacctgagttttgggcatacatgaacccaaaaactcacacaacccacaggcacacactaggtggagcaatttgaagacatagatttccactgggtctcattttttccgattataaagcaacagtgaccccagcctgtacttaaccaaatacattaaaatatgttattttaaacccccaaaataagagacagtattaggaacatggcttatgcacatcaattgctggcaagggaaacgatgctttaaaaaggatggggagaagactcaatgtccacttctcagtaactgcctttctgattaaccatgagtcagtaacttcatctcatgtagccttggagtgacttcgctttttaaaactgatattccctgtcttacagaggcagtcagaggactgaggacatggtttatggagcgtaattttaatccctccccagtgaattctctgggaaacacagcgaaggccagagtgcaggaccctgggacctcgcagtttcttcactgtgcggtgtgttaggcgagctggagaccaaggagggtgcaggactgggactggtccttctctcactcctgtctcaccttcacccagtggagctccaaattcatctgcttcatatgttgtcattccagtagggtgaaaaggtttgaagatcagaaatggcagcctagcctttgactgtagtaaagctagattcagatctaatcgagtcctgtcatttatcagagttgaggttctgaggaagtcaaagtgcttaatgataggccagaaatagaaatgactcacgtcaacgtaagaatgagtaatatattgtatgtaaaatgacacagttcatgatgtgtcctctcatgagccagggagagttccaggtgtcagagacacagtggggaacatttcgtggcatgcacaaagcacatgctacacaagcattagtgccttccaccttccctctgtgacatgacctctgagcctgactgggcttaaagaaagtggttcagtggactgagtttgactgaactcagtgcccccttcgtgcccccacacccctcccactcccacatgacctggtccctttacaatccatgctctctgtgccatcccctgcccccaattcaaaaccctcttcactgaggtcctaacagagcacgcccagccctgagcagacagctcactgtttatggtcccctctccctctctgtccagcaaaaccttcctcttcgaatgtccatacccttctcagaacacggctttctgaaacattagcaaatacttctaataaaccaatcaagccactcctgagagtggagacaaatacctttatgaactttcacagcaaatgtattttctttccagcaaaggcctcccggagacacagtatcttactccaaaagatgagttccttgatgagaatttaaagcaccccaatgcacagctgagagcctgttccatcacacccactacaatgttaggatgagtcccgtcttggaggaattgaccctgatcccagaaaaggttcatttcctgaagaaaagcgagtgcatgatttgctcttgcattcatctgacatgtatgttcaaagtttgctgaatgtatcccctagaggttgggggaagcagtatcttaggcaacgcactgattttgtaacagattgctgggctaacctccgtggcttttcattccaggattagatatttgacgaactgtcaggaggaatgactgtctcttacacattgctagacatttctgtggcaagacttgtaccttattttaacattgtgctgtttgacctccactattatttgcctgttcatttatgtatgttcccacttattctaaagaggttcgaggtgacaggccttagaagtagaagccagatgtgatgttctgcagctactcataggaatgcatttattttatcccccagcaagctggaagggactacgtgccaatttcccttcacaatgctggcaactgtctcttgccaaacaaggcaaaacctttcctgcaaaacaccccagtgagccaaaaaatggaataattttaactaagaggcttttccccccaagctactactgacatgtatttgctcaaagatttagtccctggcatctgtgtggtgtttactacaattcactctgttccagtacggagctgagctctagacctagcagggctggagagtgcacccaaagagaacagattcctagtggacagaacggatatctttttttcctgaatacttttaaatgaccataagaggatcaggggaagagaaagggaagcaaagtaaattcacttgggaattactcaacttactgagattcaatgactgtcagaccacagagcttttattcacttaatcatattactctactgcttaaaaaatcatcccatggcctcctctcacctataaagtctaaccggtgcatggcagttaaggccttgccaccttcccctcctctcatattgcacagccagcagcttctcagtagcaatgcatgttctgcgcgtctgcacaggtcattccttgtgttggatgcctcttctcttggttggtctggtgaactcccactaatcctcccagacgcagctcactggtcacctcctctgtgaaatctttcaacttcccaaagttgactattgtgtctttgatgccgccataagtctgtatctttaccaaaatatgtattaatggacattttactaccccacaatataggagagtagtgagtgcagggctgtgtcttctaacttctgtctgaaccatcaggtgaatgatgaccagcaaggtacccagcacacagtccgttttcagtaaaaccttgtccagttgaaactgaactctggctgggttatccatgggccccaataccgctgccagggaccacacagaacaggtctactcctctgcacataaaggctctttgagcccatgagcagggacctcctgcttccagagttgactgttttccgttttcctagtatcttccatctcatcatagacagcgtttcaaatccctccttaatttcagttccacccctcaaaactagtttgtttttctatatcctttttaatacttcccacctcaaactgaatagaaaattccagaaataatcagactggtactatcatctctatcattttataatcaatattaatgcagcccaagatcacagtactaagattatattatactcttaaatgttgttaaattttgctatttactaaagccctaaatttttttcacatgttcttatgcatatttacatatttgaactttttgatccgaatagaaattttatatatgttcttgttatatttcatgtctttaaaacttggataccatttaaacatttagagatcttttgaactcttttttttctttcgagatactgattctatcatcccacctctattatcctccccatctacgtcactttggagatttgataaacctgtcctctgtatcttcattcgaggtatggaattatgcattaaagaggcccgagatggaaaaacaacactccagaatgacactgaatcatgtaacatcattttttcagtgtagctattcagttagctttgctaacatctaatgtaagtttcttgattacttttcgtcaaatccctttctaaagtctcgatacaaactttaccaaagaaagctgtgactctgtggattcattcgctcttggagaaaccaggcagcactgtgatgatcacagctttcttttccattccttagtaaccaatcctagattctttacccaagactgctaataaactcagtgggctattgattcaaaattatgtccttcacctttaaaactggaaacctccctctacctccttctctggctctttacaactctttaaatagcatcgtcagcaaattggaaacctcatctgctatgttcttagtgcctgggatataaatttaccccagagcctctgaatgaccttttgcagtcttttcatccaccttgatctcttccttcttgcctgctgtttcccttcatcacagcttcactccaatgaactcctctaccaggagcggcctccttctcagccttggcctatccaaatcctgcccctgactcaggctatcttgcacagtaaaacattagtggagccttcccagatgaccttcatcctacatggtctctccttactctgaactttggtccacctgtggtcattactattcatgctgagaaaatgtgtcgtgcagcaatccccactgccattgtagtcgtggctggtttaatatgaagcttctgggtctgacggtcaatggcactgaatgataaggattctaagctactctttcctagagatgttagtggttatgggagaagaaaattgaggaatttgttaccttttacatataaagagactaattcttactttcctactactgctaggccatgagttttgattattacctaacggtagtgagttattattcacgctgattttgccacgaacttccttgtcattactcaaactgctggccagggtcggaggtgcggcctgtgaccatggaacagaatgaaaaccactggctcatggagaggtcaaaccccgcctctgacctcattacgacagggcttcaagaaaacaaggaaacaatcccaacagtccacctcaatccacaggcgaaaggatactccagtgtgccttcagttcttcaatttttttcagggattcttgaacttccttccatacttgctcatcaccagttagcatatcagcatcctgctcaggccagaaaaggaagacaaataatctaattagtaataggcaaaggacgtgaatagacctttctcccagatatacaaatggcctgcaagcccctgaaaagatgcttggcatcatttatcatcagggaaatatataaagcaaaaccacagtgagatgttacttgatacccactaccatggctataatcaaaaagacaggataacagcaaaggttagtgaagatgcagagaaacggaaaccctcatacactgcacatgagaatgcaaaatggtagctttggaaaacactctggaagttcctcaaagggttaaacgtagagttttcatgttcccaattagagttaccatattaacagtcctactcctaggtatctacccaagataaatgaacatgtatgttcaacaaaaacttgttcacaaatattcacagcagcattgttcataatagccaaaaaatggaaacaactcacacgtctatcaataaaatatccagacaatggaatatgactccacaataaagtactacatgctacaacatggatgaacctttccacaataaagtactgatacctgctacaacatggatgaggcttgaatacgttacgctaagcgagaagccaatcacaaagaccacatgtatgattccatggatatgacatgcccagaagaggcaaatccacagagacagagtcgatttgtggttgcctagggctaagaggattggagggaactggagagtcactgctaatgggtaggagtttcttctggggtgataaaaatgctctaaaattgacaccatgctagttgcacaactctgtaaagagactgaaaaccactgaactgtacactttaactgggtgaatttcatcacaggtgaattacacctcaataatgctgatattttaaaaaaacagaagaataggataaatagttatttgttaggagacctacagctaaaaccttattaagtataaagtacaactacacccatgtgacccaattctgacttccacctaaactaaaaacaaaatcccccaacactgaaaaaattcaaaagaaaattatgagctaccatgtatgaaatgtctgccctcctattcagtaagcaggtcctctgcttccggttggccagtgtacgtctggcatctagcacagtgcctggcacatagtagttgcttactcagcacttgttgaatgaatgactgaaaaccacatgtgtgcacaatgctgaaggctttactgatatttactgatattgatatttactgatatttactgatatcgtcttatcttcacatagctcttctatgtatgtaagtatcttcacatagctcttctatgtatgtaaggtcaaatcccatggggtaacacaggcagggagtggaaaaagtctaccctgggtcaggcaatgagagggcacactgtctatagaatactaaaaaataataataaaaaccaacgaaaagtaggtctgatgtttattatgtgcaacaattcagaggtgaaatattcttcttccccccaggtcagagggtgtctaacatctttctccctaatatatcactgatcatacccagtttatacatgacaaaactgagactcagattaagtgacttacctgacaatcactagcctggaaccaaaatttcaccccaggtctgtttgattccaaaaggctatcttcttgtcaaatattactctgtttgccacagatactgctatggtcttttcagcatgctcagcaagtcctgcttatttaaagctgcactaacaggtagccaccagccaggtgtggctatttcaatttaaattaattcaaacaataaaaaactcagttcctcagctgcagcagccacattccaagaagctaacagccgcatgcggctgtggctaccacactcaacaacccagatacagaacagttcactatgtcattgcagaaagtcctgttggacagtgctgctttcaggtggctagtcaaagggtaagcactcttagaagacactattcaaaaccaggtgttcactatccatgagactttcaacgggtgtcagagacaagaaccaccctaggaagttacatgaaagcagggccagtgtgaaggatgacataagggtgaggaacgagggacattttcatactctagacatccccctggagactgtcatgtgcccgttgaaggaggtttatagaacgaccccatgagaaccactgccagagtcagtctgtgtttttgggaagaagaaatatcactcaagtgtgccagggcagaaacaaagggaggggcagagcaccacgaaccacagaaaacagatcctgagactctccttctgaggctggggcagtgggtgtgtgtatgaggagataggagcacttgtgtctgcataattgggctttgtgggcctctatgtgtatgtgctgtgtgtctgtgtgatatagtagagtggattttaaaaagacaccataggtgcactttttttttttaattctaaatacatccctaactttctgtacatggaggagggaggagataaaatgcccttaagaaggtaaacaacaggctggatgcggcggctcatgcctgtaatcccaccactttgggaggccgagacaggtggatcacctgaggtcaggagtttgagaccagcctggccaacatgacaaaacctcgtctctactaaaaatataaaaactagctgggtctagtggcacacgcctgtaatcccagatacttgggaggctgaggcaggagaatggcttgaacgtgggaggcagaggttgcagtgagccaagaccacgccactgcactccagcctggacaacagagcgagactctgcctcaaaaaaagaaaagaaaagaaggtaaacaacagtctcccttcaaatgcctgctttaagcccgtattcatctcctaaagatcacctccctctcctgcaccaaagccttcagcaacttcccactgcctcccagatcaagctcacccattagaccttaacaatcatggtcattcctgattgaatgttccagttttacatttcacaactggcagcttaaaccctagatctaagcaaaatgttagtctctatggtaagcagaataatggatccccaaagatgtccacatcctgctctccaaacctgtgaatatgttaggccacattgcaaaggggaattaagttgtagatgggattaaggttgctaatcagctgaccttaaaatagctgagagtatcccggactttccaggtgggtccaatataattacaagggtccttagaagtagaagagggaggcaaaagaggaggtcagggtgatgtgctgtgagaagaacttaaccagaagctggcaaaggcaaggaaccagtcccctggagtttccagaaaggaaggcagccttgcccacaccttgattttggccttctgagacttgggtcaggcttctggcctacagaactctaaaataataaatctgagttgttttgagatgctatatttatgatcaattgttacagcagccacagaaaatgtagtccctaacataccttctgctcctctggccactggggctctttgtgcctggccctctctgtacctggaattacttagttagatcactcatttattccattaacacttactgagtacctaaccaggcactgttctaggcagtagggatagagcagtaaataaatcagataatcatggtgttcatactgaagaggcaggtggaacacacggcaagagaagatatgtgcatgcgcgtgcgtgtgcgtgcgcgcgcacacacacacacacacacactcacacacacattttgttgggagaaaaacaaggaagagggatggggaatactggcaccagggagttcattttaaacaggatgatcggggaaggtctcaccaaagtgatatttgagtaaagctcatttaaaggaggtgaaggagtaggagacagcagttccaggaagagcggagggcaagtgcggacgcagaagcgtgcctgaatgttccaggaacatgaggccagcatggccagagcttgtggactgcagtgtgtgcatgtcatatcttccccacttaactgtaagctctttagagctgaatataggtcttattcttctttgatcctgcctctcccaaatatctagcacagtcttatatttaacaaatgctctgctgaatgtctatagcatggatctggaagaagtgaactaacttggtaatgatttgatgtctcttgtgtttatttcagttattcctcacaacatctttgaaaggcaccaatacttgttatttacagatgaggtgcaagataatcctgaagcttacataattggtccaaatgtccttctacccctaattgccgaggtaggattcaaacccaggtctgtctggctccaaagcccatgctctttctagtaccttcatgcttcaatttgatttctctcctggacttgcttaaaaggtgaaactcatatctgagttaatcaattcaaaatatcttcacccttgtttcctaagctctatctagtactagcaattctaagaggagagtaaaatcctccaacatagaacccacagcagatctcgtattcttctatcaagcagggtgagaccgcagcccagggcagaacaatttcatatgggaattacagtcacaactaaatttgccaccagtgaacataacctgattagctgttcttttaggttgatcctaagcctttatttgcttaacagaagagcaagcaagctttgaaactgctcctaaacatttagaaatgatacctctgagagcattttatattggagctagacaaagctacactcactaatagctatcacctccctggagtgttccactacggtaactgcctctcaggttccaacttcccctgaccctacccatcccactgtggctgctactcacaattatgtctacactgggtctgtcacgtctcccctctctccacaccaggctggaggaaaacattcagttgcacaggtgtataaacaggacagaaacagaaaaactacttagggaagcataattttaatcttctactttcctaatttgcaaatagaagagtaaattactgttttttatcacagtccctgaggtataaaattagtaaatttatatccttatttccattatttcatatccaaacacaaagacacttgatataattcaggacaaagttattcaggaaaaaaaaaatctctttgaattttacttttaccacataaaaggagcttgaatgggtgagtcctggaatttttttttaggggatggaaacattcattttacattcatttaaacatcaaatatactattgctggattttctacaaatgctaaaaagaattcagcctagaagcagaaggattcctaagaaagctgactttcctgggaaatgatcgagagaatgaagaacctgctggttccagcgctggtggcatctctgccctgacccactgcatgaccccgggcaagtcttccttttcctggccctcaccttcctcacctgcagaaggagcagctagtctggatggctgctatgtaaccactctagtgatttcagcagtgcagaaccaatttagctccatctctggtgactgctcttttgcacagccccggagaagtccttcaaaagcctgtctttattttaaacagtacaatcgtagagctagtttatgaaagacagaactgtgccgttgttctcaggtaagaacgagtctcatttgtccattctctctctgaccgcacaagccccttgaataccgccctcccagttcactcaccccattctttcccctcacagctccaccccaaaatcctacccacgcccatctctgacttcactgcacccactcttccaactaaaatcgccatcctgtggcttctgtcaggactcagcgtgttttctgctgtttcctcggctcaccactccatttaagtctttggctttcttcccgtttgtccttttgggacacagcccctgctgtactctatcaggaaaccttctctggttctgccttctgggttagcctggccctccaggcccctctgcacagcccctagccctgaactgacacgaatggtttcctggattgcctccccaggtatcctcagaacgccctgagggaccgtgacctcatcatagctgtattcccagtgcctgcaaggtaaatcactcggtaaatatttggtgatagagtgaatgagaagtgatcttccacaacccatgggcgacagtattacaagaataaaataccttaactccaccacaacaaagagaatcccaaccaagacaacaggttgttcctttcacagcacacgtctaccttgactctaatattactacactaagatcagatacgttcccaccgcagctgtgggtatttgtcaaatactacagctggcattggtcatcatttagagcctaagtgtgacaccctcccccagcacaggaaaccccacgccggctccggacccacgctttctgacaatcgcgtcaagggttatttggggagtgggctcgcttacctctcctggcttctacctcaaacaccatcctgagattctaatggcgctcttggcccagaggtccctcgctccatctatccctgcatgaatcagtgaggccacctacattccttcatccatagctgctgaatcaataccccaggatcatttccttaactgtaaaaataggtaccagatgatatgagatcatctcaccaccacataaaagggtatcactcaacacggttacattcaattggccaaacgcttcctttgggtttcggagtgggaagtttacctgccagataccagtagtcactgtgaattacaaagctacgtttcttccatagggaaagtttggagtccagccaggctagctgagtataaacttgagaaagtgaccacgggctctgtcaggttaaacacacgaatccatccagacccaccttgcagctcgaacacttgaacagatgtgttcacttagcttgcaagcgtttgatgttgaaactcgtatgctgggccaatttcagatggttctcattaaaaagaagaggaacaggagaaaggtaatctgcttcccagtacttcctgttatccagtactcatgcaaactctaattagattgaagagagatggagtataggatgaaaaataaaaaattaatgaacacttacaaacttttccagtaattcaataattcatgtcttaaacggaagaaaggtttttagttttagtttttaaagtagaatgaggttcaaatacagtgtctgcactcaagagagagattggaaagtcttgaaattaaaaattctgaggtaatttgcagtgtctttgactgaggtagtctggttggggcaatatactgggactagattaatatacaacatcattcaaaacctttatgattaaaaggagacatctgtgctggaaccaatttccacctcctttgacaaaaacaactgaaagcagttcagatgtaacttgaggggaaaagtggctctttcataaagcggaaaaatagtggctaaaaatagagcattcactgttatatcaactacagaccagtcagtggacattataggctggggaataaggaaaaggaaggaatgttctcaggttgaagcacgatcaaattgtagtatgttctaattagcaattaatcagcaaatgtacacaacgattaacagaaattagtgaaaaagaatgccgggcttggagccataagatgtggaactgaatccctgctgcatatccctgctgccgagctgtgtagtcttggcaagtccttcaaccttccagaggcccaatttcttcagtggtaacgattctctaaggagatgcaccttctcatcttttcctctgcaccctctagagttacttacgtcctaaatgtcacagtggcctgagttttcaatccccaccctacagggcggggaccaacaggaggctgactagagtcagctttgtttggtgggaaagaaaaaaatggtggaggagggagcacattacaatgtaatcaacaaccaactatgctgtgaccccacatctctgcacatcccattccctttgccgggaaggctcttcctcaacgtagtcatccaagcaaacttctctgatccaccacaaaccacaccaaacagcctctgacatccacaggcacaatccctgtgcacttcccactggctttcatgatgcttgctctactgcctggcggcaatgagcgtaactgtgatgcagatgaaaagcatgtcttccagatgctgtcatcagcccacaggtgaagtaaaattggctttaaaaggttattttttcatctatttcatgaaattgtgggatctcagtgcctttaacagatgtccacaagcaggatgtagcagggctctgaattgtgagtccaagcagctgcttgcatcctcgcaagagcccaaagttcccgcctcctgctgcttcacccatctcctgagctggccgaccccaggatggatgtcctcttctcagatgagagagcccagagttcctgccgccttctccttcaccggcctccctgagctggccgaccccaggatggatgtcctcttctcagatgagagagccttctcccgtcgggcagccccgtcactcccttggatccaactgaggagcacttgggcaaccaggggctgtgagcccaatccaaacaaaaatgctcgtggtgaggagaagaagtcatcaaacagctgaagccactggcagctctgttccatttcactttacattcccaccgtcgctgccagcatttgccaaatgcccatttagctttagatctcaggcagaaacagggctctcctgcaactacaaatttccacaaaccacacattcaaaccaactgcgatttcaaggttcaatctccagctacacagaattgccagaaggaaggggatattcccttcatagcttctgggaaacggagcacagccttgaaggtatgaagtcagaacttctagaaccaccaaaggccttttccggctacagcctcaacacctcccctccctctgtgtggggttgttcccatcccagtgaataaaactgcttctcagagaaataagcttatttgcttatataaaatcaagtcaacctggagagaataaaaacagcatctacacgttgagggcagtttgagagcctacctcttgtcagtggtgcttgctaaaaatgagccttctgtagaaaagcattttgtagaaaactagcatgatgggctgatatacaaggcagttaaacacacatgaatacatttaggaaggagacacttgcttgcaccctccccccatactggaaaggtatgttcctgatgtaataacatataatggggattagatgacacagagggctatgagctccacttgcaaatgcacattcagacaaattcttttcacatctgtagagagactaccaaatggatggcttaggctgctgtaagcccatactcacaactcctacccaagtcctgccaatactgttgtgtaaacgctaccaggtgggaggtttgagattctgggaaaaatgcaaagattttacaggaaaattgttctcctgacaatagccattaagataaagtacacctccaaagttcagggtgagttttgtcttaatgaagaccaaagctgcagccctcatctcctttaatcggccacatctccatcttttgtattttcttctttgaggacagatgctctcattctcctctgccaacagagataaaaatgctttaagctgccgcagaacagattcaagtgaggtttaaagggcagtgtcccgaaggcgaaggttataggataacctagatgtggccactccagagacattcagacatgggatgaatgatagcttgatttgggttctgtgctgttggcatgtaagactgtgtgacaggcagcactacggaagtggaactaaggaggccgggccctggtaccagctctgccactggccagctgtgaggcctagagtctaacagtgcctcctggctccgcttgcccaggtgagaactacattagggttaccactgacatggaaactaatccttccactccattagtcgcctatgtgtaaagtatatgttgtccatgaaaacagacctgaaattctgataggaaggttgctggggtttgtgattgtgcaacaaattgtaaatgcctttgttctgatttgtccctccttcattctattttaaactgagttttctcaagtataaacaaccccagccatagcacagagagtctacaggactgaagacaacactcaacatggtactaccttctgccaaaccaagaatttgacaatggttatttaattcacacattccctctaacatttgtatgtataatgattataacaggcaatattccaagcttgggtaaacatggtatttgcttatctgctaaagcgagcacatcagattatctaatctgtggttctgaattaaaggaatagtttagctggggtccacaatgacagcttcacataacaagtccctgagacacaagtctagacatagctttttaggaggcaatcttacgggtcatctaaagaaatgatttattttgacattagaacctctctcttaacatcagttaatggagggttccatagcgtcccctaagtcttcagagttgggctgcagaaattatcccgttctacaaacacttcataaggcagcactgaaatccttagaccatgtgtcacacaagccaaaagttcaaaagaaacatgtcgctgttcgagggaaagaaattactttaatctctcagcctttaaaaaaaaattctagaattgtattttgtatctcactggaaaaaaagccagtgttcctccaattattctaaaacaaaaaaagaaaagtctgtagtctgtgaatcaatccatacagagatctgtcccttgaagctggagggtgggtcaccccagagggcagtcacttggcctaaaggtctggtgaggagaacactactttgtaaagtttgggaggagagaggggtgaccagattccatggtacagctcttttgtgcctcacctcgtatccatgagacagactacacaaaatcaccaggacttagacgctcctgcaagcagctctgcagccatggaagtgaagtgctggctgacggcacggcgagccgcttcctggcacgccaacagaaagcacatgtctgcatttttgattccagtaaactccaggctggctctcagccagaggacctctttgtaatgtcaaagataaaagtactggccatgtttggcaccctgcctccacctccattctcttgtaaccgtctcataaaccaagcatgcattactgttaacagagtcttccagacaaaggtctgacggagcttcataaacattagcagatgacgatcagacaggtccctactgcacaggaaggaaaggaggtacagggaggggcaagtgatttcactcagaacatgctggaaattgtggggagagctggaaatagatattcaactatatactcagaatactcctactaccagagaactgctcactgagccgcctgagtcgtgcacatcttccattagaacctggcatgtgggcaacatcaaacctcaaatctgtccccagcagtataggtatcatctttatattgatatctgatgaagttcctcaaatttggatgttcaaaatggctttttgagtatacaagatgatataatgcttctcatacccctaatattcttcctcttgcccaagggaatgctacgatgccagtcacagaagatttaggaaatgattaccttttgattagtttttgttttcattttgggtcatactcattgtgggccaaaattacacagccctagctgtttgcctttaccatttctgttttactttccatttaacttttgagactactctgaaagtaagattttaaggtttgtaaatgcttaccaactaaaatacgcaaggatttcttttccggaggtaaacaaacttacaaatccctcttgctctgtgcaagaacaaggggtacccagaccttcattcagaggacttaatatgagaaagtcccaggtcttcatcaccagtggaagctggatagctctggatgtgctttttaaaatatgtatcagaggctttaattcactccagagggctgcagagagcttacttcctcccctatgctaccaagagtgtgcaaacacacagatacccacagacatgcccacatacacacacatcccaggaatatgctttaagggatactgagggctccgactttccctcaaactgcagacctgttgttcctccagctttgtctctcctctttgctgtaagggcctagtaaggtaaggtgggtatatacttagaatcacctcaggagctgttaagaatacagaccgggttccatcgaggcaaatgatatcagcatctcttgggggcaggcagataccggtatcttttctaagctccccaggtgattccaatgcacagtctgggccaaggaccatcagcgtggcctttgccgcctcagccattgctccgaatctctgcgatcatgctgtcactcttcgtgccgacatggttaagacttgctgcaagtattgatggttttgcttttcttttttcttgtctgctcaatctacagttctgtctcccatgttctctgcttttgcacaaatagtttatttacaatagacacaaaagtgaccaagtctgtggcactacggggaataaatctcatgcccttcaggtgctctttagctcaatatatgacaacatctccccagtgcactccagggccaggtactggatctgagaagacacagctgagatgtggcctcagcttacattccagtggttgaaacggccaaacaaatgtatcatttctaaataccgcacgtgataacagagaggtaagccctggggctatgggagcatagaggcagagccctctgcctggccaggatttagggaaaatgtcctggagaagaggatgcatgagtgcaggcttggaggctatgggagcacagaggcagagccctctgcctggccgggatttagggaaaatgtcccggagaagaggatgcatgagttcaggcttggaggctatggaagcattagacaaggagagacaagcaggaaggccagtagcagagaagagaaagaggtccttggggaggccacgctgttgggtgcttctggttcactcatgcatggcagggcggcgctgcggagacggggcagctccccggccctctgctgccctactaggtctgcagttacttgctgttcagaggctgcttttccttagaggctcttttccccactaagctgaagggctacttcagaatgagcccacagacccaaaaacataaagctgaattaaacggttcatcgggggaaaggggtggagataaaggtttagatatgaggtagagaggtagggaaggggtcagatcaaagaatgaatttgatcctgcatgggcaacatggagacatggggagattttaagtataatctctatgtttttcaaatatttacgtggaaaatacacttgcaggtgggagggactgaaggcggaaggtgttaggtagatgtttcaacaatccagaaagagatgacatgaatctgaataaggccgtgccttagcaacagtgagagaggaagagagagactgaagagaaaaggaacaattcaagagagtgtaacaagatgataacctgggagtaagtctgtggagagtagaggattccaggacaacggccatgcatctggcttcagtggctgagtgcatggcgaagccttccggtgagatggggaatgtagaaaggtgtttaggaaagggacgttcgcttttggacatgctaatataagatgtctgcagagaatccaggtacagttacccctaggaagcgggaaatatgaaactagacccagaagacaagtgaaagtgagaagtgtcgacttggaagtcaacgccacgcaggtggaatctgaagatatgcgacagaggaaatcacccaatccaacggggcccaagaatctcaggggcaaagcggagaagtaaaggagggcacggaaacgaaaggagagtgttcccaggaggaggaaggaagggacaggtggtgtggaactcaacaatggcatcaatggggaagagactcaaaggaggtcaatggatttgaaatcaggggctcaccgatgacatcagagagagcgtgctttggggagtgataactcctattgtgggagttaagagaaaacaaacagggtcattaagtgtgcagatgactcaaggggtttcacagattaaacaggaaacaatggttagaggcaagagctgagctggaaaaagagtttgtttcttataacgggaaagtgtgggcacgtttatgccacagggaaggagtcagtggacacggaaaggcagaccccaacagatggggcagcaaggggggcgaggtccacgaggaggcagagggtagggtcaagagcacaggtggtagaagcgggtggtggggactcggctttggcaaggaggtccccatttcctctaacaggaagagacagaatgggtgcagatagagttgcatctggaagtcagcagggtgggaagttgagatgggctttatgtctgatggactctttttccctatctactgaaatcaagagacagcagaggcttaggaggatggagcagtagtgagggtctgggagtgctatagagaatgggtaaaaaggggccagctgaggacaacttggcaaggaggaagcccagctgagggaaggccagaagcagccccagcacctgtctgcaggatcctgtgactttcacagccccattgcattacaggggcctgaactgcaggaatatactgttgatgtcatcagcagttggagggttggagagggacaacgcagggatggcaggaagagggcgttgagcttgtgagtgtaaacaaacatgggttccggcagagaaagaagggaagctgcctatgctaagattttcaaaagagtaatgccccttttctccaactacagtttagcccatgaaaccaatttgtatttgtttggcctccaggaagagcagtgttatttctttaatctaggtttcatgttaacacatctgagaaccgcttgcccatctccccatttccattttcagtgcagctataatcttgataatgagggcacggtagtcattaaactattggaaactatgagtctgaaaatgcttgacagtcgcttaggttcccatttgctttatgcatttctagtctgtacaaggttcacgttctagaacaacatctgagcacactgctcacaaacagctgataagcatttcccaataggactagatgacctacctcatagggtgggcctaagggctaaatgagataatatgcaaagtgctgtgcatagcaactggctcgcagtaaccgctaaatgcacatgagctgtgctgttacagaagagatggggagtaggcagcagaacactgcgatggagacgaagagtgtaagaggacaacgctgagtaaccgaggtgatgagaaacgcttcagtgctctctgagcaacgagaaagcatggaagagacagagtcgctgcttcaagcgtgtgagaaacatcaagagatcacagaaagctactcaattcttagggtttttcctttctccccaaagaagttattcttcatcaggagagagcagaataggaatcttagaaaagttcccatctttaattccagctgaactatattccaggacagtgaaagaacttggaaaatatggtcatgaaactattcttactccactctgaagaactgagagaaagggaatggcagcagaagaccagagtggcggcaaatatggtctcaagaaaataaaaataaaactctgtaatggaagtcttcaagcaaataagtcaatgtctatctttgaccaatgcttattaagaattttaaaacatggtgtaccctagagacagcacaggtgcgttgctgtacacaccagagatagcacaggtgcgttgctgtacacaccagagatagcacaggtgcgttgctgtacacaccagagatagcacaggtgcgttgctgtacacaccagagatagcacaggtgcgttgctgtacacgccagagatagcacaggtgcgttgctgtacacgccagagatagcacaggtgcgttgctgtacacactagagatagcacagttgccatgcacaccgctgctgtctctagtgaatgctgttcttgcagctgcagcaccaagaacaaatcctgccaatctgaactcatttaattccatggagattatacaagtatatggggcaaatattattaacaccatattgttcgatttcaaccaggatttgttaatatcttcataatattctgggggtaagataaggctatctggttaggatgagaaagtatatataggttcctggctggctggctgaacaaccaactatatcttaggattaactgatgtcagccttgaatcactccttggtaggaatcattttccttattttatagatataggtgagtttcagagatggccaactgcaggccaaataacaacaacaacatttactgagggtttattgtgctaattactttaaacactgtatcttatttaatcatttcaacgaagtatcaggtaaaaaccagtccaatccttatagaagacaagactgcagctgagaaagacaggttaacctcctcaagttcaagtagctacaaagtggtggagaaggacttgaactcccagttgtataattcagaaacctgagtgctctctgctacaccacactgcctcaaatattcaagtacttgaagactggtaggtgggacaagaaacctatttgctctttattgttccaaggggcagaactaagaccctgatgtaagtggaaagaggcagcttttagttcatgagattaattaactttacaatcacagttgcccaagagtggaacattgtgctcaaaaagagtgtgctgagatcagcactaaaaaagttcacattgagtacggatacccacccagggcacacactgtccaggagatacttgccctgggtaggcgggcctctaagggcccttcccatcctgggcttataggcccctatgaaatgattcttctacatttgttcattataaaaatatacagatctccaacaggataatggggatattcatgcttttgaccagattagaaaactcacatatctaagtataccaccaaaccaacactgtgttactcaagtctggtttcatcaactctggaatgtgtgcattcttggaggaggaaagaacaccaggggcatgaactgcaagcagaaaggaatctgtcatgatgataactggaaatatatatcctgtctttccaacgggtggtttacatgtgagtttgtaggtcttggtatggggaagtaaggtaggccatactcagtattacaaagtgttggaggaagagagggcaagaatatcccttcctgatagcccattgtttaaactaccatgaaattgttttatgagtaaaagtcattttgaagcatcaggtaatagagatttttggcatgtcctatagagcttaactccatgctaggcaaataacagtatttattcacatattcacttgcgcaacacaaatttattaggcactgtattgggcactgaggacaaaatacagaacaagactgatagggtcattagtactttcctaacaagtaagcaaatacacagcaaatataaaaatgatacgtaacgtttgctagtgcaatcatggaaataaaggcattgcagaaaataatgaggagagcagcacctgattttcatagggtagtcaaggatctctccccaaggaggtaaggttgaagccacgagctgaagaatgatgatgagctaggcaagcacaaagctacaggaagatgattttggacagagggaagccaagtgcaaaggccccaggacaagaaagagctcggcatattccagccgtgagcctgagccgagactggtagggtgaacaggagccaggccgcacaggggcctgctggtcttgttggggaagctggatctcccctccaagaaagtgggaagttgctcaagagctaccttctgaaaacattctctggcttttgcgagaaaactaaattccaagacaacagggtggaaacaggcagaccgcttagggaggctcttgcagtagtgtaaacaacagagaagggtgctgaagaaacactcacaggattatacatgttgctggaaggggagagaggcaagaagtgacaactgacctctgtcaatcgtgaggtcttgacttaacctcattctggcacgctgcttgggaaacactagctaggtttattaacccaactgtggttgccaccaacagcagctgctaaaccttcttctggttttcaacaaaaatcccccatatatcttatgtattcgcagctccctaagtcatcaaaccttcatctcatctgaaaagagagcctatctgtggcttgaatcactacaatgagccaaaaatcaatttataattttgggtaatagttctaaatctattttcaatcatgtgggggtgaggggtgttgagaggaaaaagtgaatgaagtttgagaaactagcaatgaagtctctcagtcaacaatttaatgactacaaaataaataaataaatgcactagtgtacccttgggtcccagttcttattcagttacacatctgttctgcaatagaatgagggagttaattacttttctatgacatgtatgtattttgtgagacaccacattgcaccagttaataatgatctaccttctgttgacacaaaacgtttaaattaataaaaaaatctaaatgatatatcacatagcaaagcatacttcactgaaaggctggatggcaggagtagtaattttcctgggtagaaataattgagatgagcttatggtagcatgaaaagctcaatcaataaagagacttatatgggcaaactgttttcaagagtacactctttttagaaagggtaggctgtgcttcgctaatagctaatgtagcagcactgtgattgttagagaaagaaactgagactgatacccagtaattgcccataattgacaatattagcaattttccatttgaatctgtctgttcaatctttagggtcagaaaagacaaatgtgaaaagggtaaaaacaatcccttgaagctctattaatactaaaaaaaatctttgtgctcttcactgagtgtacccttgtaactagatactaaaccaactgcattatggaaacagcctattttttccaaactgtataagcaatattaaatgaccttggaaaaatcgagataatatgtaaagtagactcccagcacaaagacggaagacatactctaaataaacttgacaagagtgccttgttcaagtctcaaaaccacccaaggaaaagtctgaaacccacaacatcccgtaattattttgctattttccacttattttgggttaaaaaacaaaagtctaccacttttctttcatttttaaattcattctcacttctttcttaaaaactaggggaaaaaaaccccaaaacatcaggactggagtcaagaagtttatttcctgtataataatttctttcttttggggtcccaacgctaaaagactattacttctttctgaccattcaagcccctgctcttcactgtccttcatggtttaaagcagcctttacccatgctggcccacagagtatcatgaaaggtccatggacctgacactgtaagaatttaggtacaaatctagcgagatgaatccttttctaattcttgcctatttttggcttttcagggagcttcatatactaggaacttcttctaggctattgagtacatagtaggtatttagtaaatgctggttgtcgtgggaagcaacagataaaggtgaaaatggccaaaacccagagtgggtgatgtaaaaaagaaaaattgtccaattttataaagtttcatgattttttttcctttagcggtaggatgtctaatatttctatttaatctcaaatattaaatttatacagggatatccaggtcagaggattccagaacttgaggattaggaagctttttagcaatgcagagatcagacagatgaaaaagactgttcttagaagacctgtacaaaacaaatgccaccatatcttcttaaaaaagcccaaaaggtcagtacatcgaatccaaatacctatagctgaagtctatttctcccaatcttagtgaggactgaaaactataggtctccctgaccatgatgcagcatggttgtctggggtaaatacccgaggttcattgtctcatgccagggtaatcgaggatgcagacacacaaagtgattttgagaacggaggtttaatgggcaaaagaaagagaaaagagaataagctctctcttctgcagggacagagaggaaccggagtggtccttccggttttgtggtgaaatgcatgggggtttttatagacaagcttgaggaggcagtgtctgatttacatagggcctgagagattgggtggaccaggtgtgatgtttgcatagcacctgaagaagctggccatcccaccctaatcttttattatgcaggtatctatctgggaggtagccatgttgtctgttccttactgtacacgtgattgacaaaagggaagatggtgccactgagaggtaaagccagcaggactttctgggttgagtggggacttggagaacttttctgtctagctagaggattgtaaatgcaccaatcagcactctgtaaaaacgcaccaatcagcgctctgtgtctagctaaaggattgtaaacggaccaatcagcactctgtaaaatggcccaatcagctctctgtaaaatggcccaatcagcaggatgtgggcagggccaaataagggaataaaagctagccacctgagccaacagcggcaacccactcgggtccccttccacgctgtggaagctttgttcttttgctcttcacaataaatcttgctgctgctcactctttgggtctgcactacctttatgagctgtaacactcaatgcgaaggtctgcggcttcactcctgaagtcagcgagaccacacacccactgggaagaacaaacaactctgtacacgccacctttaagagctgtaacattcactgtgaaggtctgcggcttcactcctgaagtcagcaagaccatgaacccaccggaaggaagaaactctggacacatctgaacatctgaaggaataaactccagacacaccatctttaagaactgtaacactcaccatgagggtctgcagcttcattcttgaagtcagtgagaccaagaacccaccggaaggaaccaattccggacacaccaccatgttgaacatgcctggcccccaggtagccttttcttattggcacagctgccagcattcacccctgcaagcttccagcttgcttgtctatgtctgtgactcgattttacaggctgttctttgttagaaaagatgtgatttggggactgcttttcattaaagggaaaaccttaccgaggacttccttaccctcactatctgcccaactaatttctttttaactcctatatcaaccagataaggcccctcctttctcctgcaggctgaagagtttgtatgcccttagtctttctttaaagtcttacttttctacagtgtttctctattagaggttctctctgtccctttttaagttatggggccactatatagttatggggcagctgcataaaaacgttcatggtcttttcttgagctaaaagacaattacataaaattaaggaggttagtatccacaatttttacaatgattttaactgaccttattcataacatgaagtagttgtaaaaagtagatattcatttaatatgatgtcaaactaaggtaattttcctcatcctctgaggctgcttgttactcccattggagtactcacccatgttgaacgcaacctaattgttcagaaataattaacatgtttttatttcagttgtagaaaacataatttattaattggctgctactttatgtgttccattttaaaaggcacaataaataagaaattagcataagaaggtattgaaaaaatgccaagattgactaaattctgagaaaagcaagataattccaaattaaggatgagtaaatttattacataaaggagtttaatgacaaatgtggagacaactgttttatgggcctttagctacagctttccaattttaatgttatagacaggaaaacattatcaacgctttcataattccaggattctaatttacatatcaaaacaagagaaagagaaagcccacatctctccttacttattagagttctcggggtctgaaaacggcttgtcaacaaaggttgaaagaagaggaagcagaagatatgctgatggctgcaactgaagcaatacaatatcctaattactgggaagtacagctagtttagagaccatcacaccctcacctcagcaattaatacccagtacaattggtaaatgttctaatctttaatagaagcacccagaaacagcctgtaagcagatgagtatttgaaacaaaccgtttgccatatccccgggtattaatcgaacccaaaagcatctcattctttgtgggggaggaagaaagctgccatcatagatatgcataagcagctctctacaagctcttcttctgggtgtaatgatgtgaaaaccatgctaatttccttgcccgatatttgaattttttattcttcatgcaatcatttctgacttcttggttctacacacactcacgtttttctggctattgcgggtcgaaaggccaacctcactgttctaacaatgacttcccatccctccatgatgaaaatgcaaaccctctgcccagcataggccatccctcaccacccactgctggccttaccagcctttatcctccagcaatactaaaccattagctgttccctgatgcgccatattctctcaagcctctgggacatttcacagggtgtgtccctgtcagaagcatgtgaaccagagcaactccatcttgaataggggcctggtaaaatgaggctaagacctactgggtggcattcccagatggttaaggcattctaagtcacaggatgagataggaagttaccacaagtaacaggtcataaagaccttgctgataaaacaggttgcagtaaaggagctggccaaatcctaccaaaaccgagatggccatgagagtgacctctagtcatcctcactgctatactcccaccagcaccatgacagtttacaaatgccatggcaacgtcaggaagttaccctatatggtctaaaaaggggaggcatgaataatccacccctcgtttagcatatcatcaagaaataaccataaaaatgggtaacccgcagcccttggggctgctgtgtgtggaggagtcattctttattcctccaccttcttaataaacttgctttcactttttggactcgccctgaattctttcttgtgtgagatccaagaaccttctcttggggtctggattgggaccccttttccagtaacatccccagactgaatctctttgaaaccatctcaatgaaaattcctatacaacctgtacatctcaggtcaatgtctcctgtgaagtctttctagactgaccagggattttttttctctttcattgccactatacttcaaacaggcttccagtaaaatcactgccacaccaaattaaactgtgtctgggtatctatctccacattagaatggaagccacctacaggaaggggacatctttcaatctcaggattcccatggttggcctatgatatatgtctcacatcatgaaatacttgaggaagaaagaaagggacaaaaggagagaaacagggagggagggagagattcaagcaggtttgctgaaagactggagatgaaaatggtaattatgggtgagtaataagcaaaaaaaaggagacttaagtctatttaagccctaagcaatataagacgccttatttccagagagttaatgttcaagctataaacagaaaagacttattcctaattctagtccttgttggggtgagtcagggctccctggactctccacagcagctaatgcttcagtctcttcttacatgatagacctgtcatggagtctcacccaagtgggttgtaaaagcactggccaatgtcagtctagggtcttaaatggacacttaaatatactaaattattcagtagtaaagccaacccaaaatatctatttttcctgtttatatttctagaattctaccatctaaagggcttgagaaattggacaaagatagtatgttaagtatttgaaaatgaatacataaatggaagtgatctctcaagaaaaataatgtaaataaataaataggcctaaaagttccctcttgatgttattttacctttatttaccttttaaccttgcttccacaaccaagggcagtacccacagtgctttatcaaaagagcactgccccagaattatgatacttgtattttctgggccggattgtccagcgtcactctatttgtgagtgacacaagtcatttctcctctctgcaaaatgctgatattgacctagatgcctaatgtttcttctagctattcaaatttaactgactttctgacaaaccacttagcttgtgtgatattcgatggatctaagtacaaagtatgctctctcacgtctaccttttaagctctgaaggtatgcaatcaataacatgcagaaagagcccaatctgagtgtcatttcagcaggttttaaagacagagtgaagaaatgcatgtgttctacatcaaccatgtctacctgaagcccaacagcaacttctcagagcagggaaagagaaagtggaaccacatttggtcacctaccatccctaatacacggagctgcattacatactccctgtagcttaccaatgccaccaattccccagcttcattcttccaaggatgcaatgtcactagagggcgcagttaatgactatataaatagtgagccccaagatagttattgtgaaatttaacctctttccatatcccaacagtgagctgttagtggaactttgtgtggcagagacctatagaactccaaagttaggtaaggtcaaacatgtcatgttttaaaggctttgagcatgtactatggaccaaaagcataagccttcaagttcactgttgagcccgattaacagataaggggaaaatgtactttttgagaaaaataaataggttatttttgcatggcaccatgttctcttaatttctatagagagtgagataacagaagtgactagaatacctttttctccttctaggacatccttcccattgacactggaggggccaactacatgttttaatcagagcccacagctgcccacacccactgcagagtgagctactctccaccaaccctgcagccctgaagtttctgtgaccactgaagaggtctgttttcagacttagggtcaaagtgtgggtgacctccaacacctactgtaatgaaggaataaatgtcaatagaagccttgtctggtctctgtcccaaggcattttattatttgtttcattgtgagattccaaatgtggtcttactcagaaaagaacaataattcttacatggcaaattctgaaagaggcatcaatgcaatccctctcaaaataccaatgacattcttcacagaaacagaaaaactaatccccaaatttatatggaaccacaaaaggtccagaatagccaaagccattctgagcaaaaagaacaaaactgaaggaatcacattacctgacttcaaattatactacagagctatagtaaccaaaacagcatggtactggcataaaaacagacacacagaccaatggaaagaaatagagaatccagaattaaatccatacatctgcagtgaactcatttttgacaaaggtgccaagaacatacactgggggaaggatagtcttcaataaatggtgccgggaaaactggatgtgcagaagaatgaaactagatttctatctctcactatataaaacaattaaccaagatggattaacgacttaaatttaagaccctcaaactacgaaactactaaaagaaaacactggggaaactctccaggacattggtgtgggcaaagatttcttgagtaacatcccaaaagcacaggcaaccaaaacaaaaatggacaaatgggatcacatcaagttaaaagcttctacacagcaaagaaaacaatgaacaaagtaaagagacaacccacagaatgggtgaaaatatctgcaaactacccatctgacaaggaatcaataactaggatatatataaggacttcaaacaactgaataaggaaaaaaatctaacaatctaacaatctgggcaaaagatctaaataaacatttctcaaaagacgacatacaaatggtgaacaggtataagaacatcccgcatcatcaaagaaatgcaaatcaaaactacaatgagatatcatctcaccacagttaaaatggctttgatccaaaagatagggagtaacatatgctgacaaagatgtggaaaaaaagggaaccctcgcacactattgttgggaatgtaaattagtacatctactatggaaaactgtatgaagggtcctcgaaaaactaaaatagaactaccattgatccagcaatctcactggtaggtatatacgcaaatgaaaggaaatcagtatatcgaagaggtatctgcacgcccatgtttattgcactactattcacaatagctaagctttggaagcaacctgagtgtctgttgatagatgaataaagaaaacatggtacatatacacaatggagtactagtcagccataaacaagaatgagatcctatcacttgcaacagcaaggatggaatgggaggacattgtgttcaattaaactagccagacacagaaagaccaacttcacatgttctcactaatttgtaggagctaaaaattaaaagaatttaactcatggagatagagagtagaatgatggttaccagagcctgggaaggtagtgggcaagggagggaacgggggatggttaatgggtacaaaaatataatcagatagaatgaataacatctactatttgatacaacagggtgaccagagtctacaataatttactgtacatttaaaaattactgaagaaatataattggaatatttgtaccacaaaagaaatgataaatgcttgaggcaatggataccccatttatcctaacatgattattacacattgtatgacagtatcaaaatatttatctcatgtacccataaatatacacgcctactctgtagccataaacattcaaaatttaaaaatacaaaaataaataatgtttacaaaagaggattggtctcttgggaaataaactgcagagacagcccaggatgacatccactttgtccaggaatctggggggaggggagcaatgacctggatgtgactctgtgcagtgccactcatgctgtcttcttactcagctgtacttcccttccttctgctatgtacaccccctcagtgacagcaatgtcgggaactgtaggggtgaagaggacagcacgagtagtgatgaaggacagtgatatgccccctaagtctggacaaaggtcagcttacttctggaaggagagcccaggttaggaagtgcaggggagcaagccaggaagaatacaagaatgaaaaacaagctgagctgagcatggtggctcacacctgtaatcccaacagtttgggaggcagaggcaggaggactgcttgatcccagaagctgaagactagcctgggcaatacagtgagactccatctctacaaaaatatttttaaaaattagcagggcatggtggcacacgcctgtagccccagctactgaggaggctgacatgggaggattgcctgagcccaggagtgagccatgaacacaccactgcacttcagcctgggcgaaagagtgacgccctgtctcaaaacagaaaaaagaaagaaagaaaaacaccaaccaccccagcacagtgaccactggaaccaaaccaaacaagaggcactaggcacaaaaaaagggggaagaaagcagagacaactaaaaattggaacaggaggagttaaaaaactgttaagaaaattatgtgaacaattcagagactctgatcagcaaatgatgggaactgaggatgctgtatttcttggaacctcccaaatagactatttccccagatcattcaataataataatggctaccattaccaagcatctaccatctcccaatctatacatatattatctaattatctaattgaacccttaaagtagctttgccaggtttagagtattctcattttacaaaagagaaaattaagaccatcacagggaaggtaacttgctgatgtcaaagggttggtcaacagcagaaaccagaaccatctatctgcaaagcacatgctctttccaccgtatcaagctgtcctcttatccaccatttggatttcatgtctctggccagttgctgatgctccggaactagaacccaacttctgctaaatctaactctgtactctttgtataatatcctgtggctttaaataagatattgactcagcaaatggtactagaatcattggctatccatatacaaaaaagaacattatgcatacacataaattaactgaaaatggatcaaattcctaaatgtaaaacctaaaactataaaatctaatatgaaacacagaagaaatatctttctcctcttgaattaggtaaagattttcagctatggcttcaaaagactgatccatgaaagaaaaatactgataaactaaactatttcaaaatttaaaacttctgcttttcattctgtgaagagaatgaaaagaccagctgcaaactgaggaaaaaaacatgtataaaacatatgtccaacaaaagacctgtgtacaggataaagaactctcaaaactcagtaagaaaacacccaatttttaaaataggcaaaagatttgaacagatatatcaacaattaagatgtacatgtggcacacaaacacgtgagaaaacacattacagtactgcaaattaaaaccacaatgcaatgttaccacactaaatgtattaggaggatgaaaaacaaaaagaaaatctgacaaaaacaagtgctggtgaggatttggggtaactggaactctgagtcattgctggtgggaattcaaaacaataggggctgctttgaaaaaaagtgcagcaatttcttataaagttaaacatatatttaccatagagcccagcaaccccactcctaggtatttgtccaaataaaatgaaaacttatatttgcacaataacctgtatgtgaatgttcacagtggctttgacaaccaccaaaactagaaaacaactcaaatatccttcacttagaaaaacaaactatgaaatagccatgtaatggaatactacttggcaataaaaatgaaccaactattgaggttatatattataaatgtgtgtacaaataacatggctaagcaaaagaagccaaatgaaatggctggttaatgtatatgatattgtggaaaaggtaaaatggtagtgacagaaagaagatttgggttagcaggtgctgggagtggggtatagacatggatacaacgcagtacgaaggaatttgggagtggtggtgatagaacgcttctctatcttgatggtggtggtggtggttgtggtcacagactgcatttatccaagtttgtagaactgtacactaaaaagggtgaattttactgaatgcaaattacactccaattctttaaaaagatagggaaggtctatctgttactcttatcactatagaaacagcatagtgaagaggttagggctatactcttgaaagctcccgttgcctcatctgtaaaacggcagtaagagtaaccctaactttgatatggttgtagagagaaatgagatgaggcatacagagaagtctgcagagtacctcgtgagaggtgaagccagctggacttccagggtggagtggggaattggagaacttttctgtcttacaaggggattgtaaaatgcaccagctggtgctctgtagctagctagacgtttgtaaaatgcaccaatcagtgctctgtaaaaacgcaccaatcagcgctctgtagctagctagaggtttgtaaaatggaccaatcagcaccctgtaaaatggaccaatcagcaccctgtaaaatgaacctatcagcactctgtaaaatgaacctatcagcactctgtaaaaggaaccaatcagcaggacatgggtggggacaaataagggaataaaacctggccaccccaaccagcagcggaaacccgctcaggtccccttccacgccgtggaagcttttgttttttcactcttcacaatacatcctgctgctgcttactctttgggtccgtgccatctttaagagctctaacactcaccgcaaaggtccgcggctccattcttcaagtcatcaagaccatgaacccaccggaaggaaccaactctggacacactagcacacaataagtgcccccataagctttagcaggtattctaatttccagtagtatctgaggaagaatcaccttattgtactagacttcctgaacactactgcgtacctgtggaccatgtgttgggctggggatggtacttggtacacaagaacacatactctgtatcacattagctgccatccctcaatctatcctctgagctggaggcttatgaagccccaaagatggtagaaaagaatgtgtgtgcaagaactggaaaggtgagacagaattcacgacaccacaaattgtggagagaccatcttttacccgaggtggacataacagggccacgtgaaggagcctggtgagcacagctgcctgtcctctggggagaaggcagagaagaagtgccacatcctgtgatgtggtgaacgccacagtccaaggcaaacacaatagctacattgtttatctctcagccaactttacagcccatcgtagcatgcccagaagcctctccccgtatgtcatagcaacactgcagacgggattatgtgattatgaagtcagtaactcccttccttgattaaacatgaactcaaacagacagtcattcactctgggggaaacccatttttctgcttgtctggagaagcaagacacaggtaacatacagcaatgttaggtttcaactaattaaaaatgggaatgaacacacgcacacgcacgcacacacttcttcagttccctgtcaaatcttcctgaggacaacatagtttggttatgatgaaaactttagaaacgggaaacattctgcttagattgttaaaattgagaacaacgcagagctggttgggctcatcatcccaccaggagacagttctgcttacaatttatctagcaaaatagagtaaggcagcagaaaaaatcttggtttcctagtgacctttaagtaagtgctcccatttcaaatagactcagtaccataaaaactttcttgggctgagaactttcatttcctttgaatataacttttgcgctaacattctttcatttcttcttcttcagacaatcattgtttcttcctttcactcaaacctgcctctgttccccggttttcacggtttacagggcatagcccaggtgatgtacagcccacatgggaatcaaggcagttcccacacagcaccagcacaaagtcatttctttgtagaagctgggcttcttcagggctgtgtaactcataggtgtcgtggagggtctcagaaggaaacgagggaaggcaattctgtgttgcagaaaaagagtttttctaaaaagaagctgaaataattaccagagacaaaaattaacattgctttatatttacagaagaaactaagaggaagtaggcttagaattgtagcatcagggaatgagaagtttattaaggcttctccccactacagaaccatttattaaactgtttccagaatggatacattttcacaatgatcctactcaatctctcttcatagaaggctctgtgataaaagaagatatagatcccctgctccacagacggctgacactgggtaaaagatgcacacatacttggaagccctcaggaaaattagatcattatcttctcgttttttctttgcctccaaagacttagatttttacctatgtactcgaaaagcaactgcagacttccaatcaagatgctgtaagttcaaacctggaagcgttcccttctactccaaatccatagtaatgacaggtaaaatataaaaacaggaaccaaaaatagctttgccaagtcaaaaaaaaaaaaaaaaacaggcaatgatctccctggaccaaaaatagaacagaaatgcaaagcaataaacaaagctgaagctccagggcctgaggtctggaagtaggtggcagtaggtacaagctgagtgctggtggttaaacagggaatacaaatgtttcacataaaaatggtgagtacagtcaaccttaaagcttaaagccagagaatggggtgaggctaccttgcttgacaaaagaggccgggataaacaaaaccagggctgatgacctgttcccctgtgctagatatttacaggaagctgtgggcctgaaggggccaaacagagccatgctctcttgtctaggtacacagccatgacgcccaccatctaggcaacacttctgcactagcctcagcatcaccggggcgcaagaggtccaaatgccattaagttctggttttgaactggaggctgaggggcttgggggaggcaaaactaccagacagaagggaagagcacagaaggagtgaaaagaacaaaacaaaaaaactgtccactaaaaatgagcctgccatacaaaattccagaacactgagtgaaatgcaatgctaaccaactgaaaacaatcagaacataaattccctccagtaaaataaacttcatggaactaacacttaaaagaagtgtgattagaatacccaaagagatgaataatgtagtagcatgcattaaagtaaaaaagaagttataaaaccaaaataggcagaaataaaacacagagacgtgaaaaagaacaaatttgaaatcttggaaataaaaattggtctttaagctgaaccagtaagcagaaagtatccctagcacctgacttaagggagctctaagtttaaaaacacggacaaaatgccagaagctaaaatgggttctctctgaggagtaggtcgtgggcaggagcaagagaggaaaggggtaccattgttttcaactgtgttagagtactttaatttttcaaactatatacatgtattactttaataaaaaatcaaaataagaaatgtaaaagcccatttgcaagaaataacactagtgaaggattacctgaaggatttgcagtcactgctttcctccatagagactaaattgtattcttggaaagaaacaaaccatcaaagagatatgatcttagattacctaatttttcacgcttctagttacctcttttattaagaagtattaatttggctgggcacggtggttcacacctgtaatcccagcactttgggaggccagggcgggtggatcacttgaggtcaggagttcgagaccagcctggccaacatgttgaaaccccatctctaccaaaaagtataaaaaattagccaggtgtggtggtgcgcggcgcctgtaatcccagctattcagggggcaaggcaggagaattactgaaacctgggaggcagaggttgcagtgagctgagattgtgccactgcactgcagcctagaagacacagtgagactgtctccaaaaaaaaaaaaagtattgtcaatcagctatgatgaagaatattatagaaatcagtgatttcactcgctgtggaagtccagtaagaatgctttgtgagtgcctcaggcctcagtgcagggaaaaactgctctggctgtgttttccttcttagggctactgtgaattttgaaagtagtcttttaggtttggctgctgatacattaagggtaaattcatcatttttctagctgttatatattgcttctaggccttttggttaagctcaagtgtagtacttctagctgttacataaaggatcatatggtataaattctgcatactaaactactttcatcttatttgtcacttttatttctcaaacgaaaataaaatttattgctgttgtattacatatgcaagtagatacatatatacatgtgtatgtatccttgtgaatgtgtgcgtgtaagctacttcaaaatcttttgggtggaggaaagggaacaattagataaaggaaattggtattttgaaacagaaaaagggaacaaaagcaggttgaatgttagggtcgcaactagagagcactgaatggcaacctatgagtatgaagttgatcctgagtgctaaagataatgctgaatgcttgaacatttctgagcaaagtaacaacatgagaatagtggcatctgagagagtttacctaaaacagtgtgtgccaaggatgaaaagaaagaaattgagagcccggtgaataatcaggggctatttcaataacctagcagtgaggcaacagagctttgatagactgatagacatggtgtttcaaaagaattaactctaacaggacttaggaaagaaaaattgacatggcaagtaatcatagcttgtttgttttttgcaacaaggcatgtgacatccaaagcagcacgctatgttcttgccacaaacttatggaaacaatcaattccatttggtctgttcagctcctattgccttggattctgacctgggcaagccatgaggacccaaatcattcaaaaacctccctcagaaggtaagttttatttttttccagaaattaagctgcagctgattacaaatgacaactgtaaatatgcaaattatacttgctattaaaagggttcctgccttcctgaaacaaaatactgtgtaagtccaataatatgcagatgtagacacataataaatattgcttgatgcagaaaactggtgagatgaattttctaggttccaagaaaagcagaaaaataagcttggaaactttaaatccaggaactgaaaattaattttgattgaactaatgttgaatttatgatcttttgggaatgcactaagctgaatttacctctgtatttttttttgaggcaaattgatagtacagagatctcagaggagtgtttatatcactaaacaaaattctcaaatagaaacttaaaaatacaactgaaaaattagttgcaaactaagtttatattctcatctaagtacatactctactctcttccactagaaaatatttcatggaaacatgggaaaacaggagcggggaggggccctatggctgtctagtgtaattctttaatgttacagaggatggaacgaatccagagaggttcaatgacttgcccaggaccattcaatgtgttagatacagcatggactataatccagcagagtaatcaagtactgttttcatgacaccattagacccatctcaatattttaatggtcaatgttatatgttaacttgagtgggccacagggtgcccagatatttggtcaaacattattcatagagtgtctgtgagagtatttctttatgagcttgccattggaatccacagactcagtaaaggagtctgctctctctggtggcacttaactaaccagctgaaggcctgagtggaaccaaaaggctgcaattccctcaagtaaaagcaaaagagaattcctcctggcttactgcttgagttggactgatcagttcttcttggaacttgggcctgccagcttttggaacagaacttacaccactggctctcctggttctcagggcttcagacttgtcctgaaactataccatggctcttctgggtctccagcttgccaactgcagatcttgagacttctcaacctccataatcaggtgagacaattccttagaataaatctgtttctccaccccatcttgttggttctccttctctgaaaaaccctaattttaatattaaacgaatctttagctcaatagagtaaagaaaatggtctcagtgggtatggtagacattatgcactagctacccaaaatccatttaacacctctcttttctcttgacttcctcttgcataaaggctaaaaagctaaaatacagttcctagcctcttctatagctaaaggtggccatatgacaccattctgaacaacaaagtaaatgacatcatttttgagcaataaagtgtaggtagatatccttaggaggtcttccctttgctctttgcctcttattaccccatcttttttctccagagcttagatacactgactggggtttggaagcatcagtcatcttcagactgtaaggacaaacccacatgctagggatgactatggaggaagacagaaggatttcaggtccatgatgagatctatgagtcgctgctgtcatcttggattacttctccagaatttttagaacatgcaccccacctactaaagctacgtttagttgggctatctgttatttatagccaaatcctttcctaatatactattgcagcccagatgtcacctgttacaataaaactaagatcactatgacccccattttaataaaagatcatcattcattcactcaagaattttctgaagatccaccatattcatggcacctaagaggaactaaattcaagagccttctcatttccaaccaaggatgctggtggaaagctaccttgctaacattccagatcatggtctgggaggaatcccagggcagtttcccatgatttctgtcattcttgcctgtggcaaaaggctaacaataaagtagattgaatcttcaggagctattagaatattcaacttttcccacttaattcccttattttcaaaagttcttcttaaggcaaaatggatcatgttcatggactcctgcagcattagaatgagctcagggtcctttctcatgcagtgagagcaactacctctcttgattcatgttgccaatgggagttacagtgagttgtggtatactggcaggagcattaggtttagtcatgacatctgggtgtcagacttggttttgccactttttcctttaagtcccaggggtaagtcctgggataagtctcagaggcatatctctgaacctttccgagtttcacttcctaatttacttataattactcagaccaagaaagataacaattacgaaagaattctagtgaggtaaacattcttccaaagtaagatttctttagacaatctgattatgtgaaatatttcatattggacctaaaaataagtaggtccaacatgaaaaaggtatatgagtaacagaagaaaagtccattcattatcttcatggcatttactttgtctctcctttctcagagtaaaagttgttacataagtgatctcaatctaataatgtgctgcagtggaaaagccttatggagcaaatgttaaagaaacagagagacatcatcaagatggctgactagaggcagctggcactcatctcctccaccaaaaagaaggaaaacagtcagcagataaccacaggttaaacagagcatctaagagggaacaatggaattcagcacaaaagggacagggactctccaaggcacagagaaagagggaagataagcagcagtctcagccgggattggctcagagccaggaaaggctccccattgtagggaaaaggtaagcaagaaatctccagttgtccacattaccaccacagatgcctgccatcctagccacaggagagctgctcagcttcacaggccctgagcctagtatagggagttgactggagtccatcatggaattgttcccaagggcattcatgctgcattctagtcacccctcaggacccaaggtgctgtggcatggcaccattttaagagcccagcaacaaccagactatatcctgccctggaccccagaagcccctccattccacatccctggaatgccactgatattcccccatatccactcagagggctgcagtatcatgaggccagctggaccaagtggtacagccagatatccagtactctagcccacactgtgtcctataccctggggaccagcagaaccagtgcaccagggaggctgcccccatgacaaatggagctgaagcacattttcctcaaagcatgggagctgcctgcctggggccactgccacctacagcgatgccaccccttccaaggacaaggccaccacacacctgtacatgccttcaggggacctgagaaccagctctctggggcacaatgtccagaggccccatctgtatcctatctgggggctggaagataggataagcctgcacatggcatcaaggaaattgaggacaggcctgggtcaacccatctccagtggtgccatatgcaccattacaaggcctgcagacagtctcatgtcatttagacacctaaggaccagaatgcctggcccactgccaccatcaccagtacctacatgtgccaacaaggggcctaagaaccagcccacctggtgtctccatccccagcaaaggttgcccaagcctccactaacaatcacagcctaagccactaaagaacctgtgatcactgctgacactgattatggacaaagaaataatatgaagaccacagtactgttcctacccaaaatcagagctaaagaactctacccaacaaatactgtaaatatatctacatgaaaaagtcattctctatgaaagccaatccaaaaacttagaagaagcaattatgacaccagatgcacagacgtaaggacacgagaaatgcgaaaaagaaaacatgacacctacaaagcaacacaataattcttcagaaaaagatatcaaagaaaaggaaatctatgatatgcttgaaacgaaatgcaaaataatgacctcaaggaaactcagtgatatacaagagaacacaggtaaaacaatatgaaaaactcagaaaagcagttaatgatctgaataaattcaaagagatatcgtaaaaagaaccaaagagaaatcctaagactgaagaattcaatgaacaaaattaaaaaatataatcgagaagcttcaacaataggctagatcatgaagaaggaatttctgaattgaaggcagagcttttgaaataacacagtccaaaaaaggtgaaaatctaacaaaaaagaatgaagaaagcctaagtgacatatcggacatcataaagtaaaaagtattcaaataccgaaatttccaaaaggagaagaaattataaaagtcagagaaaacaggcagagcaagatgctggaatagaaagcttcaccaattgcccccacccccacaaggacaccaagttaacaactatccacacagaaaaaaacaccttcatgagaaccaaacgccagatgagcattcacagtactggcttttaacttcctattgcgaaaaggggcactgaagacatagaacaaactgtcctgaatcgccagtgccacctctccctgacccccagcagtggtgcgtggtgacaagagcatctctgggtgctagggaagggatgatatagtttggctccgtgtccttacccaaatctcatctggaattgtaactggggcttgcatcccctgaaataacagcctgagctgtaccttggcctcttttacccacagctggagcaggtgggatgccccaagtcccgaggctgcacactgcaggggggccctggaccctgcccataaaaccattttttacctcctaggcctctgggcctgtgatgggaggggctgctgtgaaagtctctgagatgccctagagacattttccccgctgtcttggtgattaacatttggctccttgtttcttatgcaaatttctgtagccagcttgaatttctccccagaatatgggtttttcttttctaccacatcgtcaggctgcaaatgttgactccatgtctcacatccaggtcatgtggggattatgggaagtacatcttgaattgtaatccccataattctcacaggtcaagggaagaacctggtgggaggtgattggatcatgggggctgttttcctgagacgggggtgagttctcatgagatctcatggttttataaggtgctcttcctgctttgctcttcgttttctctctcatctgccaccatgtaagacatgcctcttcctcttcactatgattttaagtttcctgaggcctccctaaccatgtggaactgtgagacaattaaaactctcttctttgtaaattacccagtctcaggtaatatcttcatagcagtgtgaaaacagactcatacaaggaagaatacagcaattgtgaggcactgaactcagtgctgtcctgttagaggagaaaggaaaagcaaaccaaactcacctgatgttgcccacagagggagcatttaaactagccctagccagggggcaatctccaatcccagaggtccgaacttgagtgcctgcaaacctcaccactgagggccaaagtactgttggcctctaagtaaacctgaaaggcagtctaggccataacgactgcaactcgtaggcaagtcctacagctgaactaggcccagagacagtggacttagggggcatgcgacatactgaggcaccagctgggacagccgagagagtgctggcgtcacccctcccctggccccagggtgcacagcacctggctccaaaagagaccccttccttctgcttgaggagaggacagggaagagtagggaggactttgtcctgcatcttggataccagctcagccacagcaggagagggcaccagcagagtcgtgaggcccccattccagaccgtagctcccagatgacatttctagacatactctgagccggaagggaagccgctgccttgaaggaaacaacccagtcctgccagcattcatcacctactaactgaagaacccttgggccccgaataaccagcagtgacacccatgaattacatcgaaggccttgggtgagtctccgggacttgctggcttcaggtgagactcagcacataaccagctgtggtagctacagggcaaaactccttctgtttgagaaaagcagagagaaaaataaaagggactcaactaccaacatcttaggtaccaagaaccccaagaatgggttcctggggtccctgactccaagacttgagtcttagcatttctgggcctgccttcggccggagggcagtcctctcccctgactagagtcccaaatccctgcaacattcaccacgagctgactttagagaccttgggccttaagggaatgttggcagtaatctggcaatactccatgtggccaggggtaaaggtggctgcggggtgaggctcctgtgcctttggaaaaaggagggaagactgagaaagattgagtcttacagttttagtgccagctcagtcgtaatacaaaagaataccaggtagacttttaaggtctgactcccagacagtacttctggacccacctggggcctgggggacctcatggccctgaagggaagggcataggccttgctggctttgccacctgctgattgtagagccccagacccttgagcaaacacagtcagcagccagggagtggttacagcaggtcttgggcgagacccagcactgtgctggcttcaggtctacataaaagcagaaacatggaacaatggaacacaacagaaaacccagaaacaaatatacacacctatggtgaactaatttttgataaaagtgccaagaacatagaaaagacagtctcttcaataaatgatgctgggaaaactggatagccatatgcaaaagaatgaaactacaccactatctctcaccatatacaaaaataaaatcaaatggattaaagacttaaatctaagacctcaaactataaaactactacaagaaaatattaaggaaaatctccaggacactgggctgggcaaagatattttgagcaataccctataaacacaggcaaccaaagaaaacatggacaaatgggatcacatcaagttaaaaagcttctgcatagcagaggaaacaatcagcaaagcgaagagacaacccatggaatgggagaaaatatttgcaagctacccatctgacaaggggttaatcaccagaatatacaaagagctcaaacaaatctatagaaaaaacaaatctaataatctgatcaaaagacggacaaaagatttgaatagacattgctcaaaagaagacatacacatggcatacagacatatgaaaaggtgttcaatatcactgtcagagaaatgcaaatcaaaaccacaatgaggtatcatctcaccccagttaaaatggcttataataaagacaagcagtaacaaatgctggtgaggatgtggagaaaagggaacccttgtacactgttgatgggaatgtaaattaatacaaccactatggagaactgtttggaggttcctcaagaaactaaaaatataactaccataggatccagcaatcctactgctgggtatatacccaaaacaaaggaaatcagcttatcgaagaggtatctgcactcctatgtttgttgcagcactgttcacaatagctaagatttggaagcaaactaaacgtccatcagcagatgaatgcataaagaaaatgtggtacatatacacaatggagtactattcagccagaaaaaaatgagatccagtcatttgtaacaacatggatggaaatgaaggttattccattaagtgaaataccagtctcagaaagacaaacatatgttcttacttatttgtggtatctaagaaaaatcacacgttcttatttatttacttatttattactaaaaaatcacatgttcttacttatttgtggtatccaaaaatcaaaccaattgaactcatggacagagagagtagaaggaggcttcccagaggctgcaaatcgtacgtggtttacaggggacgtgaggatggttaatggggacaacagaaatagaaagaatgggtaagacctactatttgatagcacaatagggtgactatagtcaatgattacctagttgtatgttttaagataacttaaaaaatgtaatcggatcgtttgtaactcaaaggataaatgcttgaggggatggataccatattttccttaacatgcttctttcacattgcatccttgtatcaaaacatctcatgtactccataaatatatgcccctactatgtacccacaaattttttaaaaaataaaataatttaaagtcagagaaaacctatttaacgaaataacagccaaaaccaaaggaattcatcaccactagactagctctaaaaaaaattcttaggagagtcctatatccagcagcaaaaggacaatatttgccatcatgaaaacacaccaaagtagagaactcactgatagaacagatacgcaaatgggaaaaagaagggaatcaaatgttatcactacagaaaaccaccaaactgtaaaggcaaacaatacaagaggaagaggagaacaaaggatttacaaaacaatcagaaaacaatttttaaaatgtcaggactaagtcctctcatataaataaccataactgtaaatggtttaaattcccccaattaaaagattggctggataggtaggaataacaacaacaaaaagaatctaactatgtgctgcctacaaaaaaaatcacttcaattgtaaagccagattaaaagtgaagggatggccaggcatggtggctcacgcctgtaatcccagcactttgggaggccgaggtgggcagatcacgaggtcaggagatcgagaccatcctggccaatatgatgaaaccctgtctctactaaaaatataaaaatcagctgggcgtggtggctcgtgcctgtaatcccagctactcaggaagctgaggccggagaatcccttgacccagggagttggaggttgcagtgagctgagatcgcgccactgcactccaacgtggtgatagagtgagactccatctcaaaaaaaaaaagtgaagggatgacaaacaatactccacgcaaacagaagccaaagctgagcaggagtagctgtagtgtatcacacaaaatagacattaagtcaaaaaacaaagagagacacaaaaggtcattaaaaatgataaaaacatcaattcagcgataggatataaccattgtaaacatatatgcgcccaaactggagcacccagatatacaagacaaatattattagggctaaatagacagagagaccccaatacactaatagttggggacttcagcagtggacagatcatctagacagaaaatctacagaaaaatatcacacttaatctgtaccacagaggaatccagcagatgtttacagaacatacatccaacacctgtagaatatactttcatctcatcagtaaatggaacattctccaagataaatgatacattagtcctctaaacaaggcttaacacatttttagaaactgagatcatatcaggtaccttttcagactgcaatgaaataaaactagaaatcagtaaaagaaactttggctgtacaaatacatgaaaattaaacatgcttcttgggtcagtgaagcaattgagaaaaagatcaaaaactttattcaaacaaatgaaaatggacatacaacatatcaaaatgtatgggttacagcaaaagtagtgttaagatggaagtttatagcaataaacacctctataaaagaggtaggaagatttcaagttaaaaagtctaacaatgtatctcaaggaactagaaaaacaagaataaaccaacatcaaaattagtagaaggtaagaaataaagatccaaacagatctaaacaaaacagagattaaagaacaatacaatacaaaagatcaatgaaacaaaaagttttttgaaaagataaacaaaattaataaacgacttgctagactaagaaagaaaaagactcaaataagtaaaatcagtgaggaaaaaggggacattataccagattccccagaaattcaaagcatgattagagactgttagcaacaactgtatgccaataaattggaaaacctagaagaaatggataaattcccagtcacacacaaactaccaaggttaaaccgtgaagaaaacagaaaacgtgaacagaacaatagcaagtaatgagatagaaacagtaataaagcctcccatcaaagaaaagcctaggacctgatggcttcactgctgaattctaccaaacatttaaaaaagaatgaataccaattctactcccactattccagaaaaattaggaggaggaaatacttccaaagtatatatataaaaccagcattatgtaaaaccagcattaccctgatgctaaaactagacaaaggcacaacaacaaaaaactaaaggccaatatcactgattagcatagacacacttttttttcaacaaaatactggcaaaccaaattcaacattaaaaagatcattcatcataatcaagtgggttcatctcagggatggaaggatggttgaacatatgtaaatcaataaaggtgatacatcacattaacagaatcaatgacaaaaccatatgatcatttcaatagatgttgaaaaaaactttcaataaaattcaatatgccttcatgatgaaaaaaatcttaacaaactgggtatgagggaaacatacttcagaaaataagggccatatatgacaaaccccaagctagcatcacacttaattgggaaaaactgaaagcccctcctttaccacgtggaacaagacaaagatgtccactttcaccacttttactcaacacagtactggaattcctagccagagcaattagacaggagaaaaaattaaagggcattcaaattagaaaggaagaattcaagttagccttgttcacagacaacatgatcttacatctagaaccaagagactccaacaaaaactgttaaactgataaattcagttaagtcgcaggatacaaaatcaacatacaaaaatcagtagcatttctatatgccaacagcaaacatctgaaaacaaataaagaaagcaatcccatttgcaacagctacaataaaatagcataaacacctaggactaaacttaataaaagtgagatctctacaataaaagtataaagcattgataaaagaaattgaagagaacataataaattggaaagatagcccatgtggattggaagaatactgctaaaatgaccgttctatccaaagcaatctacattttcaatgtaatccatatcaaaatatcaatgacactctgcacatgaaaagaaaaaggcaatccggaaattcatatggaacaacaaaagcaatcctggacaaaacgaacaaagctggaggcatcacgttacctgacttgaaaatgctctataaaattacaaaaagcaaagtaagcatggtactagcataaaaatggacatatggaccaatggaacacatgaaagaacgtagaaacaaatccacacatttagtcaatggagtttcaagaaagtcatcaagaaaatacattgagaaaggaaaatctagatagcccatatgcaaaagaataaaactagacccctatctctccccatatacaaaagtcatatcaaaacagcttaaatatttgaatataagacctaaaaccatgaaactactataagaaaacattgggtaaacacttcagacattgagctgggcaactacttattgagcaagacctcaaaagcacaggcaaccaaagcaaatatagaaacatgagatcaaatcaagctagaaagcttctgcacagcaaagaaaataatcaatgaagaaacaacctatagaattgaaaaaaaaatttgcaaagtattcattggacaagagattaataatcacaatatataggaactcaaactcaatagcaaaaaacaacccaattaagaacaggcaaaatatgctgaattcatagaaatggccaacagatatataaaaaaatgttcaataacattaatggtcagggaaatgcaaattaaaaccacaatgagctatcatctccccagttaaaatggctactataaaaaagtaagaaaataacaaatgctggcaaggatgtggagaaaggggaaggctcacacattgttggtggaatgtaaattagtacaaccactatggacaacagtaaggaggttcctcaagaaactacaaacgcaactaccatataaccaaacaatccaaacgttggatatagatccaaaagaaaggaaatcagaatatcaaagagagatctgcactcccatgtttattgctgcactattcaaaatagccaaggcaggggtcgacctaaatgtccatcaataagtaaaaaaaaaaatgccatatatatatatatacacacacatatacacacacacacaacggaatatagttcctctatgaaaagtaataaaatcctgtcatttgtagcaacatggatggaacttaaagacatcacatgatgtgaaatatgccaggcacagaaagacatatctcatgttctcactcatacatgggaactaaaaagaaggtgattttatagagatagtgaatacaatagtggttttgaggctggaaagagtagtaggtagagggattaagaggggttggttaatgcatacaagattacagctcaataggaggagtaagatctagtgttcagctgcacaatagggcaactatagttaatagtttactgtatatttcaaaatagctagaagagaaaatttagaatgttcccaacataaataaatttttgaggagatggatctcccagttacccagatctgatcattacacattgtatgctggtatcaaaataccacatataccacacaaatatgtacaactatcatatatcaataaaaatgtttaaaaagcaataaagagcatttaacttggaagaaatcacattgtcctccctttgcagacaacatgaccttatatacggagaaactaaaagactccaccaaaatacccttagaactgataaattcagtaaagctgcaagatacaaaatcaacatgcaagaatcagcagtgtttctatacaccaataatgaactacctgaaacagaaatcaagaaagtaatcccatttacactagctacccaccccccaaaaaaagacacctaggagtaaatttaaccaaggaggtgaaaggcctctgcaataagaactataaaacattgataaaagaaactgaagagaacacaaatggaaaggcataccatgctcattaattggaagaattaatattgttaaatgatgatactatccaaagcaatctacagattcaatgcaatccctattaaaataccaacgatattcttcaagaaatagaactaatgatcctaaaattaacatgaaaacacaaaagaccccaaatagccaaggcaataccgagcaaaaagaacaaagctggaggtatcacactacctaacttcaaaatatcccacaaagttatactaacaaaaaaaacatggaattggtataaaaacagacatatagaccaatggaacagaacagaaaacgcacaattaaatacacattatttataggcaactgattgtcaacaaaggcaccaagaacacacagtggggaaaggacacctcttcaattatttgtcatcagaaaagtggatatccacgtgcagaagaatgaaactaaacccttatctgtcaccacacagaaaaatcaaccaaaattaattaactactgtgagcctggaaactataatactaaaagaaaacagttggtgggactgtaaactagttcaaccattgtggaaaacagtgtggcgattcctcagggatctagaactagaaataccatttgacccagccatcccattactgggtatatacccaaaggattataagtcatgctgctataaagacacatgcacacgtatgtttattgtggcactattcacaacagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccggggcctgttgtggtgtggggggaggggggagggatagcattaggagatatacctaatgtaaatgacaagttaatgggtgcagcacaccaacatggcacatgtatacatatgtaacaaacctgcacgttgtgcacatgtgccctagaacttaaactataatttaaaaaaaaaaaaagaaaacataggggaaacacttcagaacattggtctaggcaaagattttatggctaagaccacaaaagcacaagcaacaaaaacaaaaatagataaatgagactgtattaaaccaaaatgcttctgcagagcaaaggaaacactcaacagagtgaagagacaactataaaatggcagaaaatatttgcaaattatgcattcaaaaaggaactaatatccagaatatacaaggaactcaaacaactcaacagcaaaaatatcacaaatattccaattcaaaagagggcaaaggatctaaatagatatttatctaacacatatagaaaaggccaataaaaatgcttatcagcaaccatcaggaaaatgcaaatcaaaaccaaaatgaggtgtcatctcaccccaatgagaatgactattatcaaaaagaccaaaaaaaataaaaataacaaatgctggcaaggatgtggggaaaacatactctcatactaggctggtgcaaaagtaattgtggtttttgccattaaaattaatagctacccactcccaaaaaaagacacctaggaataaatttaaccaaggaggtgaaaggcctctacaatgaggccactgccattacttttaatggcaaaaactgcaataacttttgcacccacctaatagtatagccattatggaaaacagcatgaggggttctcaaaaaactaaaaatagaactaccatacaatctagcaattacagtactgggtatttatccaaaggatagaaaatcagtatatccaagggatacctgcagccccatgtttattacagcagcactattcagaaaaactaagatgaaatcaacctctatgtccatcaatggaaaaatggataaagaaaatgtggcatacatacacaatggaatattattcagtcatgaaaatgatattctgtcattcatggcaacatggatgggcctagaggacactatgttaagcaaagtcagtcaggtgcagaaagataaaatactccgtgttctcactcatatgtgggaattaaaaaaaatggatttcatggaagtagagagcagaactgtgggtactagaggctaagaaggtggggagaggttggttaatgaacacaaacttaggaggaacgaatctgctcatctgcagcactgtagggggatatggttcactttattttattgtatattctcaaaacgctaaaagaggattttgaatattcatgacataaagaaatgataaatatatgaggtgacagatatgctaattaccctgatttgatactacacatagtatacacataattaagtatcactctgtatcccaaaatatgtgcaattattatgtgtcaactaaaaacaaaaggaaaaaactataaggataaaaaacagatcagcggttatcaggggttggggtaggggtggtagggttgactataaagggacatgagggcacttttttgggaaacgaaaccattctgtatcttgattttgatggcagtttcatgactgggtttgttgaaatcatagaactgtctcactaagtagggtaaattttttgcatgtaaattgtacctcaacaaacctgattttattttaaaaaacatttttaaagaaataaactaggtaaaacttggtatgttgtttaccgagcaataacttgtcaatcataacgtaattcaacccacttactacatatgttctactagcactctggccttcacccatccttttaattaaatatttaatgcctacattcccacttgactctaaactccacagatccttacctttggttaaatcggttaaatctcagcttggtgggtgacaaaagttccaggaaacaaaatatatgcagttcaatgagttatcttatttatctgtttcctaccatgtactgagggtcattacttttgggtttatgaaatctaggcagagttctctgaagatcattgagattttgccgtggaggtgtttcaatctggttccatactacataccttgtcctgggtttggcaacggaaacagtcacattcaaagcagtactggtccctcagctgcttccggcgctcctcactggtcatcagcatatccaggtagcagatggtgagctgtgcaggccagagagagggaagcgctgaaacatctgctgtgctcatttctttaacaaatggttattattattgctaattattggagtaaaacttgtttttattataaaccaaaaatataagagagaaggtactgcttatagtttctctacccaaatgatcacacgtaaatttttaatctatttcctttcagtctttgctatgtggtaaatatatatgtatcatatatttaaagaacgggtcttatgatctctacccacttttgtatcttagtttttttcactacaggaaaatatcaaaaactgttgtatgtttactaaggtttgctaataaattctataaccattagcaatcagagaagccaaattaatcctggcaaccgaaagggtggcagatgatacagccagattgctcttaaattctaaccaattctatagctgcctcatggaatttaaggtcatccaaatttggtatctttgaaatgagaaaacagttctcttatttgtatctaggtttggaaaaaaaagggggggtagaataatttccaaataggggagagtttaacttgagagtaccaccactgatggaagcattcaaactgactgccttacaccctttcagagtaatatcccctgcctcggatggtgaagggttataaatgagaggatatatttaaaggactcctcggacactctctaacactgagtcccattaagtcacgggtctttaggcaacatcataatgcttgagcattttgcacttgattagatctcttatgaaagtctaattcaaaatccagaaaacagaatgcttgatcttcccctcaacctgttccatctcggctagagcattctcactctcagttgacagtaactcatcttttgacttatccaagttgaagcctcagagtcatccttgacttcactctttcctttacacttgccatccaatccaccaggaaattctgcgggctccaccttaaaaactacccagaatcaaccactttttaccttttccagtgccaccatcctggtctgagccatcattacctctcacctgtaaaatgtaatagtctcacaactggtctctctgattctttctccaggccccctgcactccaccctctagccagagtgattcacataaaatatgtcagatgacatgttctgtttgaaacatcacaacagctccccactttgcctgagtgaaggccaggtccttctaactccccaagtgcaattcaaagtatggtccccgcattggtgccagtgcgcactgtgggttaccagtccatgacgacatgagtcaagaaacaaagtcaatatttagaaatgttttttactaatttggtaagggtaattttatgtgactctaataataaaacattgggctttaaaaaaaaaaaaaaagacagggtctcactgtgccaccaaggctggtgtgcagtggcatgatcacaactcactgcagcctcaacctcccaggtttgggtgatcctcccacccctcagcttcccaggtagctggggctacaggcatgtaccaccacactggctaattttctgtatttcttgtagagatggagtttcgccatgctacccaggctggtcttgaactcctgggctcaagcaatccttcctccttgacctcccatggaattacaggcgtaagccactgcacccagcccttcatttttctaataatttattttcactagattttataaaaatactggtctgcaatagattatgaaggaaaagaaaaactggtccttcgtcataggtagagaagcaatggcttcacataatcccacctgttccctctcatttcccagtttccctcattgctgctgctccaccaggctggcctcccgtctggctccacacacactcctacctcaaggcctgtgcactggctgttccctctgcccttctgccccgtttactatgacaacctccctcatcgcctttgagtttcagtcaaatcccactttctcgttcaggtctaacctcaatgccctattaagagtaacaacccaattcccttacctgctctagtttttcttttcctgtatcatatatcagcttgtaccagactgtagaaattacttctttgcttttaaaagtagaaagtaatcatggcggtatgtgtggtggggggagaagtgaagactttggcagagcaagaaggcaggattatccactgaagggatgcaaaaaactccctagagcagaaaactccatgtggtttttgttatacttaaaagaaagcatctcatgtctacaaagcatgatcttacttgtttgaaatcatagtagggcaaaggcagccaccctctctggcagaaaacaaagctttgggaaggactctctcaagctgtaggggtgatggtggatggctgggctggccagccagatctgtcaaatccaccatggccgtcaccatcaccaacgggacaggagtcacagcctgatctggctggctggctctccatagattcttcacattaggcaaccataacatgctgctccacacacagaaacaagaatatctgcccttaagagatacagacaatgacgttactgagtatctactgtttgtggcgaggcagcatagcacagtaaaaactggcaaaggtcttgggttcaggtaacactgaagactgcacccagatctcttgataagtctgatgctctttttacttttacatggctgcttctcatacttggcagggagagagggctgtagaagaagctggcgtcccttaaggagtgtccgtagcaccgtcaaacctaaaatactcacacctgtgttagagaatgttctgtggcaactgagatccttcagctgagacaacagccactttttgatttcctccatgtttctcttgcttcatgatctgaagccagggttgcctctgaggcacaaagggtcacctataccaggcaagttcctcttgtttctaatgaatgctatgttccaaattccaaataacctatttccaagctcactttttgaaacagcctatgagtaagtctgggacagtagatagattcatcttatactatcaggctctgtgggtcccagtttccttacaggaggtgaggtagcaaatgagcgcatccctatgtcccctcttgggttaactctaggacactaattctgaatccagcccaatggctcttagtcatcaactcccattatcagagcaggtaaatggacagtagttattgggagattacagtgtgcccagtgtgaagccactaactccagggcctgtcatgccagaaaaaaatgtgcttgactaacccaagactttattacaagggccaaaactcatgagtgatcttgtcaggcagtgaatggccaacaggagactagttatttcatttaaccccaataaatgggctcctaaagcctccctcggcatactgtaactgcctggaaccattacctggactacgcaatggctttctaactggcttccccgctgcctgcagtgtacctttcatcttctaaactgctttgagagagatcttcctaaaactcacatgtgatcacgtcatttctctacataaaaacttgcgatggtttctcactgcccttgaataaaggcacacaaggatttccctcagctgtttttctgtctgcctttctagcctccatgtctctccctgaaccccagcctgtcacagttatgtacattgctagacctctgaaacaatgaacaccatgccaacatgtgtctgggcatcactggctaagcgagcctctcctccacactcagcctcctgagagcctctcatcctccaagcttggctcaaatacacctcttcctatggcgactgccccattacctcagagaaagccacccatttttgtgcttcttttatgccaatgaagtctgcagaatatctggttatcaattgtgaagtgcttaatggcaaaaatattttattcatatttttgggaaaaaacagccagattactaactggtaatgacagctaaaatcatgttattagccaaagataaaaacctttattaaagactcattgactcactagttgtaatggaatatctgctcagtaaatgtaaggctcatttagtgggaatgtatatgtgaaacttggccattgatcagtagacaccttaatggcacagaacaaaattgcattaaaatattaatgccattgaccactgctctgccattttagtgcagctcttatagaaaatgcagtaaatcatttctgacattagagtaatataatgaaggagattttctagatcttgaatacatagcttacattaaaatctcaagacaaaatgaactccttttccatgaaaccatcttttcattgtctacaactgagtggataagatgagcaagttaaggccggccacggtggctcacgcctgtaatcccagcactttgggaggccaaggcggtaggatcacgaggtcaggagattgagaccatcctggctaacacggtgaaaccccgtctctactaaaaatacaaaaaattagccaggcgtggtggcgggcgcctgtagtcccagctactcgggaggcagaggcaggaggatggcgtgaactcgggaggcggagcttgcagtgagacgagatcatgccactgcactccagcctgggcgacagagcgagactccgtctcaaaaaaaaaaaaaaaaaaaaaaaaaagatgaccaagttaaaattagaccttgtttcatttctagaattccgtgatcacagttatgaatgtttctgttaatactggctctgaactggaaaaaagcctgaaaaatgtcacttctttttaaagtcaaacctgagtatctttgtgtctcttgtttcacaagttgtgtccttgtttcacaaatcctgctaattttatcttcttaatattatagtcttcaggtaccctatcacaagccaccacctgagctccccgacttcaggctaccactgttatctcttccctggattattacatcaccccgacgctcattctcccaaccttgcctacacatagaaaagtggtcatacaaaaataagcaatgagcaaaggacatcctgttcaataaacggtgctaggacggctggctagccatatgcagaagacacctaccttgtaccatatataaaaattaatacaaagattaaaaatttaaatgtaagaccacagactttatgcaccctagaagaaaacctaagaaacaccattctggacgtcagctttcggaaagaacatatgactaagtcttcaacagcaattgcaacaaaaacaaaaattgacaagtgggacctaaactaaagagtttctgcacagcaagagaaactatcaacaaagtaaacaaacgacctacagaataggagaaaatattcacaaactatgcatctgacaaaggtctaatacccagaatctataaggaacttaagcaattcaataagcaaataacccaagtaaaaagtgggccaaagacatgagcagacacatttgaaaagaagacataccagcagccaacaaacatggttttaaatgctccacatcactaatcagagaaatgcaaatcaaaaccacaacgagaaaccatcttacaccagtcagaatggctattactaaaaagtccaaaaataacaaatgttggtgaagctgtggagaaaagggaacacttatacactattggtgggaatgtaaattggttaacccactgttgaaagcagtttggagaggagctcagaactaccatttgagccaacaatcccattactgggtatatacccaaagaaaataagtcattctaccaaaaacacacatgcactcacgtgttcatcacagtactattcacaatagcaaagaaatagaatcaacctaagtgcccatcaacagtgagctaaaaaatgtggtgtatatatatatatatatatatacacataccatggaatagtatgcagccataaaaaagaatgacatcatgtcctttgtggcaacatgaatgcagctagtggccattctcctaagcaaatcaatgcagaaacagaaaaccaaacccagcaattacagatttctcataaattgtggaaacaaatatttagagaatctatcgaaccaaacacccaatgttctcacttataagtgggaactaaacactgggtactcatggacataaagatggcaatgacagacactggcactactagagagggaggtagggcaaggggtgaaaaactgttgggtaccatgttcactaccagggtgatgggattcatcacaccccaaagctcactatcatgcaatatacccatgcaacacagctgcacatgtgccccctgaatctaaaataaaagttgaaattatttttttaaaaatcacaattaggttactaaatattcttttagcttaattcaaaaggtaaatgaaattacatttcttttacacttatccattcttaagaatggggcagggacttttataatgaatttaactgtgaaatcacaatttagttatttattgaatataatttaataaaaccccgttaaaagtaattttatcatcttaagccaaaaacaaaaatcaaacttgtatgtatttgtattcaacagcctaaacctgaaagcaccggctcatttcagacttaaaggtaccttcatttaaagtgaaactggtcataacactttcagcttcaatttcagaggagcatgtattagaacaaagactgcctatagaaaatgttaatttaagaatggaaaataatctgtgtagatgtcatcatggaccaacacttctatacacaaaccaaatgttattcaacagttgtagcaatctttcttgccgagtccaaacatcagccagaccacctccaccaaagaccaattattctgctttgatacgtaagatgagatttactatagttttgatagattctctaaatatgtttccacaatttatgagaaatctctaatgtcatattttttttttggacactcaccatttgagctctacttttcccttcaggaaactctaatcacaaatggaagaagaaaatcactatgtagtaagcatcatgtgctgggcactgtcctaggtaaataatttgttacttcaatcctgagaatgaagctttattactaaccccctccacactgcgtagtagtaagtgtagcactgaacaaatcatttcccagtttaaaccttacattttcttccataaaataaaaaaaatgaatatgtaacattatctgagttttctaagattccaaagatggtacagactacttaggtcttactcaattttgtagtccttgggttttgttttttgtttttacctattaggcttcatctattgcttcctaaattgaatcaccctataaatattccctatcatcatagccatggtcgtatatacaaaaagtgaatgaaaggcaaaggaaacatcacgtttcaatcatatggttcaacgagttgagaaaaactcacactacagcaacagtgactgaggtaaaattgaatgtacactgagtaaaatgtttcgtttgtgatatcccaaatctaactcaggggttagaattgggtggggttttaaaaattgttttcttcaagtgttttatgtatagtacatacaataaaaaacagtaacatttgtaaacatgcaggaaaaaaaaaacaagaaaatctggccacgcagttcctttgctgaaacccttcaatcatgtcccgctgctcgtccttctcccttacacaaatatttactgggcgcctcctatagaccagccaatgttatgaaaccttcagctaaaccaaggtctgtgataaggctcccatggggtttgtcagtctgatccctacatcttccctcaaattcgggtcacatctaaattctttcgtcgtctattgatgagaactgcttcctactccttgaactcaccattctgtccctggcctctgtgtctatgtctacaatgccttttccagcctcatccaactctaactccatggatcctttcagagtctaggagtcagtcctctggaagcattccttaaccactctccactccctccccttactaatcactcgagtgctcctgctctgagctgctgtaagcctgtgcccatttacaccactgtgcatcttaattctattattgttttctgttctctgtcagtttcctcaactataccttgaactcttgaagtcagggctgggtcttaataatctttgtattagagaaggtttctaaaactgctaccaactcctgacatccagtaaacatgcagtgaattcgtttaatggtttagcaaataagatgactaacagaagaaacagactgtcttaatcccaaaagacatcagattaagactgacattagggatactaatgcattcaacttgtgtcaatcacatttctcccagttgatatggcgccagagaatgctggcagccaatggcattatttgtaacagctacaagttattttaaccaggaactaccataagactgctttggcctacccagctttcctccctgatccatgttttataaaactatcagaacaaatgaatctcatatttaagataattttgaaaaggtagccatcagcaatccagtcaagtgagccatgacttaaatgatattacacatctctctctgtaggaggcggctgaatgaggagacaaaaatccaaagtcaaataaaaaaaaaagacccaataactcagcattacaatggagagccttaaatagcaaagtattataaatgttgctggtttgcaaggaaactgtccaaagagggtccaaaggatggatttatatagagagaaacatggggtgagaaatttccatggcaacttctgttatcacagaccttgtgcaattttccagctctccttgtgtgaggtttgaaatgctcccatcttaaactggcagtagactggctttcatattcccttcctttcaggagccatgggacaccactgaggactgccagtcatttgtaaatgtctgagactctattccagctttttttttttttttttttttttctgagatggagtttcactctgtcgcccaggctggagtgcaatggtgcgatcttggctcaccgcaacctgcgcctcctgggtttaagcgattctcctgcctcagcctcctcagtagctgggattacaggtgtgcgccaccacacctggctaattttttgtatttttagtagagacggggtttcaccatgtcggccaggctggatgcaaactcctgacctcaagtgatccacctcccttagcctcccaaagtgctgagattacaggcatgagccacggtgcccagccctattccagctcttattttatctttaagaagtctcattaatttactcaacaaatgttgattgaggaacttctgcctcagttgctgttgagtcttccattgtgaatcccatattctgacactcagatcccaaatagctcatattaaaactgtgggtgccctaatgagcactaaagccaaatgcaaagttcatgataggaaattaccaaaatgtctaaaattttttcccaaggaattttaactttcaaaaaattaatacataatatttatacatatttatggggtccaggtactattttgctacctgcatacgatgtgtaatgatcaagtgatggtatttaggttatccacgacctcatgtatttaccatttttgtatgttgggaacacaaaatgtctagatttattccttaatttaaagctaatatttgtacaataaataggaattaccctgcttaatcaatgcctcaaactgtcttttctcatggctctccctctcccctacctctgctccaaggggtcagtttgaaaggcataggatatattttagttgttgggggatggctacaggcattagttaagcacacgccaaggacacaagtcttctccaatgatgcaacaatcccacacgatgaagaactgtcccattcaaaatggcaatagtgtccccacaagaaatactgccggtcattagagtaagctcaatataatagagagtcgattcaacaaaaagttatcaaatgcctcctggatgcaaagctaagtgctaagagatacagaaataagacacgattgtctgtcctcataaagctctaaatagagaggtctccaaaacagccataatatgtgccaaaaatgtattaataaccactataagcgagaactcaaaggaaaagaacttcttctaatatgggaaatcagggaaagagttacacaagagatgtgattgaaagggtatcttagtccattttctgctgttttaacagaataccacagactgggtaatttataaataaatttctcacagttctggagtctgggaagcatgatgccaaaagcatggcaccggcatctggggagggccttcttgctgcctgataacatggcagagggcgtcacatgaggtggcagcaggagtgtcctcttcttataaagccaccaatctcatcatggggttcccaccctgataaccttatctaatctggattacttcccaaagactccacctccacaaagcatcagcaagaatttggggataaagttttcaacagatggaatctgggggacatgtttaaatcataacaaacagcctcgaagggcatataacattaagacaaagagacacagtggacagaaacgatgatgaatcaggggaaacactgttcagcaagacctacaaaatggaatggagaaatgtttattctcttaaactggtatatatgaaggacttgtggggagaaccttctttttgttgagaagatgccttgctaagtaccacagggaaaaatatctgagtctgaagggctttacactgagtggaaatgtctcgtatttggcaagagggaggatttgcttgttgctccagagatggaaagagaaagatgtgaaaaagtgaaagcagcacctaaagacaaggtgtcttattcaactaaatgaaaagcaaccacgggagaatgactggcagccgagcctaggaaaatagaagaaactttctttgttgtttctgaaaattccaaccaactctaattgcttttgtcaagttacttggtttgttttttaatttgcaaaaacatcgtcatcatcgacaacagcagcagccgctcttcagcccccaaatgaatattgctgaaaatagatagcggtttcatctcttacctgccttgaagtcctttgcggccccagaaaaaaaagagaaaaaactacattgtccatctcactgacatctatcccagtatatttcatacactggtcctaaaatctggaaatttagcgagtagttgtataagaagtggctccttccactgaaaatcagtttggggagaatcttgtcaaagccaaatccctgtctacataaaatatggtacctctgagttgaggttttattggctgagtgctgcataaatgcaataaaagctttcagtactgttttccttgcaataaatatccactttagcaaattggaaaggagaaggaaacggggttctggaaagtagaaatatctgtaactcagaactcagcatgggtagtcactgtgcaaaccagtgcaagcttaggttcagagccctggagcagcccgtttgcagctgtcttgtaagaaggttctgcaccaaaagaggctggctggacagtctgtcaaactggaggggtcaaggccagttcactgctggaggtcatcctccctgtcctctattccctttgcatctttgctgaaatgatcacccagagatgctgatgggtttgtcaagtcccaatgtcagcctgagacagtataagctgtttgctttactagcacaaagttaacatgcatcattaccttcaatgtagccagtggccttccgagtgaagaagtcttggggatcccactcacaagctgggatgcccccccctgcccacggaaggatatgagaggctgctcagctgttgccactgaggagatttcatgaattccctgtgtgtgcataaaacacacaccctctgtcatacacaaactcctctctctctcacacacaggacaggaactgtcatcatccagaaatatggtgacctctcccctaaaaaattagcccatttgtaatttgggagaagaaaggataggttgctggggagaggtgactgaactacaaatactctcactggcagaaggacaatgaaaagttgtcccctcaggcacaatcagttttagggacgggccgagctgagagggtctttgataggaaagaaggccaggctgggaagcatgagtttccttacctcctctcccacctcgatgtctcggactgctcgcagtaagaggtggggcccattgaacacaatcgaacagttggggtcacagctgtgattgagcaaagagatactggaaaaaaaaaggggggaagactgtcacagctcagcaggtagagtcaactaaatttaacaaatgcagtgggtaaaatacaccttcctttggggggcagcagcaggtagggttgacaggatgccaggggttcagtactcggggatgcattcacagaaatgtcactagcacacctcccacgaagtgcaattctcctcaagatgcaggctaactagggaattccgtcatttaataataaaaaaatttcctgagtcctttttggggattggggcatagttgactgattagataacagtcaataaggcaacccaacacgaaggtcagaaagaaactgactcagaaagaaatacttagacagctgggtgtggtggctcacgcctgtaatcctaggactttaggaagccgaggtgggtggatcatttgaggccagcagtttgagaccagcctgatcagcatggtgaaaccctgtccctactaaaaatacaaaaaaattagctgggtgtggtggcacatgcctgtagtcctagctactcaggaggtggaggcaggagaatcgcttgaacccaggaggcggaggttgcagtgagccgagatcgcaccactgcactccagcctgggtgacagagtgagactccatctcaaaaaaaaaaaatactcagacataatgggatgcagcagccaagataccactgacctctcccataggatctcatttgttgagctcctttggagaaatggccgcctttgctagaacatccacactgaaaaataattaggactatttgctcttaaatagagagctgacgttattttgccacctacatcctgatgcatcctgggccatggtccagtcattttattaccttggagggacatttcttaccatctgggaaacaaaatggatttaagctgctatcaggaattggtaataattagaatgagcacttactatgtagaaacactttcttgcacttgagcatgttcatcacatttaatcctcacaacaatcttatgaggatcatttacaggtaaagagactgatgcacagaaattaaatgacttgctcaaggacatacagctagtaagtggtgatggaatttggaccaggtggcctgaacgcagagcccatgctttgaatcatcctatgttactgccttttgagaaccacctaccagtagacctgacctacagttaatgacaattgtgagaaataagaaaaaaggctgaattcttagattcacaattattagaaagtctaaatttgtatttggactcttatggcataaaaacaaaatgaaactgggtgtgcctatagtgcttgtggagagacggtttcatagctcagtggtaagagtcagctcagcaatagctggagagagcattcaggggccaaagcctgagagttttcttgcctccttgagtgaaagggctcagagtgtgccaactcgaaagacaacatgaacccaactgatacgtacggcaagtccggtgaaatcagcatgtgctgcagctcaggaaactggggaataaccaaaaatcagcccgatggttaattagcacccaccgtcctcaacttcttcacccaaagtccccctgagaacaagagtttagttctgagatctgcccctttgttaatatcacagcatataatgtggggttataaaactgttttctttcaacttaacattttccatttttttgtaatttattgctaagttttaagcttggctcttgaacaagctgcagcaactgcctttctaactacctccaaagggctggggatttgggtgggaatgaaagtgtgtcttccagtacatgaagtaccatacaccatacctgggatataggccaacaccaacttcctgcatctccgcattacagatggtgaaagagttgcagatcacctgtaaacacaaggggaaccatcagtattactagagtcacttaagaaacttcatagccaagagaataaaaaacgttcaaacccaaatgtaggagcatcttagtagttgcttaagaaagagccaagccaatcatggatgctctttgacttacaacagaatttatctgggatatactccccctaaaaacatcaggtggttaagtgcagaaataccaacctcctgggagaaaaaaaaaaaaaacagacggaaaccagcagaggaaccattaatttcagtctcattatccactaccccaaagttacagttacatgaactgttcaaaatccagaatatgaataagctatttattgaaaactagactcctgctgtatcacgattttttcaaactgcatgcagtttccaaatgccactgtgtatctgttcagtgatagcaacttgtctcttactcctacagaaagcgaagtatcccgtgactgagcctgtcgtctgatgcgtgttggtgaagaccacagggagcactggaggtcatttagtcaagccatggtatttaccaggagtccatcactgggtacatgacacagtcctgtcttatgcagggacggagcagaagcagtaaaaaacacaatcgactgtgctcaaggaacttaaaaacctcgtttgtgaaataaggttgatgtatgaggtcacacagaaccatggaaagagcactggaccagaatcaggaaatctagattctggctaaaatcactgcttcagacaggtgcgaggaaaagagcagtgaagaaaaacaaaacaaaagttcctgcctccgtggagctcaagttctagttgaatacacagattttttaaaaaacccaatgatagaaaactgtcacatgtagataaatgccaaggagagaaacaaggtccttacagagaaaaaaagttgtcaagaaagctctttaggatgagttgacatttaagcaatgacctgaagggactgctgaaatgaacgtgtgtatttataggcgataaaggctcatatcaggagaaagagcaagtgcgaaggccctacgctaggaatgcccgtggtaacagaggaacagcaaagaggctagtgtgaccaaagcggagcaagaaagtagggggcaaaacacgagctcaaagacggagtgggatcacttacggccctactgccatatttgggttttgctctgaagaagatagaaagccactggattttgagccaaggcatgaaggagtctgacttctgctttaaaaggatcattctggctgttgtgtagagaatgggctataaaaaggtgaatggaagtggagaaaatggttaggaagtcactgctatagcccaggtgatagacaatggtgactcggatgtcggtagcaggagaactgggtagcacagccaacaggccttacttactgcgggacggcttgtggggaatgaaaggagtcaggataatgctcgagtttttggccgaagcaagtggaagatcatagctaccatttattaagatgaggaagaatttaacaggaacaaatttggttacagggagttgagagcaagtccaacagttctgttttggttaagttaaatttgaaatccaagccaagactaagaatgaacaattggagttcacaagaggagttgcgcctagagatataaatttaggatgaaacatgacaaaggccatcaaaaaacaaaaaaaggagaagaggctaaacatttgagatgaaccagagactacaaatggatgctgacttgttataaagtttctgtaaaggaaaaagtgatgacgaatttctcaaatcaggtttacatgaaagaacacgaagtatgaaaacacactgagtcctctgagactcttccactgctccaaacagctcttacatgaaatctagtgcactctagcatgatttggcttttttccctctaaatatataaaattgcagtttcaaatcaggagcaaaattatacatatatatttgtaaacaaatgctaaattgctttaaggacaactattttgcattaagcagcaacagtacattgtctatatatacttatgtataaattggatggtaaaaatataagacagaaagtcctacgtttaatttttgaaattttaaacatttttaaatgtgtataatttgggaagggatacaagttttaacaaatattttaaagtataatgagaactttagttgaaataatccaccaacaaaaaaaccaggtcaaacacatctgatctgttaacttctgaatcaaaccagcatggttttttcctggactatgaagcaaattaacggttttttcaaaataggaaaaatctttatcagtttttttccatcggtttatttcatggattctgatggaatgtttaagaaggaaaagctaacaagaggaaatgtcagcttgcttgtctcttccactgggaaactcttcctgatttcctaagatgacttccctctttagcagcatttatcatactggatcattatttacccatttacttgccatcatacacaactggatcgtaaaatacttgggagggcagacacagtgtttcattcatcactctagtcctgtacctggctcaaagcctggcaaacagaagacactaataaatctatttccttttcttagagacaaggtctcactctgtcacccaggctggagtgcagtggtgcgatcatggctcactgcagcctcgaactccggagctcaagtaatccaccctcagagcctccggggtaactgggactacaggctggcaccaccacctctgactaattttttaaaactttttgcagagacaggagtcttgctatattgccctggctgaccttgaactcctggcctcaagtggtcctcccgtctcggcttcccaaaatgctgagattacaggagtgagccatagctcctggatttcatctatattagtctgagtgttacgtgttagtctttctgggctagtaaacagaaggtttagttttttgcctactctcacttttatttaaaatgctggctccatccagcactatctcaattaacaacctgacaggaaatatttttgacatacacaactgatagcaacagtggatatgcagaagctctctggcttttttttagtgcaagaataggtagataatatgtccatgtgtgctcaataatttgaaaggaattgctctttatatcaagaattaaaagaatggaaataaagcccagaaataaaagtttaaacatttttcaaagtactgtctttgtgaaaacagttttcttagggaattgcacaggttaaaacaattaatgaatgcttacttcacaaaaagataacatttagaaaaaaatattaatggtactacttcaataaaaaataaatgcaactgggttaatgaattctttctaaaaattaagcttgagtattactttagaaatttttaccatgtcttaaaactaaaacacatatttaaattgttttattattgaatgcaaagttatatttactttctgtaatttttcctttaaactaattgaaagccttcatatataatattatagtttttctagatgacaaaaatctagtgagttgtcattgagcctctgtattttataaaaacaactacagtgaaacttaaaatgttctgtgaaccaaattcttatgtcatttggttcagagtctaggtccagaatctgacatttgtgtcctgaggttagcaattccccggtagattagacacaaatagcaaaatcaataccaacacacaaagtgaataccttacaaaatgagtgtattaccatgtattcaaatttcatatttttcctgaaattcttaggactaaaggctttgtattgtagcagcagttaaactgagatatttgcaacacaagagaaaatcactactaagccattatcttgcaacggtaaaaatcagaacagccataagcaaactcacaaccaatcagagctgagtaattctacaccataagacaagaacccagccacttcccagccccctcccccaattactgaattctacacagcctatttcaaataatactttcaatttcccaatatatatacaaattttaaaacacatttaaaaagaaggggattcagtttctgaacacaactatacagaggtttcctccaagaccatctgcatctcctttaaaacttttctgtctaaaatgttcagtacagtgtctggcacagaagactttaggcacatcaagtttactaactagagggactaaatatgagttttcaaaacggagtttaatgtacttagttttattaaaccctggacagaaaaactggaaggaggaagagttggcaggtacgaaaaccagaagcagaagcttttacactacataactgcctctgccccccggcaccccgactcctagaactaatatttctctaactttaaaagcacaataagaattttaatcagggtatatttttctctacccacagaatatgacaggttattaagtacagatttttttccagaatcttctcataaaccttaagagattaaaaattgtatctcccaatccctccttatctgtatggcaaatatttatccatccttcaggacccaattcagtccttgcctgtcccattgcctcttttggtcacatagttaaagggtttgaaatctccaaaccagaacagcgggaggggaccaggctggcgacggaggtcagctcaggagaggagaggctatacttcttaaatgatgattcgcaaatcccagaatccacaaagtgttaccggaaggtttacgagagtacaggtgatttcggcatctgtttcaatttcaattaaaaaaaaaatccataatagaaacaatgaccaactacatttccctttgccaggaagttgctggagggtctcaagttttaccagggagcatgctgtaaggttgcggggacaaaggcccatgctcacgacttagtcactaagctgcatcttcactacactgctagtcttgcgacagtttgacattatagttttccattgtttcttagtcacgttatttcatttgcaaacctaatggacccctgattaaagacagaagcaagtaggagatatgactccaaagcacaatgtagacaaatggggttgcatcaaactaaaaagcttctgcatagcacaggaaatggtcaagaaagagacaacccacagagtgggagaaagtatttataaaccatacaacggataagaggttaatacctaaaatatataagaaactcaagcaacacaatatcaagaaaacaaacaacccaattttaaaatgggcaaaggatttgagtagacatttctcaaaagaagacatataaatggtcaaaagattcatgagaaaatgctcaatatcaccaaatgctcaatcattaggaaaatacaaaataaaatcacaatgaggtatcacctcatgcctgtttcatcaaaaagatgaaagataaaccttggtgaggatgtggagacaagggaattcctgcacactggtggagtctacattagtccagccattatgaaaaactgtacagaagttactcgaaaacctcaaaatagaactgccatataatcaagcaatcccatttctgtactcaactaactaaaataagagatatccgtgctcccactctcacgtgcactgcagcatttttcacattagctacgatatggaattgacctaagtgtccatcaacaaatggatcaagaaaatgtagtatagatacacaaatggagtaatattcagcccttaaaaagaaggaaattctgtcatttgcaagaatatggatgaacctggaggacagtatgttaagtgaactaagccaggtacaaaaagacaaataatccatgatctcacttatatgtggaatattaaaaagtcaaactcatagtaatagagtataatggtggttaccagaggcatgggctggggagagaaatggggagatgttggtcaaagggtgcaaagtttcaccttcttcacaggaggaataagttcttgagatcaccacagcatgatgactacagttaataataaattgtatatatatttcaaagtttccaagaaaaaatttcaaatgcctcaccgtaaaaaatgacatgaggtaagggatatgctaaattagcttgatttaatcattccaccttgtatacatttaccaaaaattcacattgtactctaaatatatacaattgttattcgttaattaaaattttaaataatttaataagacagaaagcaaggatgttgaaaaacaagggaaaatacataaaatgataattctataaatttgtctcaagatgctttatatcatgacttaccaggttgaaattcttatagagcatctcaagacatctctaatatttgaaaaaatgttaggaggagaacatacactgaatacgtaatcttatttttttttttgcagatggcgtgaagaccacgaaagtccccagtgtgtgatttggaatgtgcttgcactttgctacctaaaacctttcttgtcttataatcgagaaaaagaacatagaagtcatgaaacataatccagctggtttcttaaagagttaattataagaatgtgaagcatcaggtcatgaaagcaatatgcaacctaaggcccaaagcaataatatttcatttaaaaatttgtgttgattaaggccaggcgcagcggctcactcctgtaatcccagtactttgggaggccaaggcaagtggatcgattgagcccagaagtttgagaccagcttgggcaacatggcaaaacctcgccactataaaaaatacaaaaattagctgggcatgatgccatgcacctacctgtaggtccagctactcaggaggctgaggctgcagtgagccatgatcgcgccactgcactccaatgactgtccccgccacaaaaaaaaatgttgtggtaataatgtttttacaaaactaatttacagcaggttaaaccatgcgatatcacgtgataaaggagaaaactaaaaatttgtctttatatgctatgattattaaagattttacaaattcactttgtaatacaagtcaagtaaaaaataaaataataatattatttaagaaaactctttatcccaccacacatgacaatatatttgggaatttgtctttctagactgagatacatccaactgttttcacaactgcagtggtgtctgtcccatttcaagctctggccacaaataagtctgcagtgcacactagacacacaaaatcctcaacaatcacttgtcaaggctaaaatcaatatcaaggccaatatcataaggaatggcaatcataaaattgtgctttctattttatctctctcccacagtcaaactgccaaatgttagcaaatgaagcccctttagataacatgctttctaaaatccacagattttcattttctaaaagctttactcacaacagaacttataaacaactatccttgctaatagcaaaatagtcacatatttgtccactgttccttccctgaggctcttacctggcatttcacctccttaaagccatctgatgaaacaagcacttaccacagatgtctgtcaaatacgtagagaaggtataaagctctgacacatcattttcattgtttcattttcttcccatatcctgaggctcagaaattcttcaataatttattacaagacatcattataggtttccatagctccacggtcacatctaccaatttcatttagatgtgctcctacccaaaaggtttatcacaatgaactgaactttctcccatgtatcgcacttaaagattcttttgttcagcttaaatcttcaaaaacattctcttctatgatactctagtttcattattctctaagtaagtggtgtggaaatccacccccagcagtaccaggacgcctcactgtaatcttactcccagtactaaattcctaaatcaagtatgctaggtgctgcatagcacctgactgaagttgaattagatatggcagcgtgtggctcaagttatctgtttttccgtcaaattaatggagaaaaggaaactacagaaaaacgttacacgtgaaaggtaagactgcacactaatcaactgcttaaagtaatccccaaatgaaagatacagtgcgtgctgaggttcctttcactatgtagaaattaaggtgaatattctctccgggtgaacttttggcaggcaagggtttgccataccgatgatgcctgacatctcagggagtgaaacccagaagcaggtatttcacatgacagtagctgaagtgtgcatgactcgtgtacaagctgtgcgggcccgcatgaaggtattttggggactagtgcgtggctgtttctggcagccaatgacaggctagatggggagcaccttggggggccactccttctttggttgcccaagcatgcctgatccctggatacagcccgataacctagtgggcaggagccagggaagaacaaacacagatcagacgagagagagtcacaactttaattatgcagtcaagaggcatcaagaaatgagtctctgaggtcagacagcccctcttttgatctctccaggtatgctcctttatttttggaaatatagaaagaaataaaagaggaaatttatcatggcttcattccaactcctacactgttcctttgtacagaagtagctcataattcttccccttcttcttccagacacttttatagatggccagatacacaaatcagactggtgggatttcaatgcaaggatatcatttgatcttttgtcttctcttctggtaccatttttaactagtcaccatcatgaatacataaatagtgccattcccagcctctttcctgaccagattcctgagttggtaagtagctaaaacaccagcatactgcccctacaccgcttcagtgagttgctgcagcaatttgcaaggaaggttcccctttcctgactcaagagttcatcagaatgtgaagaaaagaggagttcaagaccaccctggccaacatggtgaaaccctgtctctactaaaaatacaaaaattagccgggcgtggtggcctgaggctatattcccagctactcgggagggtgaggcagaatcacctgaacctaggaagtggaggttacagtgagccaagatcacaccactgcactccagcctcggcgacagagcgagactccatctcaataaaaaaaattaaaaaataaaaaaatttaaaaaaaaaagaatgtgaagaaaatagataatttagaaaagtagattaaacatattttcttttgtaatggacattgctgaaaatacagtttgacaaactcttcttagctagttagcaggaccctcttgactaagaaagcattatagaagtatcggtttaaaaagatagacaggccaggcaccatggttcacacctgtaatcccaacactttgggaggccaaggcgggtggatcacgaggtcaggagatcgagaccagcctggccaatatggtgaaaccccatctctactaaaatacaaaaaattagctaggcatggtggtggcaggtgtctgtagtccaagctactcgggagactgaggcaggggaatcgcttgaacccaggaggcagaggttgcagtgagccaagatcgcaccactccactccagcctggcgacagagcaagactccgtctcaggaagaaataaataaataaatagccaaaccctggcctagaggagacaggctgactgttgggtccagatctggtccccatcaacttttctagtctcttctctagtgtctgccttctcatgttttcctctcagttttcctgtcttcacaccttcatgtctctgccaggtggaacagtcccactgcttagaatgttctcccctccttcctctagctactgaaataccactggtcccttaagaacggttcgaaagtcttttcctgtgggaggccttcatgtcattgaaaaagaagaagagagagggacagctgcaatcactgtggctccagtcggtgccggggagactgggtggtttggactgggaggaattctccacagtgcagcatagcggctatggcaaatcatggccagactgtttctttaggtgggtcacagatccatccctcctcaccttcccctcagggaatttcagcaactccagccaggggtttacggacagaactctgatctccccgggacacagcactggggggaggggcagctatggtctctatgttcagcagacttagtctttcctgcctgctagctctgaagagtccatgcagtctggacaaggggaactccccccagcgcagtgcacctgctctgccaaggggcagccacactgcttctttaagcatatccctcatcctgtgcctcctgactgggtgagacctcccaactggggtcactagatacctctgacaggagcattctagctggcatcaggtcagtgcctctctgggaggaagctcccagaggaaggggcaggcagccatctgtgctattctgcagcctccactggtgatacctccaggtgcaggaagcacccaggtgaatacggtctggaatggactcagcaaaccacagcagccctatggaagagggtcttgactgttaaaaaaacaaaacaaaacaaaacaaaaaaaaacagaaagcaccactaccaccgacatcatcatcaacaaaaaagactccacaaaaaccccacctaaaggtcaacagcctcaaaggtcaaaggtagataagcccacaaagatgagaaagaatcaatgcaaaaatgctgaaaactcaaaaagccatagtgcctcttctccttcaaatgactgcaacatctctccagcaagggcacagaactaggcagagtctgagctggatgaaatgacaaaagtaggcttcagaaggtgggtaataacgaacttcactgagttaaagtagtttgttctaacccaatgcaaagaagctaagaaccatgataaaacattacaggagctattaagcagaataaccagttgagagaggaacataaatgacctgatggagctgaaaaacacaacatgagaacttcacaatgcagccacatgtaacaacagctgaacagaccaagtggaagaaagaattctgagcttgaagactgtcttgctgaaataagacaggtagacaagattagagaaaaaagaatgaaaaggaatgaacaaaacctccaagaactattggtttatataaaaagaccaaatctacgaatgattggggtacctgaaagagctggggagaacaaaaccgagttggaaaacataactcaaggtatcatccaggagaacttgcccaacctagcaagacagaccaacattcaaactcaaaaaatccagggaaccccagtaagatactccatgagaagatcaaccccaagactcataatcatcagattctccatggttgaaatgaaagaaaaaatgttaagggcggccagagagaaaggccaggtcacgtacaaagggaagcccatcagactaacagcagatctctcagtggaaaccctacaaggtggaagagattagggatcaatattcaacatttttttcgtttgtttgttttgagacagagtctcactctgtcacccaggctggagagcaatggaacaatctcggctcactacaacctctgcctcccaggtacaagtgattctcctgcctcagcctcccgagtagctgagattacaggtgcatgccaccatgccaagctaatttttttgtatttttagtagagacaggttttcaacatgttggccaggctggtctccaactcctgacctcaagtgatctgcctgcctcagcctcccaaagtgctgggattacaggtataagccactgcaccctgcctcaatattcttaaagaaaataatttccaacccagaatttcataactggccatactaggctttataagtgaaggagaaataaaatccttttcacacaagctaatggtgaggaaatgtgtcaccaccaggcctaccttgcaagagctcctaaaggaagcactaaataaggaaaggaaaaactgttaccagccactacagaaacacactgaagtacacagaccgatgacactatgaagcagctatatcaacaagtctgcaaaataaccagctagcatcatgatgacaggatcaaattcacacataacaatattaaccttaaatgtaaatgggctaaatgccccaattaaaagacacagaatggcaagctggatgaacagctgagacccatcagtgtgctgtgtttaagacacccatctcacgtgcaaagacacacgcaggctcaaaataaagggatacaggaaaatttaccaagcaaatggaaagcagaaaaaaagcaggcattgcaatcctagtttttaacaaaacagactttaaaccagcaaagatcaaaaaagacaaagaagggcattacataatggtaaagggttcaattcaacaagaagagctaactatcctaactatatatgcacccaatacaggagcacccagattcataaaacaagttcttagagacctacaaagagacttagactcccacacaataatgggagactttaacaccccactgccaacattagacagatcatcaagacagaatattaataaagctattcaggatctgaactcagctctggataagtggatctgacatacctataaaaatctctaaccccccaaaacagaatacacattcttctctgtgccacatggcactcactctaaaattgatcccttctaattgttttactaattggaagtaaaacactaatcagcaaatgcaaaataactaaagtcataaccgtctctcagaccacagcacaatcaaattagaactcaagattaagaaactcactcaaaaccacacaactacatggaaattgaacaatgtgctcctgaatgactcctgggtaaataatgaaattgaggcagaaatgaagaagttctttgaaaccaatgagaacgaagaaactatgtaccagaacctctgggatagagctaaagcagtgttaagaggggaatttatggtactaaaagcccacatcaaaaagctagaaagacctcaaatcgacatcctaacatcacacaactaaaagaactagagaaccacgagcaaacaaaccccaaagctagcagaagacaacaaataaccaagatcagagaggaactgaggacagacacacacacactttccaaaaaaaaaaaaaaaatcaaagaatacaggggctgagttttttttttttttttttttaaataaaataggccactagctagacttaaaaagggagaggaatcaaacagacacaatgaaaaatgataaaggggatatcaccactgatcccacagatatacaaccaaccatcagagagtactataaacacctctatgcaaataaactagaaaatctagaataaatggataaattcctggacacatacatcctcccaagactaaagcaggaagaagtagaatctgaatagatcagtaacaagttccaaaattgaggcagtaatagcctaccaaccaaaagcagcctaggaccagacatattgacagctgaattctacaagaggtacaaagacgaagtggtaccatttattctgaaactattccaaacaattgaaaaagagggactcctcgctaacttattttatgaggccagcgtcatcctgacaccaaaacctggcagaggtacaacaaaaaaagaaaacttcaggccaatactcctgatgaacatcagtgtgaaaatcctcaataaaatactggcaaaccaaatccagcagcacatcaaaaaacttacccaccatgatcaagtaggctccatcccagggatgcaaagctggttcaatatttgcaaatcggtaaataaatgtaattcatcacataaatagaaccagtgacaaaaaccacatgattatctcaatagatgcagacaacgcctttgagaaaattcaacaccccctcattgtaaaaaccctcaataaactaggtattgaaggaacataactcaaaaatattaagagccatatatgacaaacccacccagccaatgtcatactgaatgggcaaaagctggaagcattcctcttgaaaactggcacaagacaaggatgccctctctcaccactcctattcaacacagtattggaagttctgaccagggcaatcaggcaagagagagaaataaagggtactcaaataggaagagaggaagtcaaattgtctttgtttgcagataacatgatcctatatctagaaaactccatcgtctaagcctaaaagcttcttaagctgatgagcaacttcagcaaactctcgggattaaaaaaaaaatcaatgtgcaaaaatcacaagcattcctatacaccaacagacatgcagagagccaaatgatgaataaactcctattcataattgctacaaagagaataaaatacctaggaatacagctaacaaggaaaataaagaatctcttcaaggagaacgataaacctccgctcaagaaaatcagaggacacaaataaatggaaaaatattccatgctcatagataggagaaatctttattatgaaaatagccatactgcccaaagtaatttatagattcaatgctattcccattaaactaccattgacattattcacagaattagaaaaaactattttaaaatccatatggaaccaaaagagagcctgtagagccaagacaatcctaagcaaaaagaacaaagccggaggcatcatgctaccaaacttaaaactacactacaaggctactgtaactaaaacagcatggtactggtacaaaaacagacatatagactaatggaacagaatagagaactcagaaataagactgcacatctaccaccatctgatcttcgataaacctgacaaaagcaatggagaaaggattccttatttaaaaaatggtactgggggaactggctagccatatgcagaaaactgaaactggaccccttccttacacattatacaaaaattaactcaagatggattaaagacataaatataaaacataaaactataaaaaactccagaaaaaaatctcggcaataccattcaggacataggcataggcaaagatttcatgaagaaaacatcaaaagcaattgcaacaaaagcaaaaatggacacatgggatctaattaaagagctttcgcacagcaaaagaaactgtcatcagagcaaacagcctacagaatggaagaaaatgtttgcaatctatccatctaacaatggtctaatgtccagagtctacaaggaacttaaacaaatttacaagaagaaaacaaacagccccattaaaaaaatgggcaaaggacatgaacagacacttctcaaaagaagacatttatgctgccaacaaacatgaaaaaaagctcaacatcactgatcagagaaatgcaaatcaaagccacaatgagaatctcacccactcagaatggtgattaaaaagtcaagaaacaacagatgctggcaaggctgcaaagaaatagggatgcttttacatggttgatgagaatgtaaatttgttcaatcattgtgcaagagtgtggcaattcctcaaaggcctagaagcagaaataccatttgacccagcaatctcattactggttatatacccaaagaaatataagttattctactacaaagatacatgcatgtctattttctttgcagcactattcacaatagcaaagacaaggaattaaatgtccatcaataatagactggataaaaaaatcatggtacatatacaccatggaatactacacagtaataaaaaggaacacgatcatgttctttgcagggacttagatggaactggaagtcaatatcctcagcaaactaatgcaggaacagaaacccaaacaccacatgttctcacttataagtgggagctgaacattgagaacgcatggacacagggaggggaacaacatacactggggcctgtccggggattgaggggcggaagaacatcagcataaatagctaatgcacgctgggattagattaatacctaggtgatggggtgatagctgcagcaaaccactatggcacatgtttacatatgtaacaaacctgaacgtcctgtacatgcacccccgcagttaaatttaaaaaaggaaacagcacagcaatattaaagatagtactgcctgaaataccacaatttaggttttttctctgaagagccagaaaggagatacaggaagagctgaatacaagtgacaaagaatctgaacaggagaggagagatggtctcagagttgttccaaacttacttgtcctcaaagctctcctccaccaccttcctccaccgcatgtggaggccacctaaaaatcacaccactcaacacattgttttctatcaaacaggtctttacactaaatcccaaatatgttgtccatgagaggaacatctgacgttcccacgccactcacgcctcaaagcacttcacctcacctcttccagttctccaatcccctcacaaagaagctatgagtacagtatcttcatgaaagaaaggtaagagaactcaacagacgcttctgaggctacatggtccgatgttctcacgcatcaaggaaatttggtcaaaataacctttgcagaaaactcagttatgaaggaagtacgtacaggcagagtggggagggggttaagctaaaggtcgggtctgaaacacagtgttgtacactagacccatcagaaggatagatttgttcattcattaagggtctattatgtaccaagcacagcgccaggcactaggaagaaaagaggaaaaattgtcccttttaatcatgttgctattatttcaccgcccaagtaaaacaaaaatgtaaaaaactccccatttctctctaattttgacaaattttagccttcctcagccaaagattattttcctgactattggccatatttctttgttaagtcactctgtcaaaacataagttgcaataatgcggggcagcgtcgaatctgccagatcaatttagaaacaaatgagtctgctgctcttccgtggccctgggaggcgggctggcctccacgtactgtcagatcgtccacaggaagaattgctggggattactgaagaccagctgggaagcgtcaactaaaatggatggcctttgaattttccactctcccattgtctaactatagccagccgccattcccaaattaatgccacagagagagagatattctctcctaaggcaggctgcaaagataaatcggctacaaaagagcaagtagctaaaggaagaaacagaaaatgaagccttggcactctgtcatgtgaatgtcacagtatttgcaggaattcatacacggcacaaccagagacagaatagaaaagtaagcttccttcctaccccggtcctcctccatatccccccaaaacgaacccaattgtttcctgttttgtgaatgccttctgctaccccatgtcaccgtattttaaaacatcagggattcagttgctttatgtggggtaaaatgtgttaaatgtgcctgcatttctaaaccatcggctaatgagattttattaggaagagcccagaaataaattaccagaatttaccagaaagctataaaatggagggattgtgaggattaaatgagaaaatacatgtgggccttggaatgactcagggcatataggaagcttagtaaatggtagcaagatcataattattaccatagttcgatcaactgtaagacccactcaataaacagtccacaccattatgttacgtaccactaagaaaaaacactaccaattaaactgtcagcctgtgtattataaatcagatatctcagaattaatgaaatacagtatcactacatatacctctaggtttccagaagtaagtcacagtgtacgtaactagtgacaaagattctttacttggccaaactcagaggagattctttacttggccaaattcagaggagattcacgcctctgaatctcctaggtccatccgtgttgttcctcaaaatccagttttagcaaaagaaccctgcctagccggtttcgccagaacctcggtactcagaatcttcatgttcctcatccttcaccaccctcgggtgctgtctgatcaccctggcctgtcttcagcaagaatccagttaggtaagaggggcctcaaggtgactgagaagatgcatctggaacttgcttcctccacaaagaagaatcgaaacagcaggacggaatcgcaactggaaacagcaggacggaatcacaactggaacagatcatctaacagagaacagtggaattcaacatggaagtgacaggagacgcctaaggcaagaaaggagagggaagcaaggcagcctctttggctgggaccctgaagaggctccccactgtgtggagagagtaagtgagagatgcccagccgtccacattcccacatggactcctgtgatccgagccacaggagagccccttgtggtccttagactaacagagtgctgcccggggaccacgctgtggcactgctccagggagggagcttgtgctgggccccacatactgctcgagtcctaagcagctacagcacagcaccattttgagggcccagcttccaccaggcagcatcctgccctgggccccaaatagcccttgaatgtccacattcctggagccccattgatatcctccaccacagccactgctggctcctgctgctgccagggctgaagcacaagccactagcagtgaccctgtggccccagcagcaaggccaccatgcacatacaagtaccctaggacaggttaacccacctgcagccaccacctaggaccaaagcacacactcttcaggacacctggcccagttccaccagccccagtgaccaggcaagccatgcaaaggcctggggattgccctaccccgtccatccaccactgtgggcagctgagcagttcctctgcaagcctgaggatgggcctgcccgacctgccgctaccagcacatctagcatccattgcatgtgccaactgcaggcctaaggaccggactgcccagccgggtgcagccaacaccaacactggccacttgggagccaggggatcctcctgccattgctactgccattgcctatgccacgcccattgcccagacgcccaaggaccctcccacccagcacactgatgccacctaccaccagcacccaagcaagccaactggatgcccaagaactgacatgcctagacttgctaacgtggatgccagtgtacacagccttgaggccaaggacaggcacatttagcccaccaccgccaccgtggggcccaaggactggtgcgcccggggtccctgtccccagcaaaatttcactgcagcttctgctaacaaccacaccacccagagccactgaggaaattatagacaccacggatgccgatacagccaaaaaagaaaaagaaaaaaaatcatatggagactacactaccgtgcgcacccagaaccaaaaccaaagtacccaaccaaggccggatgcggtggctcacgcctgtaatcccagcactttgggaggccaaggcggtggatcacttgaggtcaggagttcaagaccagcctggccaacatggtgaaaccctgtcttcactaaaaatacaaaaattagccaggcgtggtggcacacacctgtagtcccagatacttgagaggctgaggtggaagaatctcttgaacctgggaggcacaggttgcagtgagccaagattgtaccactggactccagcctgggcaacagagtgagaccctgtctccaaaaaaaagaaacccaccccccccacccccacccaaccaaccaagaaacaacaaattaaaaaacacagtgcccaacccaaacaccactatagacctatcttcaggaaaaatcctcccctgtgaatgcaaatttaaaaaactggaaggagcacaagtcactgtctgtggaagagaaagcgaaaaataaataaaacaatttaaaaatggataataaataaatggaagaagcaattgttagaccaggagtgcagacatcaatttaaggacacaagaaacatgacaaaagcaaggacatatgactaagaaatacattaattctccagcaacaggttccaaagaaaaagaaatttaaaacatttttattaagtagtaaaagaagcctgacctaatactgttaggtgaggttagccagaatcccccttacctggatatttcctcttggtaattttccatctaccgacccccacactgccccttggctaccaattcccacgtgcccacaatgtatttggagctgagcctaatctttctcccccagtgcaagacctggttgcagtggtccctgtacctatcgccatggtcctgtgctttaacaaacaggactgagtatttttttctgtaacagcaggatctgagtacaggttgttggtgtcaccacagccacactaggccctgaacgtctgaccaccccctgttcttggagcctcagtcactacacagattggctcgctctggccttcttgactcttaacattgcccagaaggattcaccaccactttcagcgtcatagttctttgctttcaccattccgagtcggtcgtcatagaatatgctatcatatgtcactcaaaatccaaaatatgcctccgatataaagttacactgcttatgccaagtcagtggtcttgccaaatgtggccatactctggaggtgactttgtgcacatatgttcccagtattttctatccatgctcagttaagcagtgccatttcccttggcacagagtttaaattagttatttgcaaacgtaaattcacatttctttttcacctatcacaccgctctctctaaataacagagtaaaaacacttacgcagataatttgggtagggaaactggggatggatttcacagtcattcatcattagcctgacaagtctttgagttagggattgaacactccggcatattagttggctatttgttattgagagcaccagctctcaagatcacaggacatataaggtaagtgatgaaggatacacaatggcatttagagaaactacacaagaactgaagaaaaacaaggaggcacattgtttctgcatcactcttattacctgcaaaccaggggatggataatttaaaataccagcggagtccacggcagccgacagcctgttaccttccttggttacagaaagatgcgggggtgaattacccactccatggctgctttaccgcgatgcacagtacacgtcagatctcttgaaaatactcgtcgtggctcactttgggaggctgaggcgggtggatcacgaggtcaggagatcgagaccatcctggctaacacggtgaaaccccatctctactaaaaatacaaaaaattagctgggcgaggtggtgcacgcctgtagtcccagctactcgggaggctgaggcaggagaatggcgtgaacccgggaggcagagcttgcagtgagccgagatcgcgcccctgcactccagcctgggtgacagagcgaggctctctctcaaaaaaaaaaaaaaacaattgccatgatatagtcaattcctacctcctacgagtctgactgtgctgcttgtgatctgaccaggagaactctccacttttcccctgtgttgtcctttttcataatccctgcttagtaatcacttccaccaagaagaaacgtctcaactttctcatgtgtgagattcaaccagtcaccctactcttcattattacaaacaaaaggtcaagttctccttttcttgagttatatacagatttaattagttatttctaataaaaaataaaattccacatgatcctttctttccctctagctttattttgcacaaatgctctcatttcccccctacatctaaatgcaaaacagaatatattcactaaaggaatcagggtttgatgattacagcaaacaactgcatttgcatatgtgaggtttccaactttgaattcaaagacaataaatagcaaaatgatttagattagaatttgccgtttctggaaaaaaaatgttatcaatgacaggaaaagaaatgttggtgtcaaagaaaataaaacagaaatacctgtaaataaagatgagtatctatcaattataccatgataaagctgggtgggagggagattattactgtaaaacttgtttgaaggggaaaaaattaaccaaagcattatcaataaacgactaaaaagctgaaacgtaaggatcactttgggaaatgaagcaaaatcaaacaccaggaaacaaggcatgaaaagaaaaggattaagggaacagatgagttgatgacaaaaaagttacaaagaccaggaggaaaaagaaatatgagaattaccgattgtaataaagaaaaagaaaaagactgacaagcataggaaaaaaaatgacgtttttatggctgcttgatgatagttcagtccattgtcaacctaactagaatcaatcagaaagccgatcctcagaagcaaatgagtgaagaggcctctgggtaaaggctgagagtactggttgatgggcatcactgttaccactgttctcacctaacttgagaagattgtgatactagctccccaaatgctcctgttaatggcatgtaccctactcttagcaggtctcacattctgtgcaaaaacactgaaagtcaacataatatgttttgtagtgtaatggagacagatcaggtttttactaagctaaaaggagatacagccttggctacgcactcgagcagaacgctgtgaaaacgcatactaaaatgatgagcctgaactccccacataccctcaagtgcatacagggttgtgtctctgcaaaagcctctacccattgaggtttccttgtgcaggggatagtctgtatctagatgctatatcaaggtgaagatcaagtatctttagttttcataaaatactagattccaaacagaaaggtaattatcagacagagtaggtggcaattagaggctgagcaggaggctctaagaatctaaaaggaatttggtcggcatgtgatcatgaaatccccaaaacattccagaaagtgataaaaataaacacctttgggtaaagtgttatttccccaaagaggaattgaagctagttagatctctttggtcataatatatattatcagtatatctggagaaagaaacaaagcaagattaccttttcttcttcttcttccatagtttaaatttgctacattgggaaacttcactgcacattaatatatcaactccaactagaccaaaatctttcaattaactaaaaacattttttaggatgtaactctgaaaaaaataaaaagtgagaaaaagcaaacataaagtaaactggcttaaaagtagggttcagtttgttttgttttgtttttgagacagagtctcgctctgtcacccaggctggagtgcagtggtgtgatctcggctcactgcaagctccgcctcctgggttcaagcaattctctgcctcagcatcctgagtagctgggattataggcgcctgacaccacgtctggctaattttttgtatttttagtacagacagggtttcaccatcttggccaggctgatcttgaactcctgacctcatgatacaccagccttgtcctcccaaagtgccgggatcacaggcatgagccaccgtgcctggccaagtagggttcagtttttaaaaataaacagcagcaacaacaaaaaccccacatgtactttcaaaagtatgttctgtgattactcttgtgcctggttcttcaaacaaacacaggacttttcacaaatgaagcctgcatgttcaatgctgaataagattaaaacgtgtttagctcattgtacctacagaaacacaacagaacttcagcaagattttcaacaatgattattttaattttaaaaaggattttgtgtaactttgtttaaatctgataatcctctttacttcaaaaaattaaagaagaaagtgaaagtaatacttggaagcaaaatgaaactaacacgaagtgtatcaggtacttttccacattaactcactgatgtaattaaattacaaatgctcagcgtcctaaggggtcaacactgtaattaggaaaagtgtatttctccttagtccttataccatttgccctggtataaatgcttgtagtaaacattgttactctttctcagacaagcgttttaaagatgctagttaaaatgtagttggtagctagtttcctgagtcaatatggcaattataccaataaaattgcagatcaagatgagccagaggcagtaaggaacaggccaaagaaaaacaggaagaaaaggggacgataaagaaagtggtaggccaggtgtggtggctcacacacctgtaatcttagcactttgggagactgaggcgggcagattacttgagcctagatgtttgagaccagcctgggcaacatggtgaaaccctgtctctacagaaaatgctaaaacattagccgagcatgctggcaggcaccagcagtcacagctactcaggaagctgaggtggaaggctcgcttgagcccccaggaagcaggggttgcagtgagccaatatagcaccactgcagccactgtccagccttggtgacacagcaagactgtcgcaaattaaattttaaaacagtggtagtttattccaaattcatgtgctaatcaaatcatatctctgtgccactctcacattcagccctttcttcccgtttccactgcaggtatttgtctcctgtattcattatctcttacttgcaactttccaagtcaatctctctggtccctgtctttttccaaaccattctttaaattgtcatcagataaatcttttttaaaaacagatttgattttacaaaagagaaacaggagatctacccagtagttgcagaataaagacaaaattctctcgtgtgacatcaaacgccccctataatctactcccatcctgtgtttccctgcacccaacacgtatttcagttatcctggcttctctgtcattcccaagtcaggttgtgggcccatgtggtgttttgtttttgtttttgtttgagtctcgctctgtcgcccaggctggactgcagtggcgcgatctcagctcactgcaagttccgcctcccgggttcacgccattctcctgcctcagcctcctgagtagctgggactacaggtgcccgccgccatacctggctaatttttttttgtattttttagtagagacggggtttcaccgcattagccaggatggtctcgatctcctgccttggcgtcccagagtgctgggattaccggcatgagccaccgcgcctggccgcccatgtggttttatgtcttttctttttttttggcatatgattgccaggtcatagcttttatatctttattcatagtttcctcttttaaaaatatctttttcactactgcgatcgctcataattttattcatcctttaggatccggcttaaatgtcacctccttcaagaaactttcctacatccaaatagatttacctgatacctgagtatagatagtacagtatattgttataattgttctattttagtattattgttgttaatctactgtgcctaagttataaattaaactttattgtaagtatgtatacataagaaaaaacagtatacatgaggttcagtactatccatggtgtcaggcaccctctggggtactggaatgtatcccccatggataaggaggcactaagcaacatattgtatgtttagctttgcatacttttggctacttacagatggaatcatactgcattgatgattttgcaatttgttttgggttttttttttttttggctcaacattatatcctaagattcatttatgttgatgcatgttgctatagtttatagctgacagacctcttgatgtgtcttctaggaggcgcttatgaagagaatttccataggaacactgtttgtaaatgcaaaaaattacaaatgaccctatgttcattactaggttatacaaatagataacattattttctattttttcatttttcagagatggggtctcattttgttgcccaggctggtctcaaactcctgggatcaagcaatcctcctgcctgggcctcccaaagtgttgggattataggcgtgagccacagtattcagcctcttggtattttctatactagcacctactaatgtatatggcacatagtatactctctacaataaatgctttttaagataaacgaatttgagaagaaaagttatgtctgattcattgtggcttcctcatccatagaggccagcacatgctcagatgctcagtcaagatctgatattcagccacaaaaggctagcagtggacaggcaggaaataatctgagctgacacaagtgagggagcaaaacaggacgtgtgacgtgttgggtgcctacccctagcgaggcaggcagagcattattttttatgaggttaattccacctgcttacttttgagtcctacaaaccactgtagttcacaagaattcctttcttctcttgtgactctctgtctccccagcctcagctaattccctctccctgtctttgtctccctccttctacttctcctcctcctcctgtactactcccctactcccctgggtatgagcctgcttcggtactctgggaagggtttagtgatggtggtaaaaactgacttcttgatttccttccttgcctgccagcgaagtcatcttccagcaacttcttccattctgttggagcaatgatttgtctctcactatgccatcctttggtttgaacattgcatacccatcttaaggcagttgatccaccctgcttattgcctttttggcatattggatgccagctcttgagcagaaccaaacccctggaaaactgatcaccatctcaacatcttattaaactaattctcattttgctaaactagaaacgaatcatcaggctaacactgccagtgaagatgcaatgtaagacaaattataccaaaccaccaataggcatgtattcatctgcagcaccagccaactactctcaaaagaactgatacagaaaatgatgaaaaggaattaaatccaaaagtaaagagacgactgccaactacagataagattttccatgaaattgagtattattcggttcatctcactctgacttcattttattacagtttagacctgactagctaaaaaaagaaagaccatcgctttgacacacaatagaagtaaaaataaagctgacatgtcaccctttccttcattcctgttttcaatattcaatcttccccctttccctttcccatcacctactacactcacttccactgtaacatttctttctcctctcttagaaaagatccttagaggaaattaaaatgtggccagtccttactctttaacgtcaacgtttctctcagcatgcacttctctaacttgagctatcatttcactaaaataactcaactctttcttttctgaatcttccctagcgttgctgtatttcttacacccgcttggattcatgcccactcgctgctcaggatatattgtgtctatacttgagtaggcacaaaatgctttttcaaacaaaacgtatctgtcatatcagtactgtttcctccatatacgtcaaccaaattaaatagcttccctgaccttttgtctactttctttgccttctgagtatcctcatcatctaactcttggcctggtaaaacaggatatgtggaaaagtcataacttaccttcctcattattttctctatcaagccataaaaagtaataagggaaacctttactttgggcttaccttcactccaaaatgtagaattgtgtggttaggtttaaaaaatgacagaattcttgcaagaaaatgttaatctaatgttagaactcctagcagacaaggtagggacgctgaatgtaattattcagagactttgagaaaaaaaaagcgggggggagaaacaagcgggttttctatctgcaatgagcccagcactttatgaggtgcctgtctagattctttttttaccacgaaagttgggagaagctactatcaccctcatttcacaaacgaggcttctaaggctcaaagaggcttaagtggtgccagatattgaatccaggtttttctgatcctcatgttccaaagcaggacaagttaaatctgaaagcatcttaagaggaatgagctataaaataacattctgacaatacaatcatacacgatgcagactgcttatccatgaaggcccttcacaatctggcctctgcatcctttcctcacccttcctctcatcaccggccacaaatctccctttttccagccctacagaacaccatacaccattttctaaagtgctgtgctgatgaatgtactttccacaggctctttcattcgtgtgactgccctttctcttgcttcatctatctcctactccaaaacttagctcaagggttgcctccttcaggaagcttttcctcattctccagtctgatttaggttctcctcctccgtagcaaagtacatacccctaacaataccacttaccccactgaaccatcattgctgatttacttgtctgtttcttttactactagggttattcctagaaagaagaagctacattttatcctactttgtatctctttcatatagtacagtgactgacacatcataggtgctccagaccccaaatagaagaactgggacagaaatcaaagggtagtatatctgggatcaccaccctgggggagtgggctatctcatgaaccagtatttaagcagaggctagataataactttcaggagcattaagaactcttttttgttgttgtttggtttttttgaaacagagtttcattccgtctcccaggctggagtttggtggcatgatctcagctcacttcaacctccgcctcccaggttcaagcgattttcacgtctcagcctcccaagtagttgggattataggcgtgtgccaccatgtccagctaattttttgggttttgtttttgtttttttaaggagagatggagtttctcaaaaaacaaacaaacaaacaaacaaaaaacaaacaaacaaactctggccaggttggtctcaaactcctggccttaagtgattgacctgcctcagcctcccaaagggctgggattacaggcatgagccaccatgcccggccaagagctctttacactaagtgaggagcagtgttaggcaagccaagacatccatgcttgctctgttattctacggctcccgacagctccagatcaaagttttctgatgaagatgggccaacatctcagaagacaggatggcacaacagtaacacaactatcatagttagaaaacctgggttctggctctgacttggttgtgtgatttttggtagacagtcccaaaagtcttgggtgatttcatctcagtttccctatttataaaacaaagggtgaaaggtaagctagggggagctgaccaactagatggtctgttaaacgccttccagtgctaagagaattgccttattttcccattgctcactgtgttctcttgtgaccacctgaaggtctctgccagctcatcttataccagtgctgtcttccctgtttgatggctcatttctctaaataaagcataacattcacagaacaaaatgagtaaaatctctgtttttttagttcactggacaacatcacttttcttttttcatttttgagacagggtcttgctctgttgcccaggctgtagtatggtagtgccgtcacagctcactgtggcctggacctcccaggctcaagtgattttcctacctcagcctcctgagtagctgagactgcaggtgtgtgccaccatgcccggctaactttttccattttctgtagagacaaggtttcatcatgttgcccaagctgctctcaaactcgtgactcaaatgatccaccagcctcagcctcccaaagtgctgggattacaggtgtgagccacatgtgctcggccacatatctttttattttaaaatattaataaaacaaaattatgcaggtaaactctgagtccaaagggaaattggcattgacttacaaaatttaatcagatacttagaattcactgagttaacacgtgcatacttgaccttgcttgatgcaaagatctgtgatatgtaatcatttgctacttcactgaagatgtttgaatcctccttgttgtaaggttgactccacaggaaaagactgattcacatggctttgttatcattggctttctgttatgaaagcagacaatttaggtcaagggacaacaatctatttttctgcctgaaaatgaccccgacatgaaaaccaactgatagattggttcatttctattaccagcactaaagaatgggcatagggctgggcacagtggctcacacctgtaatcccagcacttagaaggccgaggccagcctgggtaacatgggaaaacccccatctctacgaaaaaaagacacaaaaattagtcaggtgtggtagtgtgtgcctatagtcccagctactgaggaggctgaggtgggaggatcacttgagcctgggaggtggaggttgcagtgagctgagaccatgccactgcactccagcctgggtgacagaaaccagactctgtctctaaataaataaataaataaataaatggcataaattagccttataaattactttaatcctgaatttatagaatcgttacacatctagaggaattacttaactttttcagatatactttgcatttttcacagagagaaaaataattacataggcattttcacatttggaagttcataactccctcgggacctattccacaggaaggccgaaggccaaaggtctcttgtatattatctagctccttaaaatggcaacatttaaaaaaaaatctaacctccttctcccccaaatcaattcagtttgttgaaattcttccatatgccttaaaactaccaagggaaggcagagtcagacaaggtttaaatgtttgtaggcatctgagaaagaattgaaaacaatcagagtagagatggtggtctactctgcattctcccttgggcgctaccacaaaggcacttctctgtacccatcagcagagccgcacatgctctctcttctcatagaaacagggtcaaccctcatttctaggaacataattttcaaccacaaagttcccttccattttttactttcctgacatcagtctgctaagtgaagatatctcggtaagaactccaattttaaggggaatgaatctttacagaatgtactttatcttgtcagcactttgaatctaaatttccttctcaccctttcaccctaaaatatcagcttgcatcaggcacaaaggaagatgcacagctgcaagtgctcaagatgactaaggaaggaaaagcagacaagtcactaattactctccaaactggaggcctaaatcatccttctcttctacctgttgtttctggaatagtttatgtcagtaatggaaaatttaaacactgtcatataattccattttttttccccactccagctcttaaaaacatcctagatgttaagatgtgtagcctaggacagtggttttcacacagtgctctaaggaacctttagagccagacacacagaggaggtatcaataggaggggtctgatgccccttcgacacatgttactataattaacatgtattttgagactgagaatgtaggctccatgaaagccgggattcctgtttcctcacagccatcacctcgtccttttaacagggcccagaatacagtaagctgccggataaaagttttttgactgaataaactgcacggttattacagctgggaactgatttcgctgatttccacggtaaccctgtgaggcacgtatagtagttatcctcactttgcagatgggcaaactgaggctcagagcagcctggcttccaagaccctccttctaaacatcataccacatgacacagcctcccacgtgagccagcagctgtatttcatctgttttacatgtgaggtttcccaccatttgactggagaaaggtcgatgttaggggagaaaaaaccatttaaaaaccaccaacttcatggtgaaatccaaaggctgcaagtaatcaatctcactccttgctctgtttttcctgccacccttgggacttgacgcaagtggcttaactgctcattgtttcaggttcctcatcttattttacaacctatcttgcaagatgagtatacatgaaatattagaggatcctgatgttgtcagaagtgtagttttgcggatgttgatcccagaattgtgaaacaaggacacggttgagatgatcgctaaactctgcctgaagttcaacgcctctgtcattgaagaccttgcacagtgccgtccacatggttattttattcctccatgtccttaccaactaaacaagccatatgattttaggtttcgtggccagacagcctggctaagctcctatcaacatgtcagccagatgaggtgaagagatggagaaacaaacctgcatgtgggttgcgtcgaacaataaagagaaaacagagaccaaaaatcttgtgccaaggtttgacctcaacaaccgcaaaaccaatcattgctgtgttgtttcactatgtttctagaaacatccatagaggagaaaccaaagtcggcctgaatacatgttaatagctttcacgggcttacttctgatattttaaacaggcaacaaaaaagaaaaaccaagtttcagatcttgccagaaattggggtttcacttaactgtaaaacagtcaaggggagtttatcaggtaagacacgaagcctttctttataagctcttataagactagagaccactggattgccgtgcagttactgccgctggcattattttcttagcacactaagaaaaataaaaatgttcaaagtcctgtttttaaaaacaggatgagacttctggcttctgatctggtatgtaagaagcttagaagtcaccattccatcctaacaacaagtaaaaagctaaacaaactaaaaaatcaaccattcttcttacacatttgagatgctagatatattagcttaatttaattattccacattgtattaaaaactcacaataccactttgcatcttataaatatacacaactataatttctcaatatacagtgttaaaaaaaaattcttagatctgccaaagaaataaggtcacagggcaagctgctgcccccaagactagagagacagaggggcgcatacagagcattgcaacttactacaacagaaacctccatggaaatcagtacccggtagaaacctcaattgtactcgacatactgctgggggtctagaatgaacaactcttcgagtttaaaactccagaggtgcccatcatggggagtagggagggataagcttttgtgagtttttttttttccaggagctctagcagggcctcgcagtgagtatcagagaaaaattcccttatgcttccagtggaaaaaggaggaaaaggaccattttgaaaaaacaccagagatcagcaccataggaaaaggaaaaaagaaaaagaaaaaaacaccagagaattatgttcttaacaaggttttgccctccagagaaactaaccagaccctaacttgctggggctttggcagagcctaacctacctggggaaggaaaatacccaactccagtccactctagtcatcctgtcccacaagaaaacaaacaaacaaactgagaagcactgagtgaagctcacagtccagggtcatgggctcactagaagactgagacccactcacaggactacaggagaacaattccattctgagttagtccactttgcatttgctataaagacgtaaccaatgctggctaattttcaaagaaaagagatttatttggctcacggctctgcaggccatacatgaagcagagtgtaggcgtctgcttctgatgagggcctcaggaagttcaccatcatggcagaaggcaaagaggggccagcatgtcacatggtgatggagggagcaagaaaagggaaggagagccagactcttaacaaccagctcttgtgtgaactaacagagcaagaacctgctcatcaccaaggggaaggcaccacgccatgcatgaggggtccacccccatgatccaaaacctcccaccaggccccacctccaacactgggggtcatatttcaacataagcttcggaggggacaaaacatccaaacagtatcactccccagtgatttaccaccacatcactaaagacccattcacaattctttttacccagtacatcatgacatccgtctttcagcaaaaacttaccagacatactaaaaggcaaaaaacacagtgtgaaaagattgaacaagcatcagaatcatagtcagatacagcagaaatattggaatcattcgacaagaaaatttttgaaaatgatgaataagctaaaggctttaatgaaaaaaggacatgaaagaacagataagtataagcagatgaaaattctaagaaagcaaaagtaatgctagagatcaaaatcattttaacagacttgaataatccttttgaccaacttattaggagactgaacacaactgaggaaaaatctcagcttgaggatacgacaacagaaacttctgaaatgaaaaagcaaagagaacaaagattgtaaaaaaaaaaaaagaatatccaagaactgtaggacaactatgaaagatgtaacatacatataatgggaatattagaaagagaataaagagggaaaggaacagaagaaataatattcaaaacaataatgactgagaaattccccaaattaatgtcaaacaccaaaccacagatccatgaagcttagagaacactaagcaggatgccaggaaaactacctctgggcatatcatatttacaactaagaaaatcaaagataaagaaaaaaaatatttaaaaaaataccccagagggaagaagaacatacttcagtggaggtaaaagaaaaacttttgttttcttattcttaattgatcaacacacaatatctttttcaaaataatagcaacaatgtactcaattacgtatgcatatatatgcttatgtataagtgaaatgaatgacagtgatgattccaaagatgggagggaagaattgggaatattttgttattataagatatttgcactactgataaagcagtttcatgttattcgaaaatggacttggattagtagtaagtgtatattgcaaactctacggcaaccattttaaaaagtaaaaagaagtataattaatatgctaataaaggagagaaaacagtatcatataaaatccagctttattcataatttccaaaacttggaagcaaccaagatgtccttcagtaggtgaacaggtaaactgtggtacatctagacaacagattattcatcactaaacagagattagtcatcaagccatcaaaggacatggtagaaccttaaatgcatattactaagtgtaagaagccaatctgaaacactttatacggtatgatttcaactgtatgacattatggaaaaggcgaaagtatgaagatagtaaaaagatcaatggtggccagagatgagaggggagggagagatgaacaggtggaacatgaaagattttgggggcagtgaaaaaagtctgtatgacgctctaacagtgaagacatgccattctacatttgtgcaaactcacaggatgcacaacaccaagggtgagccctaatgtcaactcgggagtctgggagataatgtgtcaatgtaggttcatcgactttagcaaatgtaccaatctggtttgggatgtttatgatgatgggagataggggtggggcagggaatggccaagggttatatgggaaacctctatgctcaattctgctgtgaacataaaacggttctcaaataaaaagtttattaattttttaaaggatttttacacaactaagccttgataaacatttaccttctttcttcttcatcataattatttttccgcattattttgctattttccttctctccttctctctctctctttcttttagagacagggtctcactctgttgcccagcctgaagtacagtggtgccatcacagccaactgtaacctcgaattcctaggctcaagcaattctcctacctcagcctccccactagaactacagacgcctgccactatgcctggctaatgtttcagtttcttcgtagagatgaggtctcattatgtttcccaggctggtcttgaactcctggcctcaagaactcctcccaccttggcctcacaaagggccgggattacaggcgcacatcacgatgccagacccaattttgctattttctagcataacatggtatgcacacattaaattaaatgtgaaaaacaaaggcaaaaagaaaaataaatcaacaaaagttctccaatcatgactaaaatcatggactatttccttctaatcttttctacaggctgatttttaaaaacattacttaattcatggagaatatcaaccagagtgctcaagatctggcccttgggaagacaggctttcagatcatctcgagtccttatttcctttctacccccaacctctgctgtgcctggtgctcagggcccctctccagaaaccgtcactctgaagatgagcaggcacattcaaggctgtagggagtacaggggaggatctgatgcagtctttcaaatactccttttcttttaaggtccccatatgaacctatcccccctcaggacctcacttcattaatttctgagcctttctgagcaggaaatatgcttgcttctcatcgatatccaccactgtaggcactcagatcccacctagctccccactgttaattcagtcatcagaactccaactgctttttgtcttcattattgatcaatgtgttataatgacttttgattccatcaaaagtagaatttgtttttccattcctcattctccttgccattctatggtgatggatgatttctgagagaagaaagaggtagaaatctctctattccatcacaattcttattcttacatggtattgtaataccatattatctttattaatctggctttataatatatttcactgtctggcaggaacatggtcatttcaaatttgactgaatgtttcaaaaaagtattttctatttgtctttaaagttatgggcaacttaccagataagttgaaaagaagttcaatatcctaaattcaaaatcctaaattttcacatgtagaccttcctatcaactcagacaatgccaggcacaaacctatgatcagtaactgctgagtgattgtgaacaagccatccaagaaaagtcaaatgcataggggcatttgtggaagtgtggagttgtctctgaaaagctgttgcactgtgaacttgtttcagcctgagaggcaagaaaggctggcctgtgattacttccggtgtctacctagtgtgaaatgtgttgagtcaatgaagcatctggaacagacttagttcaactggaaggttcatgactgggatgcttcctggagccctcagaccagagggcagacataacccaagaattgcttcttattaaaggaacagagacaaaaacctaaacagagggataacggcagagcattaaatgcagataattccatttgcgactaatttacccaaataaaatagcagaaagcagctttcagtggaataatttaaggcaacaggcaggagagtggcgtgaactattattttcatatttccattgcttacttgtcacttccagtgaatatttaacttttgagcatccactttgtggcttaaggatgttcctaacttccccaaactttgcatccttgaccagtacactacaatatttattcacaaccctgggaaatacctatgggaaagttactgttccctgaacgaaatacatgaaaatccagatttctctactcgctgacagtttatatagataatgctacttccccctcaatttatctctactctgtttcaatctacacactgctgtcagaacagcgttagaccacagatctgagcactttaatccccccctcaaaaatggcccccctctgctcaccagctccatgctgaggctctcacgtccttctcatgatataacccccatctactgagacactcagttctcctcaaatgaatctattctccattccctgactaagctgcagcgttctcacctcagtgcctttgcctaggctgtgtcttccatctgaaatgccctttaccagactactggaatgacaactctccttcaaggcccaagtgcctcctatattaaaacaataatggttagaactttccatttcaacaaaatgatgcagaattcaccttatattgaaaaaggcaggtagtgaaggaaattcagtgtacgagtaacaatgcacctcatgtaaaccactgtgaggtaaagaaaaggcaaggactttaaagccagatattcatggatttagctccctggtctggcatctttgaatcttgtgactcggggcaagttactcaagtcttctggaactgagttttctcctctatacaatggacacaatggtacctgtgttgcaagtgtggactgtagacacaaaccacgcgtttcccatattccatttaataattctgtgctgccctcgtctttcccgcgttgtaaatttcagccttctcaggtctgtgtctttctcctgtgccgttcatcagtggaggcttagttcccagtgctggtggaagatgcctccgtacactgttaaggaggcaatgctttctcttcctatcattgataatattctgcatcatagggctatgagacctccaggcttcagagattaccactgtgtcctgtggaggcaacctctaaaaagtatgtaattctgattttcttagttaataatgtgtcactctggtaacactatttaaatgggtctctattttctcaaaacgtaagtacttctgagttctctttgttaagccagaaggggaggcaaaagaaaataactttgctagctttcttatttaaattgagagcctgggatcaatgaaaatcaacacgggtttgctgtgagaatgaaccacaataattaatgactcttcagtggctagaacataaaagatagctagtgttagtgagaccatcagcaacaatacaactgcacaacttctactaacaataatgacatggacactgttctgccagaccttccagtccacaggcctttgaggccttagccaagacttttctctactggaggggtaaaaaccactaagcaaagcctcgcttgtctgagtcagctgagtctcatagccagggtatttgtctgaccctgttttcagtgctgaatttgccatcctgttgtaaatcagtcagcacaaactcagaaacatacccgttcatttacttaacagcacacaatccttcaaagggcaaagtggtttgaggaaatccaaactaaccaaggggggaaaggccaggaacacggattcctctgctgaagataaatggtagctatcaaatctgcacacaaatccctgaataaataccaacagcattccttcgtgttgttttgaaattcaaactacattaggaaaagagaaaggtgccttactttttgacataccactaagtcttcactccatcagaatgctattagcattagtggcagattttattacctctctaagtgtgtataaaaaccaagtgtctctaaaaagtattatttttgttgacatttatcataaagactattaaaacaacatataaaaatgtcaatgttgactttcttcagagaaatagaaagaactacttaaatttcatatggagcccaaaaagagcccatatagctaagacaatcctaagcaaaaagaacaaagctggaggcatcatgctacctgacttcaaactgtactacaaggctacagcagccaaaacagcatggtactggtaccaaaacagacgtatagacgaatggaacagaacagaggcctcaggaataataccacacatctacaaccatctgatctttgacaaacctgacaaaaacaagcaatggggaaagaattccctatttaataaatggtgttggaaaactggctagccacatgtagaaaggggaaactggatcccttccttacaccttatacaaaaattaattcaagatggattaaagacttcaatgttaggcctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaagtatcagaggaaacaggcaacctacagaatgggagaaaaattttgccatctatccatatgacaaagggctaatatccagaatctacaaggaacttaaatttacaagaaaaaaaacaaccccatcagaaagtgagtgaaggatatgaacagacacttctcaaaagaagacacttatgtggccaaaaattatgaaaaaagctcatcatcactggtcagagaaaagcaaatcaaaaccacagtgagataccatctcacaccagttagaatggtgatcattaaaaagtagggaaacaacaggtgctggagaggatgtggaaaaataggaacacttttacactactggtgggagtgtaaattagttcaaccattgtggaagacagtgtggtgattcctcaaggatctagaactagaattaccatttgacccagtgatcccattactgggtatatacccaaaggcttataaatcattctactataaagacacatgcacacatatgtttattgcggcactattcacaatagcaaagacttgcaaccaatctaaatgtccattagtgatagactagatacagaaaatgtggcacatatacaccacagaatactatgcagccataaaaaaggataagttcgtgtcctttgcagggacatggatgaagctggaaaccatcattctcagtaaactaacataggaaaagaaaaccaaacaccacatgttctcactcttaagtgggagttgcacaatgagaacacgtggacacagggagtggaacatcacacaccaaggcctgtctggaggtggggctaggggagagatagcattagaagaaatacctaatgtagatgacgggttgatgggtgcagcaaaccaccatggcacgtgtatacctatgtaacaaagctgcactgttctgcacacatatcccagaacttaaagtataattaaaaaaaaaaatcaatgtgtcatttgagtagctcattgcacccaaactggctattgcacaatttcagtttatacaatctattaagagaacgcacacgctctcgtctggttagaacgcattcttcttcctgagggaaaacctgagcttaggttgttctctctgaaacatccccactaacggggatgtcccttgaaggccgcagggactctaccttttatctctaaatctctggagcctaccttggtgcctggtacatagcagtcactcaattcatggttggtgggtttatttttttaaaaatagcagctgtcatttaaccagatgctgctttgtgggaggccctttgcttacatgatcactaacacttaaaacaactctgtgaaggaggctaacaaatcctgccttacagttgaggaatctcagatttaggaagattaagaaacttgtccacagctacatacctggtcagtgagtaaaagattcaaactccaaagcccagctttgcagagtctgaagcaaacactacgctgtacagagtctagtcacctatagtcactgctgatcttgccatgtctcgggcaccactgatgcctcactataactgaaccaagtgggaagggggcactgatctgaatgtattctgacaacagaccatgccctaggatgtaagtccctggtacaagactgttttcattattcttactcctgtctcctaaaagcaggcaagaaaaccagtttttgatagattagaattgcactctattttcattcggataccaagtcctgagacaccttagctggctaggtaagtctggtggtgggagacctgctcctgaagccataagcaagttaacatatgtgaatttcctctgtaaactccacatggctctatgacaacaacacagtgttcaatggtatcacggtggtgaaaagagcacagatttttaaatcagatataacagaattagaatctgcacctcccccttacaacctcatcatctagggcaagttgagttaattaacctctcaaatttctaattcatcatctggaaagtgtacagaataatctgcacattgcaggatgtggtgaatattgctaggtgttcaccaacatctgttctcccttgctcccagggcacaggcctgaactacgtttcccagttcctcccccaacccctggaatcaggcacagctacgtgactaagttcgctccaactgagtggaagtgaaagagttgggaactgcttctggagctaagccttgagactgtgggctggccctgctgggctcctttttccacttcttgtgaaggcctgaggggcggtggagcaacaccatggaaagaatccgggccctgaataacagcatggagtggagtcacccacccacctggtacatacattacacaatcagtgaaaaagaaataaatgtctatctcctttgaagctactcaattatcattatgtccctttgttacgagaacctggccttacctttgccaacagtgtttttcccacctattataatgcctggcacaaattgggtactcaataaataaatgatgtcattgctgctgctgttaccactactgccacacctaccatgcaaagcagttcccttcttacacacattgaaggttccacggccacagacacaaactgctgcccttagctacagaaaggaaagttaatgaaatgaagatggctctggaggaaaacaaaatcaaaactttcaactctagaagaaatagcttaaagcacatgccctattgaaggacaaacacttagctaaaacagccatcatcattgttgcttttgttaggtattatgtttttgaggttatagcaggaaagcttatagacacagcacaagaaggaaatttaggaaggcatataatcggggtgtccatgttatacacagggtgttcacccaatctgcaaatgtttattaaactattcaccaaatatttgtgaaaccaacgaggtaccaggtatttgctaaatggaggtacagataatagcctcaccctcaactttcacaggagttttatcacaaaaaaaatcaaatgaaaataagtagcttattgtgtacatgtgacaagggaaaaaggagaggaacaaaacctacccatgttgtgaggctgcacgagagagcaaacataccaaagaatcttgctttattttctcagcgaaaagagttctagtgcacccatcagttgctcttgtaaccagacactgtccaaggagcatcagaccatcccaactcaagaacaaatgtcccagttagccatggctaaagaacacttcccttaataacgtcttttgatcggcacgaggaaatctacctatatgagtacttttttggggggttcagtgagtcactcacagacctatttctcaccaagtcattcggaaacgtaaatgtccagaaaaataaattttaaatatgataggacttcctggatgttaaattcaatttcagagtattttctcatatgagagtcattttgtaaaatagacttttgcattttaacaaaatcatcatcattaatacctatgcttataggtctaaacagtttcaatcaagtcacaaactaaatcaggctgcccttcctccagaccctgacttgctaacagatgccactatctgttcaggcaccctcctttcctcttcccacctctctcaaagccactcccactgtgagtatcctcactctgacacttgtgtactggaagatgatttttcaatgagaaaaaatctctctttaaatgacatttttcaaatttaatatgactaagttctgcccccaaacctactccttagatgggaagattcattcccatctgagagatgacagtatttatttttctctaatacatgagcagtattataaaaccttcccccatttctccccaatccatgtcatccagtctatcagagtcatgacaattctgaccccagaatgtatcttgaatctatttcatttttcccatctcctacatctcctatgccaacctcctaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcccagggaaagccatcgtctccggcccagggaaagccatcgtctccggcccagggaaagccatcatctctagcctagggaaagccatcgtctgtagcctagggaaagccatcgtctccggcccagggaaagccatcgtctccggcctagggaaagccatcgtctctagcctagggaaagccatcgtctctagcctagggaaagccatcgtctctagcctagggaaagccatcgtctccggcccagggaaagccatcgtctctagcccagggaaagccatcgtctccggcccagggaaagccatcgtctccggcccagggaaagccatcgtctccggcccagggaaagccatcgtctccggcccagggaaagccatcgtctctagcccagggaaagccatcgtctccggcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcctagggaaagccatcgtctccggcccagggaaagccatcgtctccggcccagggaaagccatcgtctccggcccagggaaagccatcgtctctagcccagggaaagccatcgtctctagcctagggaaagccatcgtctccggcccagggaaagccatcgtctccagcccagggaaagccatcgtctccggcccagggaaagccatcgtctctagcccagggaaagccatcgtctccagcccagggaaagccatcgtctccggcccagggaaagccatcgtctctagcccagggaaagccatcgtctccagcccagggaaagccatcgtctccggcctagggaaagccatcgtctctagcccagggaaagccatcgtctctagcctagggaaagccatcgtctctagcctagggaaagccatcgtctctagcctagggaaagccatcgtctccggcccagggaaagccatcgtctctagcctagggaaagccatcgtctctagcctagggaaagccatcgtctctagcctagggaaagccatcgtctccggcccagggaaagccatcgtctctagcccagggaaagccatcgtctctagcccagggaaagccatcgtctccggcccagggaaagccatcgtctctagcctatgttattgtgacactcttaacctcatctcatgcttgaccccttgaatccattctctatatacttctctagacagaattagaatcatctttttacaaacatgaaggattcagtcacacccacatttcaaacatttcaatggttttctgctacttcagaagaaaattgaaacttcttcaaatggcctaacacggctccgcttgatccagcctctaccacacaacagccatccccactcttctagccttgctccctcatggcatggctttaaatgccaccattggaggaagtccatccttaatcacaaaaccgaaaggaggggccacgcacggtggctcacacctgtaatcccagcactttgggaggctgaggcaggcagatcacttgaggccacgagcttgagaccagcctgggcaacatggtgaaacctcgtctctactagaaatacaaaaattagccaggtgtggtggtgcatgcctgtaatcccagctactctggaggctgaggcaggagaattacatgaacccaggaggtggaggttgcagtgagccgagatcgtgccactgcattccagcctgggtgacggagtgagactgtctcagaaaacaaaaaacaaaaaaccccaaaacttaaaagattctcccttgcatgagaatcttatttgccctccacttaccaccatttataataattcctctttttgtttccttcctgccctgttattaacacctctgaaggttggccccatgcagggaacatactacttttatagtgcactcggctggcaagcagtctttcttactttctctgtgttgtgtctatgtatacacagcatatctgtgagggagatattaatattattcccattttacagataaagaagatgtgaagcatatggaggctaagcccctccctccatcaggccacagagccaggtgcaagcccagtctcaccccagcatcctggctcctgtcagctgtcgtttatcatcactatacaccagcacgcctggctctttgtaggagctgagtgaacatgggcagaaggaatcgtgaagtaaacgcttccaagtcggaacatccagagacatttggttcctctctaggtgctcttacccattcctagttctactatttatgctgggaggcatcttctgtcccttactaattgataagttcatctagggcaagaatcatgatttatccatcttcgtgcctctcatgatacccaacagtaggcgctcaaaaaacttttcctagtgtgtgcaggcatttaaaactcagtagaaattaaccacaattgcaatgaagtaaaattcaactaagagttcccacaaaaaataagtacaacagtcaccattccagtcatttatagagctgatctgaatccagaggtaagtttccagaattaaagagctgttttatagactgcgtctttctacttcacgagtgggtagaaatcatctttattagaaaaaaaataagtgcgggagggcggggggcagagagaactatttcaaaaggtttttccctgtttgtcctaaatcctccagagcaggcagttaaacgttgagtccagcgtttcggagcctggccagtctattacaggccttggtggtgaaaggcagagtggcctcatccaagctttgtctctcgtcagcaatgctacctgtgctggcctttccgccttacttcccaaactcctctcccatttctcatttctgctcccatttccccttgttccctccaacactacgaaggcaaattatggggctcaatactgagaagtcctttccaccttattgataatgaatttctttcctgggaaacacctgggaaagagaccaaaaattcaggacagtacagcctaatctgaggtatctgtccattcttggcaggtatgcattgctaaaagcatgtgactactaccgtatatcagagagcccttttatggaacgtggctctctgctccatgagtgggtggaaataatatttagtgaaaagaagagtctcggcatcttaatgaaagaaacctagataggagatgagtcatttaaaccctctctctgtcatcacacagaaatagcttgaagaaagaaggagtcaactcaaatgcccaaggagggcaatggcaacagagatttgggaatcttttccagggtaaaaacaactgggatgggctaggggtgaataaggaagttccatcctgtctaaaggtgtctgttatggggtgaattatgttccctccaataagattatgttgaagtcttaacccccagtaccctaaaatgtgaccttatttggaaataaagtcactgtagatagaatgagttaggaaaagatcacactagagagtaagtaggcccgaaattcaacatgactggcatcccagtaagaaggtggccatgagaagacagacacaaggagagttccacatgaagacgggggcagagactggggtgatgcaggtacaagcagggaacaccaaggacagcctgctgccaccaggagctacgggaaagaaacggaacagtctgcctcagaaggagctcaccctgcccacacgccctgatttcagacctttaccctcagaattgtgaaaaaaattttgttgttttaagctaccctgtttgtggtatgtcaccatggccgttttaagaatcgaatacagcatcccaattcagacttaaaaaacgcaagatgaccaaacccagccccggcagctagatggtctctaattccaatgctcactattcagtgggcagtcacatttctgtcaaaaacaaaaatgcagttacaaaacattttctggctaaacaatgcattctcctggatctcacacatcagaattatcttccagatcccaggggtgagaagcgcagcttctgcgtcagacaccagtctagtggacatcgcacgctagccctgccactcgccagctgtggggctttgggagctctgtgcctcagtctcctccacctataagtgggaatgatagtgaagtcggcctcacagatgaggatgcagggcacactgggaagcctgctgaattacaacgagggggagaactcagcaacccaagcggcatgatctctatcacaggctgcagcactggattttaccttactgtgcatgatttttcatttgctttactgtgaactcacctaggacggggtccaggccttggtcacttttgctctccttgcacatgtgtggcaggtagtcagacatgcctcgggaatgaaggcaggaatgtacttcatcgactccactcctgtgatgtgagatccctgagggcaggacccaagtcctacatcaaccctagagcccagcaccaggtaagaggccacacagagggcaacgaagtcattgtgttggaaggacgtctgtagatgtattgctcaactctgccaagctagcatgggagcaggaattaaatgcttcattccagtttcaaggtctgagtttgtctgtttcctttctgcttatcacacacatgacatgtagaacaaattagggtgatgcttcctcactgaggctttttgggaaacctattaaaccaaggtggaaaaaataattcaagaacatgacaaatgcagctgtcagtaactctgcaacaggcagcaaatgctgagaaatgcacttattctctatggctgccgacgttgactggaaagctgctttgcagtctgggaaacaaatccctactccagactgtatgatatggattctgtctcagtggattggcattgtctagactagcagtcaacaaactacagcccatggtacctcggccactgtttttgtaaatcaagttttgttggtactcgtccctgcctttccagttatgtattgcttatggctgcttttgagctacaaggcagagtaaagcagttctaagaaagacggtatagcccagaaagcctaaatcattcactatctgaccctttagagagaggtctgttgatccctaacttggagtatcccactgtgattacacttaaaattaagcttgaagaggacagaaaccttgtttatctgggtcagacctatctagacgatgacctacctgatttatagtaggtgctcaataagtctgcaaagaataaacatgaggccaaataaatattgaggttttaggacaggtagtgccaacagcacacagtgctaaggggatgcctgctgggctagaccagtgtcccgaagctctgccctttttgagaggatgaggatctgccactgctgggtgtcccttggttaactagctacctgagagccctctgggagccctgggctgcacagacaaccaggacatcttcattttaagaattcaatagcattgagctgtcaggacagattaaacctgactaagaagaacctttcagaatccttctatgtatatacatttacattagaaatgttttaaaggaataaacacttgcaaagcggtttaaatttaaaggttcccttatacaactgaacccaaaacagctgtcagaaaccaaacatttataaatacaaatgctcaaggtaccaagtgaaaaaaagatttttagatctaaaagaaaaagtccaatctatcctgccataacaaaagcaaagaaggaaacagaaaagccagactttctgagaatgatcctttaatgttaatactgaaagcatgtgtaagttctggctccaataaagttgtttatggttagagttaagtaagaaggggtcctttaacttgggaaacgattacatagaacttgttgcagaaagaaagaattccatactatttctctttttctattttgtcctctcaaagaactgttgcttccatgcatcaggtcttcaaaccaggcttgggcaggcgagtctcccagccctccctccagcctggctctgggtgcagacccacggtcatggggaccttgagcacgtggggtcttcttttaggagggtttgtggaactgtagctctttacatagcccagagacattctccctttaaagtttttgggtaatgctcaattccatctttaaagaggtgggagttttaatagcacagctgtaatagaatcacatttcgagtttttgagacaggatcttgttctgtcacccaggctggagtgcggtagcatgatcacagctcattgcagcctccaccttctgggcttaagtgatcctctggtctcagcctctggagtaactgggaccagcatgagccactgcagctggctaatagttttttgtagagatgaagtctcactatgttgcccaggctggtctcaaactcctgggttcaaacaagtgtcctacctgggcttcccaaagtgctgggattacagatgtcagtcactacatctgtcccacatttatatttaaatagaagtagcatcctatagtctcaatttctgatcaaatgtgaaacaatcaaaatgtcagtctgagagttgatctaatataatagtaaaggctcacttataggctaaatacttccatcaaataaatcttaaagtaacattttctaattcaggttttgttttgttttttactaatccccttctaaacccacttaatttgtatttaattcatattcccaataataaaatcaaggaactacggaaacattgcatattccactaaactgtgtttacaatattaacaaaatctatttactccatagaataagcaaaaactcagacaagaattgactcactgggttcgctttgaggactgttatattccatttagaggtaggatttccttatttctttcgtagccacacctttggagatgtggccaagcattctttacacgaaacaagaaacacttgcaaagcggttcaaattcaaaggttcccttatacagttgaatccaagactgctgtcagaaaccaaacatttatcaacgcaaatgctcaaggtactgagtggaaaaaaggttcttagatctaaaaagtccaatctacccttccatagcaaggagctggggctctgcatgatggtagatgacttccaacgtgatctttccccccatgctaccagctgagaagacctcatactgaaggtcttcacagagacaagatgcctcatctccctggccttattttgtggcagctttcgggacattgttttcagttataacttttcagactctttcaccccatgggggttgtgttcccatattagaattaatataaatgcattttcatcaaaaggaaagaaaatagaaaaagaaaattaatgactagttacagcaaattcattatttcccctaaaaactaaacacatcaaaatgctgcttctttatccaaattcttcaccatattgaaatcatgaaatgaaacgacaaccagctttcatgaccagctaagaaacgcatttgatgagatcaaaagtccagcacgtggccccctgggacccacgaccagatgcccatggcagatttttaaattgtttgacttttcttcttaaaaatctacgtcctgttttgctgttgttcatttcaaacctcctgtgtgggagtgttaataaaatctaacatctgtaaatttctcatattggtttgatgaatccttgctcaaacattctcctttattctggctctaaatgatgtgatctcagccatctcctgaaagtatccaaagattaagacaaagatttaaaagccccattgaaaccacaaacaaaaagcccctgaacacctcaagactgagtctcccaacacaggctatgatggaatcgtttcggtttcaaggaatcagtagcaagaagaacagtcagctcctgctgagaaagggccaggaggaagagtgtaatgagggagagaataaaggtatgcttcagcttaaaactaatcatattataggtcaattagaatgcaacatttccaaaaccttaaatgtgtatttcatttgagtaaactcaatcaagtctactctttttttttttttttttttaaatggagtttcgctcttgttgcccaggctggagtgcaatggcgcggtctcggctcactgcaacctctgccttctgggttcaagcgattctcctgcctcagccacccaagtagctgggattacaggcgcctgccaccacgcccgggtaatttttgcatttttagaaacagggtttcaccatgtcacccaggctggtttcaaactcctgacctcaggtgatccgtcccgccttggcctgcccatgtgctgggattacaggcataagctactgacccagcccaaccctactctcatctcaggattcaatggacaaaactgcttcctagttcaaaaagaaaaagtatgtcatcaggaacaaagcccatcaacttcacaaccatgcagcacaaatctatttgtgcctgcgcccgcagaagcacctcccctcctgtgcaagggcatgtgcactcacctgggccctggatcccactgttcctcttcatctaggacaggagctctccagcttgagtgtgcgtgagaatcacccagaaggctcattgaaacacaggctgctgagctccaaacccagagtttctaattgagtaatctgaagtaaggactggtaatttactttgctaacaatttccaggtgatgttttatgatcccagagcagactctgagaacaactaatctaagacctgctacactgattatcctctcatcctacatttttgagtctctcctttcatattgcttctttccctaagcatataaacatgttcaaatttgtcatcttaaaacataaacaaaagtctccctgacctccctgggaatgtagtgtatttctctttccttctgtacacatgtaggttcttaagagaatgttctccatacaccacttccatccgacttctccttgctctgtaatctatttgccctctcaactctgctgaatgtgcacatctcacgaccccacatgaacttaacagtttccaggccaatggatacttcttaagtccctgtttgactctctgccttacctaccatcgctcacctgaccacacagcattccctcctcccttggattttataacctctccctatcctggatctcctaccacctccttcactgcctcccttttggtctcccgtcctggaatatctgcttttcaccatccctataagtgctggggatcccttgggacctgtccttggctctcgtcttctgatgccatacattttgcctgagagttctcatccatgcctgtctttcacctataatctatatcctaatggctctcaaatctagacttctcttctaaacttcaactacatagaatgatcatcaattagacaattatatttgtccaataggcatctcaaagttatcaatacttaaaagtgaacccattaatttctaccttgttcctgttccccttcctttattttttacctaacaaaatggctcctccaactgctcactcatgcaaaccacctttatgtccttaaggaaaaacatgtccttacgtctcaagcacaatcacagttcagaggtgggtccaatccacctcttaactgtctcaaatctgctcccttattcccgtctccaagactgttgctccaacttcggtcaacatcataatacttggttcttccctttcttaactgcatttctagtcacctccttctcatattttaagctccaataacaccaaaaactagttaatgatatctttgaatgtggcatgctctcttacaatggaaaacttctatatattttattccctctgcttggaaaattattaaaatccctgcaccaacatgttctttccaaaaccttcccaaatgttcttgactttggactcctttctggctctcattccacttgaaacctgcctccattacagcaattacctgtttccaagcctaacactgcgccattcaaaggtaaatccttgaattcctagtgctgataatacctggctcaaaataggagccctactaaaaagtacttttatacaacatacatcagtgattctgaacaaggaaacacactcccctggcagtagagtaagcgagtctaccaaacattttaggatcgtttttagcgtttaattctcctcctacagaattttagataactaacatcacatttatttcatctcaactttaacatgtttcatctcttgtttacttcatttcttcaaggaactgagagaggacccactgaaattcagtttggggatgttaggaacctgttggaagattttctggagaagttttctcattacaacagtgtttcctttctagtcattagaagaatgaagggagctgagggaagcagatacttgagagttttacattttctgtacctcagtttgttctctaccatttcagtaaaagacagctactcccaaatacatttttgctgtatgcaactgtgctgttattcctgtagctggtccaagttttatagattactcacacagccccctagtgagcccagctgcttttatactattatgatgccataaacaaaattacataacattttaaggccagtaataaatgcctgaactagctgactggaacatgtagcatttgggcattttcatggtcttcagtgacggttttactgccctgaaaagccctccctgtacgttatcaaagaacaggaagtctccatgtctccactctcggttgttccagcctaaaggtgacccacccacgcccacatgcaaggctggcaagaacgggtcatcgtcaaagagaatatgctaagtgcattgaaacaggctgtgtacaaccttcatcaagcttcaagtagttaaaatcgtgccttacaagtatttttaaagaaaactggtataggtggatacagcaaataaacatgtatttgaaaatccagagacaaatataagtaaaacttgatgaacatatttgcattttatgtaaatgtcaatgtacatgttgtggaacaacttggctctctgctggagagcatacctccttttaaatgagtcaccacttgcggatgaataggaaaacgctgacagatccatgcgagataaaacggatcacagcagtcttggaatcaacacacttttatgatgaaaccaactcatattcatgcctccaaacacagcttaggcttgaaaccaagttgcagaacgtccaaaaattcttgaagaatccagatgttcccataatcagccactgatcaatttcccaggagaaaaggacttaaacaaggatgggaaattccaagacgtttaatacccagaggatatctgcacccagagaaatgtcacactcagaccacaggaagctatagctctgctgttgactgatgtagtcaggtgtctagaattttatgccagcctctacccactacacaccattactgttttgagataaattagcaaacaccaaaaattagaggtaaaaaagatctagaaaaaaaacaattgaaacgaactaaagaagccagagccagggaggtttaacaatcattagtaacaggtgatatccactgaaacttttccatgttcttccagcttcacgctaagaacttcacgttttcttaacttattcctcacaacgatttttaatttaaattgattattcccactttataaatatgaaaactaagacttagcaatattaagagatttacccaaggcacacgacttatcaacagtggagacggaatctgaactcagtctttctgattccaaagtcccggcacttaagcaccacactggagcctgaagcaaaggctcatgggtgaccccagtcttaaacatctgagggtttgtaacatggaagacagaacagcttcgttgtattctaaagcaggagtcctccaaacctgtttgtactggagaatcatctctgaaacttaaaaagaaaaaagaaaatccagtttctacggtcccactcacagactctgcttcagctgatctggcatggaggccagaaaactgtatttttataatgctctgctgggtttgagaatcaccgctccatacctcagaactagaataaacgcagaggaatcactaggaggcaggtttggctttacgttattaaacagacaaaccaaaccaaacacacacacacacacacacacacacacacacaccgccacccacaaaccagtcctaaccacagggctacacaagcctcccctgcccagtcctaaccaacagagcttcccaaatggagctgtagctgcctgctcaagcgccacgatataatggagacaacccagtctctggaaacagaggctgccatttccagttctgattcagccattctcaggtgtgtagctctggtcaagttattttctctgagtctcagtttgctcaactggaaattattggagaacacttacctcaaagaattgttaagaattagagacaattaggtaaaattcaaagaaccgtggctgatgtggctgatggtgctcataagcaaacggcacctgcccacttgaaatgtaaccatcttcttctgtagcttctgtagcgagcctctgcatgtggacagcgtgggccgcctctgcagcacccttccccttattcccaccattgtcccacccactgacatggccacgtcctattggcttcaagcccagattttagcaatgggctctgactggcctaatccaatcagcccacacctggcccccttgccacagccataggcagggaccagagcccaggccaatcagcagatggtgttcctctggcagagaacggtttgggaggaggctgagcatgtgtccaaaattgggccaatcagagtgaactcaaaggctttttttgtcagtaggaggaaagggagtatctcctcttccagaatgtatgacacatcagcctgagagctgacgctcagcagccattctgctaccaagagcctttatcaaactatgtctgaagcctgggctatctccatatttttgagatctgtgaaccaataaattccccgtatcatattatttaagccttgaggttgtttttctatggccaaggctgaacacattgtaacttatccagaatcccctggctgggagtggtgagatgtaaccacttagatcatttctaacttcatgattccatgacttcttagactttatccaattaatacctgtcttcacatttataacacttctgacgactggtttctgcagcctggaacatcctgtccccctttctcttcttaagaaatcctgctcaccttttaggacccaactgaaatgggtccactgctgcaagatctttgaagaggagtcagttaatccatcttcctgtgcactcccccagtacttgaccatttcctctcttatccttaatttcattgtgtacttttctcactcctatcttcacctatgtttaggctgtgtgcactttgaagacaacacccccttccctaggcattacttgttaacaggccaactgtgcagcaaagtagcacaaatccagcttgctgcacatgtccaatgcctaagatgaggctgggcctgcagcaggcttgcaagaaacaaccactcattcattcaatgccacatgagtggttaactggatacaaaggagaagcaaacacaacgaaggcttctgccttaaccttctaggtgtcctaccttgtaccttgaagggattagagagaaaaacattctccatcttgcactgctgatttccaatgacaagtggggcttcccccctcccacagaggattacaggccaacttgggtatggtagggttttggggactggaggtggtttagagttttttccaatcttattaaacttactcagagcttaacatctattaatgaaattatgttttctataataaaagtagagactcaaatcctatagatgccctgaccttaagatataaaaattcaattttaaaaaatattacacataccaaatacaaaagatctattctgtgacctcttctctaacaccaacaactgtaaatttaatatcatcctgtgttacctgaggtagttggaaggtgtttcttctacgtttgttgtatctagctttttcttttcagattttattatttatttatttttgagacagggcctcagtctgtggctcccaagctggagtgcagtggtgtgatcatggctcactgcaaccttgacttcctgggctaaagtgatcctcccgcctcatcgtcctgagtagctgggaccacagggatgtagctgggactacaggcctgcaccaccacacctggacaattttttattttttgtaaagacagggtctcactatgttgcccaggttagtctcaaactcctgggctcaagcaatcctcccgcctgggcatcccaaagtgctgggattataggcatgagccaccatgcctggccagctttttctttaagtgagaaaaatggtgagagagaactgtctcctactcctacttccttttggtcacacagctatctcgaccttgaataaaatttctggatctgacatggtttcagtggctgcaatgagaaaggaagtatacagcacaaactaggagtagatttgttattcatactccaacacctgattaccttctcaaaaaccagggtatttcctgcaacccagattcctcattgacaggaatcatcttggtctgaaggaagggatcaggagccaagaaataagagtggcctctagaagctggaaaaggcaaggaagcagattctccctagagtgtccagaaggagccggccctgccaacaatcttgaattttagtccagtgggactcatgtcggactttggacctacagagctgtaagataacacgtgtgtggtttttaaagccattgatttgtggtaatttgttatgacagaaacagaaagtgagtgcactgacttccctgtaccagtgaccactaactggcatctacactagtccctttccaaacagtagtgctgtttaaaaaaattgttatgtttatcaacatgaagcatcataagaagtcacaatcgtaagttgaagtcaattagaaaaaagaaaattctaacaattaccaaagatccaaacaagaaaaattcagtatcaaacattcctcttatattcacaaaagagacctgaatacacacatgctttaactaaaatgatttctttcctatatgtggaaaaaatgcacttattcattaattcaacacataatttacagagcctctcccacctgccaggcactgtgaagaatcctgagggtttcctgccatctatctgagccagggcaggtgtggaaaaaaattttcacattagttcattaatggtaaaataggaaaaaggaatagagccacagcttaaaagttatgtcgttatagacagagataccagcagagaactaagccacgtgcatttgttatctgtttctgagcagcttaaagcaaccagctaagtgacttcacacagttctgagggtcaggaatccaggagtgtcttagctgccatggttccgcctcagggtgtttcaggaggttgcagtcaaactgtcagccagagccacagtcaactcaaagatggacaaaggctggggcatctaagctcactcctgtggttgctggggaacctcagtcactccccggctgtttgccaggggcttgggttacttgccaggagggcttccccttagagctgctacaagaaggcaggtggcttcttcccaagtgacccgagagagagattctgaccaaaacagaagccaatgtgttttacaactgaaccccagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggtcacacacaccaactgtgatgcagtgtgggaggggagtgcccaagggtgtgaacctcgggatgcaggaatcattgggatcaggttgaagcctgactaccacaccatgttcttccaaaacatttcaacaaaggagccatgtagtaaaatcagcatggttctagaatggcagtcatggggcctggagtagccatggatcggccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcagctactctacaatctatcaaggcctcggtttccaaagccgcaaaatgacaatggagtcccatctattaataaaactttgggaggtagaagggctgctgcttctgcactcaacgtttactgggtgttcatcatgttccagatactgtttgaagcgttacacccttattaactcactttcttctcatcataaccctctgaggtggttacaatgttcactgctgtgtaagagctgagaagactgaagcaaagagagttcatccatttgccaaagcctcaccattagtaagaggtagtcaggattcgaacctaagtggtttggcatctaagtccacattataacccactgtactctctaacagagggtatggaaatgatgcaagtcagtacactataaaatcatcagcaatactaaactttaaaagaagaaaccacgtttaaaaaattggttaaaaaataggagccaagcatggtggtgctcacctataatcgcagctactagagaggctgaggtgggaggatcacttgagcccacgagttcaagaccaggctaggcaacatagcaagacgttgtctcaaaaaaaaaaaagatagatagatagatagatagatagatagatagatagatagatagatagatagacagacagacagacagacagacagacagacagatatagattccatttacatgagggacctagagtggtcaaacttataaagacagagggatggatgccagggctgggggaatagggaatggggagttaaaatttaatgggcattgaattttagtttgagatattgaaaaagttcgggggatggatggtggtgatggtttcacaacagtgggaatgtatttaatgtcactgaactatacacttaaatgatttaaatggtcatttttatgttatgtatatcttaccaccataaaaagaagacattaaactacaatatccaatattccatccaggggcttcctcaaaatggaaaatccccatggttaatcgctttagatgcatagaaaatcgttccgttctaaggtgtaggaagaaatccaaaaggacttgtcttttctggttggtccatcatcgctctctcaacttcttttcattgcacttttcattacagaaataaaataaaatgtcggaagagtttctgttactcttatctttcccaagtcacattaagtaggaatttttaatttaagtgcattccatttctaaagccaggaaaatctgcccacacgaggtgcttcatagcatacacattaggaactcctctatggttctcattatttacacccttcctcggatgtgccctgtgtgttttgagagtcagagattggcccgacaaaatgaaagcgaaggcgtcagctgagagggacgcggggctttaggtaaaggacacacgatgagaggccctggccatcgggttactgttgtccacgtgtcggatggctagagacgctgtgagagttactctctctagaggtcagcactttggatgccctcaccctctgaaataagcattttctcccgggacatcaaggagctggggactccaagcattttcctcaccactctggtcatctcccacatttaggaggaaagttctacttccatgaggcctttgcttgcctcatttcagaaataggggagggccttctcataaaatgactttttatgccttagttaagagcatatgtttaatttaccactcacttccctctcattatccatctatgtgcggatcacagtactaggtggtatgaagtgagactgagaaagtaagagatgaagaaacttaaaaaaaaaaagctgtaaaaaggacacaggtaaaatctaaccttcggctgggcgcagtggctcacgcctgtaattccagcactttgggaggccgaggtgggtggatcacaaggtcaagagattgagaccatcctggccaacatggtgaaaccctgtctctactaaaaatataaaaattagctgagggtggtggcatgcgcctgtagtccaagctacccgggaggtggagcttgcagtgagccgagattgcgccactgcactccagcctggtgacagagcaagactccgtctcaaaaaaaagaaaaagaaaatctaaccttcgaagaaatggaatgattaagacacatgaataaataaaacaccacttacctagaagtttctaatgtccagtaaacaaattgtcatgcttgttaaagttacatatcacaggtggcttcataagcctcaggacaacctgagaagcagccctgtgctacacggaagtcatgggactagagtagaaacaactaggtccaaaccctgaattccgcattaattcatttgttgattacgacgtccacccatatgacaagtatttagcctaagtctgtttatacacctgagaaatggagaacagtaacaaatgcctgagggtgctataaggattaaacaggtaatttatgccaacgtgtttggtaaatatttacagatgatacaattatgaactgtagggctggatgatatttcaagatatcaatttgtgctcttctctttgcattgcctttctttttctcccacagatcagactctgctcagtgcctcaggggaggcatgtggcagtagagaaagcagaaaccatctgcaaaatctgggatgcagtagggggtgggggagagactaatgcagcctgcagggctgacggagcaggggcctaggccccagttctaagcagggctgccacccagaagcacaacttccccaggagggggatttggatagacagagacacatgcaactcctgagtcctatgtgtggcaaggatgcatcagagagccaatagacatgcacagggggcaggccaagagagccatgcccctaacagcttggtcctggggatgagcccagaaccctgagaagggagatgaagttttccaccacaccagtggaaagacaatcagccagaaattgggcagatgtatagaaaaaaaaatgaaatgttatttttggcacattagagtttggggactgagttttatacccattataatatttaacttcccaacacctaaaatcctcctggcagttaacaacgaatgcccaatggaagaaatgtttcttgtttaatttcataaatacatatagagaagccatcttctctgactaaaaagaccacagattgtgctgctctaatgaaaagagcattggcagggcataaattctgaaacgattttctatatgttgctagccacatagaggatgctaaataaaaagctgttggctgatgggtgacaaattgtccagggcagctcataacttccctagactcttgagatcaatggcacacacctgccaaccagtgggctgggattaggggtataatgtgttgtgatgaatggaccttttctccatgcaatgctaatgggtttatatagaatagaattcatgatacaggtgttattttaaacactgtgctctaaccccttgaaaactgaacaaatagacacatactcattaggccaggaccacatctatcaagttacctaatgcattcccagagcctagaagactactaggcacagagtaaaaattcagtaactatctggtgaatgttaactcacagaagacacaatactgcctctaacttcacctatgaaatgcaaagtagaggcgtaactccaacaaataaagccaagcccagtatttaaaagcccaaaacaaatgaagtgcaacaacagaacaagagctggctagctttccagtgtccccatccaaactagggacacctacagaaacacagaaagttcaaagcctatgggaggggaacgtgggggagggagagggacttatttaccagccccagctttacacttcctccatctcctcctcttctttagcaagatgcctctgtgctttccatgaagaagtcggccccagaacatgacctgcatctcagagaagttctgatttatgaattggcactgaggcgacgtcgctggtgcggaacaccatgacgtctgtgtctagggtatgcgcatatgctgcgtttttccgcaggtgcctcgcagtctgctctggctcttagggcttccgaactcagttcagggcatggattttaattaacgaaatgaaacactggccctacacgacgggacacttaatgaatttatttaatgatgccaaatatggggaacccctttagggagagaagcaaaaggaacaggagaaaaagatcaatttgttaaaagacagtcaaagcaactgagtgttactctcagacaggggggatgtcaactggggagtgatccccagaaaatcaacttcattgtgaaatcagaagtacgagcatctttctttcaactggaattcattgagcatctactgagctgctatttcagcacgcttgctgctgggagacacagaagacatccttcctcctcaacatgcttctgatagacattattaagaaaaactatttttttggctagcaatgcagtttcacctcacatgatttcacttccttggagccgtgaatcagcagtggcagggattatctcccctgaggaaaaccaagatgtgggctggctggctggggtagggtggtgagaggcagtgctgtgcaggaaaggactttctccaggccagcaggctatgcagttacacagaggagcaagccctgcacccaccatcgtgattcccaacccttccccagacctcagcacctccaccaccaccagggaaacaagacacagtcacggcagcggacagcactttaggacaaagggggaaggacaaaggcaggatgtgaggatggtcagggagtgatcagaactgctgggagaaagatcagccattgctaagtgtgtcttcaagccctacacttccctggagagatcacagctttctctggcagatgctcagacaagaggtcacggataggcactgttctggcaattgccagacaaaccaacctctttctgatcccactgagaggctggacaataacacagtctgtagacaaggaaattcaaagcatggcattcctccagggaaaacgctgtgctggaccaggaccagggcctgccaacacctgtgagcagacagattccaaaatgtacagtcacaggctggctcctctgaggcttggctcacagtgcttcatcaaaagaaataaagataaggaagtatcttcctgctatcagcccctgcttcggtggcaccccactcatctcttacccacccttggggagggaatggagatctttaaccctgggtaaagagtacaatgaaacttcattttctgagctcccagaggttttggaacgtgatagctcctacagagacatgattcttgctgaataaataattctaagtcagtgacctgactagggactcatgtctgaagcaccgtttgattcttcaattttcaatttttcctccttttatttactagccaatatttccatgtgacaaccacatgcccatcccattaggagggctattacaaaagaaatgaaaagtaaatattggtgaggatgtagagaaactggaatcctcgtgcattgctggtggggatgcaaactcctgcagctgctgtggaaagcagtctggatgctcctgaaaaagttaaactaccaaacgatctagcaattctgcttctcggtatatgcccaaagcaaacgaaagcagcgactcaacagatacttgcccaccaatgttcatcgaacattattcaatttccaaaaagtggaaacatcccaagggtccgtcatcagatgaacagaaaaaatgtggtgtagacagaaaataatattttgccgtaaaaaggaaaggaattctaataatgctacggcacagacaaaccttgaagagattatgttaagtggaagaagccagacacaaaaggacaaatactgtgtgattccacttacgagaggttctgagagtagtcaaactcacagagacgcaaaacagattggtggtgtccagggttgaggtgaaaggggagtggatgattgtcgcttcacggggtaggaatttctctgaggtaaggaaaaacttagaaatagatatggtgcacaagactgtggatgtaattaatatcactgaattatacactcagagatcattcaaatcacaaactttatgttagatatattttaccaccaaaaaaaacccacaaaaacaaccaaacatgaaaccaaactataaagaagaaaacaaggtggaaataaaaaaaaaataagagcttaagaaataaaaggggaagattgcaaaaagcacacagaataataacattagcaatgctgccatattaactgcatgtagatagtatttactctgtgccaggaattgttctgggtgctatccatataacaacttgtataaccttcatgggaaccccttgatgtaggtttttattattatcctcattttaaagttaataattctgaaaaccagcaaggttaagtatcttgcccaagatcacagagcaagacatggcaaaacctagatttaaacccagaaactcttgacctggaatctatgtttttaaacaactaagctggttgccagtataaaagacctaagagtgagtcaaaaaaagaaaaaaagaaagaaagaaaaaggatttaaggatagggatgtataaacaattatatactacctaaagcaagagagagagaaagagagataaagactaatgaaaccaacatactgcattcttatttcaaaagtcaaatattaattgttccataaatagtacaggatactactgatcttttaggctcacccaagtctctcccagaaaacaaacaataaagcagaaagagcacggaactcgaggttataaaatctgctttaaaatcctggctcaatgacttactttgcttacttcttcatttagcgagtatgtaatgagtacctgctaggcaccagggaacatgctggctagttcactcaacgttttgaatcctagttcctcttttataaaattggaataatatacctacttcacagggttaagaaagctaaatgagataggctatgactgttcttgactcctagtttacactcagtaatggttgactgaagatgttttctcttgcctagtttctcagaataaaaattcgtgatgatgataagatatataaatcatgcggcttgggttttcaatggaggcattgtgactgccaggctgtagacaaatctacacagctactcggctccttgtgccccaccctctttcttacccttaagctggcaagatgatgacacatggcagggcaccgataagtgtcggtttttttctgttcttcccagaaggggtgggaagagacaacagaaaggagaaaggaaaaggagacaggagaaaaaaggaacatggaagaaaaaaaaacagaatgtgaagatggagataggatattacttccttcccttctctcccactggggtagaaagggctgtggtctgcagggggcgtccaccttccatttctctctagaatgtcccatagcatcaaccatgcccctaaaccaaaaatgacacaaaccttctccagactctaaaaagcccctttggaccacacaggacttctctctgtttccccctcccctggacaccaccatacacacagttcaatgatgaccttttattttgcatcatggccaaaacagttattaaggagtttcatttccagggcgctcactaatcaagataacagagactaaaatacaaggcctacaagccttacactcatcactggtgattcgctgagttcaccttgtcaagtaaactgtaagatgctggaagacagagaacgtatctaacagaacatatctatcagtgagtatttgctaaagccacatcttgacttatgacatatggagtgtttggaaacagaagatcacatttctacattccacatagatcgaaagtctagctaacttagagactgctttattttgtccgagtaaggttttccttaatttctaaagttctgtgatggtaagaagaagcccaccaattatcagcccatttacaccacttcactcaagtcttacgaaatgaggccgctgtcctgcgcccccgacgaggagggaaacgagactgatgcaaatgatactctaaggccaacagacagaaccatatttaggatcctatcgggctagctccaaacgctgccttcccacctattcacctgaagttccttgtaatttgttagtgtgaattaaatgacatctcggaaagtgttgcttctgactagtgagaaagttttatgtcaagagaagatgaattgctccaaggagaaaaatatgccaggcaagtccaaacacgtctgcctacctacaagtatgattcccacaagcacgtcctcctcttgccaacccatcttcaaccttatagggtgcagatgtttttgaaagtttctccttgctccaggtactatggaagagacagtgtctggcttcatcctggaaaccatggggtatgtggcatccatcatgttttggagatgggccgtttttacattagccacccttgccaaaatctaagaagcatggctgtttctcatcatgtggtcgctggctctgcgagctgtggtttgaagacggaaacaataataatcctatacataaatgactaacattttatggggaagacagaaaatagtttaaatgttttccatgatcctctttttgaactacaaatgatagtcaaacaggggtcattgccctggctgataattttcagaattgcagaccctacagtaaataacattcacagatggttcctttctttgaatatcaatgctctgccttttgggagctggcagctactcagagaagagcattaaactggccagaaagagacctgggatcctctggatctctttcctttgttcagaacaagagattttgacagattctccggccgccagtcttccagctctggtttccagctctggttctgggcgatccccaagagatcacagatactttgtatactttccacatccaccactgtaattgcagagtccctatcttccttacgattctgtttactagaaccaaacccatcatttttgagacattgccaaattcactgcaggaacaagtcataagtccactgagaagcgcatgccagttgtgaggagactccggtctgacgggcaagatgaccacctcctttttattttattatttttttaaatggagtctcgctccgtcacccaggctggagtgctgtggcgcgatctcggctcactgcaagctccgcctcccgggttcacgccattctcctgcctcagcctcccgagtagctgggactgcaggctcccgccaccacgcccggctaattttttgtatttttagtagagacggggtttcaccgtgttagccaggatggtctcgatctcctgacctcgtgatccacccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcagcctcccaaagtgctgggatgacaggcgcccgccaccacgcccggcccattattatttctttagagacggggtcctgctctgtcacccagcctagagtgcagtggtgcaatcatcgctcaccgcagcctcgacctcctgggctccagtgatccttccacctccctctcccaaagtgctgggatcacaggcctgagcctccgcgcccggccacctcctcttacagtagttcccaacccattcttcggcctcactgcatggctcacacggaaacatctcagtttaccaccgcacgatgtaagtgcgttctacactcaccaaagagaaaagaagtctgaaggataaggcagagaagagaaaggttgtaggtaggaggattggtgagcagggaagagatatgatggaagaggcggagggaaagacggtaaaggggcgaagaaatgccaagtgaagatgtgtaggcacacagaagaaccgaacccagaaccagaaaggggaaaaactctattgttctgtggggctccaattcacaggtcattaggctttggaggatccccacagaaggttgtcatctgcttctcaaacctctggcaggggcatcaggtgtagctatgctaccacagcgccatctggtggagcggtgggacttatcatgacctaatcaaactcttttaggactaattccgtcttgcaacaattccaggcaataaatacaggtgacaggatatattattgaggaatatggacagctgaagttcacacattgttacgtcctatggattatctcctctcagaacaattgtagagtaactttacaatccacatactgaaagattccctccccattcctttttatctcttcccaccccattttgaacggctcagctatcaacaaaattttcaataagaaatacattgcctttagatgtacctttttcagcaatgtaaaactaccttgcttattattccaatgatctgaattttgagcatctctttaaattacatacagatcaatgtcatgaagcattaaatttattataatatgtaatataaatatctcacacatctagtcattaaacactaatatttactttgttgcctttctttctccacagttttcccatgtgattctcttaagaacaaaatataatacagtcgtgtaaatctaagtgatttattacacaagtgattatcctagagatactgggacccacgacttggggctccaccaatgttcctctgttatataagctcaggtatgagttctgggaagccacagggcatgggagcaaaaccacatgctttggctcagacctcgattggaattcgggcaccgccacttactaaggggccttctcaagcctgtctcctatctgtaaaatgggaatgagcctaccgacttcataggattgctgtgaggattaaatggaaatcggtacgcaaaatggccagcacagtgctaacatctagaaggtgctgcccagccccaaagagatctaccagagaaataataattctcatttttagtcaagctacaaaataagactcctcatttctgatttgttttataaaaatgcaaaaaagagagagaagaaaagccttccaagattctgataccgctcaccccagttttcacttgaaagtcaaccaatgaatgagcaccagggtgaagatggaattctgccagccacagtacctgcaagagtccacaacacacttgactttcattcatgtgtactacaatcctgtgggttaaagggccataaaagttgtcctggtttttcttatacttcaaaggaagcaatttaatggccatgaatgacagcctcccgattacactgtaactatgaaacacgactgttctggaatgatttccaggctggctccctcaccaaaggaacttcaaggtaagaatttaaacaaaataacctttccaggctttcatccagcttcctcatgcaagaggctctatccttgggagcccagggaatgtatgtgcacacaaagggttacgtagggttgaggccagacagagggtggtctggagagttgtgttgaggcagggcaacccagaaaatggacagcactgttccctggggaggcctatatgctacagacactataagaaataaaagaataagggataataattttttttttgagacagcgtctcactctgtcacccaggttggagagcagtggtgcaatcatgactcgctgcagcctcaacctccttggactcagctgatcctcccacctcggcctcccgagtagctgggactacaggcgtgcaccaccatgcctggctaatttttttgtatttttttctagagatggagtttctccatgttgcccatgctggtctcaaactcctgcgctcaggccatctgcccatcttggcctcccaaagtgctggtattatatgcatgagccactgggactggcctaattttaacattttaagggggaaacattacatgaagaatgttggttacaaagaaaaacctcaaaaatgtgggctctgcctatcttactgccattgcttaattagccagatagagcaagccaaaaatattcccattgccctatgactcagcagacaagtataaatgtttctcacagtagcaaagcaaacgcttacagctggaagaccatcacatatggtggagccaacgctgtacttggaactggatttgattttcaatcctggtttctcaattaactagctctctgaccttgggcaacttccctgaacattggtttgctcatctaaaatgcggatagtcacctgtctctataaagggctacccattaaattagaggatgtgaggataagcaaatcaaaactcccttggtatgtcctatgcctcctctcagctggaatacagcagggcctaggaaacaggtccagttttctgcagagagtcatatgggcatagtttaagcatgtaaaggggcacgcttacagtgatgttataaaagcaaaacacaagtacctgcttactgcagaatcctctcacaaacagagaatcctatgaaaactgcaaaagggataaagaaagaaaaagtgggggaagccaggtccttcaaacctccagtcagcagtcactctcaatcattaccagacgtcgtcactgaatttagggcccctgtcagaaccagcacacatatggagccgtggttacaggccagaacacacacctcttgacatttaaagatgttcatcttcaattggcctccatatgagatgtggagtttgagaacctaattgttcccaagctctgtgaatgggttttatatactccgaagacagctagatattgaaaggggagaaaaggcgggatcttgacatttgggaagcaattctactacactgttttaggattggttttaaaaattaaagacggtgatttgatgtttgtgttgaaagcacaaccacgtcctgactgctaaaagaaatctaacctatatgtcatggtcccccaaagccccaaagtggattttaaagttgttaaagtaaaaatctactttgtaggaagagcccgccttgctattctaccttaaaactgatgagcgagttggagggactgggatgttggaggggctggggtgctggaggggcggcggggggcgggacaggggagacacgggtggtgaggaacagtccagggatatccaggctggacccacgtaggttcctcttcctaccaaaggggaactgggacgtgctccctgtttcccagacggaactcctgggtgataatgtgagaagcccttactgcacatctgtctttccccacatacttacaaagttagggggaaagctggaaagtgatatgcagcccctgtataattctgacttattctcagaagattttttaaaaaactaaaaaataaatggaaatcagctgcagccttcctgatgtgtgaatagagacaatttaaaagacatcaagtgccaaatactgacctgtctcgcctaacaaaactgccctgtctttcagcccactgagaacagagggacacacaccacagggaggtgagctgtctcggaaggagccctccacgcagaccccacagctatattaactgtgcttaacgtaatcatgaacacataatcgcggggctattgaagactccataacaaacaagatcaaggagcctggagcctctaaaacatgaaaaccaattagcactatgaaatctaagagcagacacagccagagctcgagaaaaggcatgggcaggagctggactgctcaatcctgctcactcctcccttccttcctgttacacggttctgttctgaggtgctgctgagaggggcttcctctcctgggccagaactgaggctaaggcccgaagctgaggacagaaagtgatcaactccccacattctaaagaggctgctggagaagcggccacgactggggcctgacatccttctctagggattatcaggcagcactctgctacccatcccacaggaccgtaacttatccttcccaatccgtagaaagcaagactctgaagcatgtgcgtttgtctttggccttgtgggaggtttctattcaagaggaaaactgatgccatgaaggatgggatgaggtgctttctcttcccagaagggaaagatttgggtgcctcgtgaaagggagtctggagtcagctccctggtcaatgatctacttgcagagacaactctctgatctcaccttaataaatgagattcattcacctggcactttgggtttcatgtagggggagagatggaagagttaggggaataaaaggagatgaaaggactaaagaaaaggcagaaggaggccgggcatggtggctcacatctgtaatcccagtatttcgggaggtctatgtgggtggatcacttgggtccaggagtttgagaccagcctgggcaacacggcgaaaccccattctaccaaaaatagaaaaaaaaaaaaatttgccaggcatggtgccatatgcctgtagtcccaactactcaggaggctgaggtgggaggatcacatgagcctgggaggttgaggctgcagtaagccgtgatcacaccactgcactccagcctgggaaacagagccagaccctgaccaaaaaaaaaaaggcagtagggcatgacaaaaaatatactgtggggcaatttgtactcagacgtgggaaacaggattaaatgcattagaaaagaactaaactgaaatatttaaaaatgacagtaatcagttaacaatccattccccatggataagaaggctgtgatttttacaccaaaggaaaagtgtttaagtcatagtccctaccataggggcttcaacaaagtgatgccaaagaaagactactgtcctacgaagacagccatctggaggaggtcctaatggtatcacaagcgatgtgacaaaaatgaagtcccttcatttctctcagcctttccttacctgtaaacagggcaagaatggaaggctgaaatagccagaggttccaaacctcaatggtaatgaagaaacacaacctgtgcattgtattctgaaaggcctcggagaaactgtgtccttatccacagacgcacagagcggtgttggagaaacatcagttaccacttgcctaggatgtctaagggctcttgacacatcctgtaatgcgacgtaaataagaaataaaggtgggcctcactgaaagcagaactcctctcagccgaggactggcttagcctgagtttctgggaggtgatctgccctctgggcttcccctccctcggcccattaacatttctgtacttagaagtcggctgggatcctggagggcataagagctgtaagaatgccatgactatttttaaaattttgaaaaataaatactagaggctctggcagcaacagcgcttggggagtagccgtacctctgaagttttcctttcctttctcgagcaacgcagggagggagctgtttaatgaggagtctcaacaccggggaacaaagcagtagtgtttgcacacaaagcttggtgctggcaattttctcggtttcgttttttcatgctgccaaagtcatttgttttgaaaataagagcctctcctttgccctcagcatccctattaagacactaaaccacaggattaattctgtttaggcctgcagagtgaggtaaatcctctgagacacctcagcaccttccccaggtgagacaggagagtccggggatgaagaattcggctctggagtcacagactcaagttcaagtgccagccgtaccgcttgctagcagcgtggccttgggcaagtcacttggcttcggtttcctcctcttagctgcaaaatatgaaaaacgggcctgctatgaaacgactggcccatagtcaacactcagtaaatgataactatataaaataatggtggtaaaaccagcaaaaatcgacaggtgtgtatcgttgggccataatgtgaaaccacgctcaaagtactttaatatagcatccttcaaggcgctcacaatgctgcagactgtaggagcgaagtcagcaatacaggttggaattcatgtattgggggctatactaacatatacaaagtatacgtgatttgtctaggttgtttttgatgcaaaatagcctgaagctagaggacaccacctactcttatctacagtgtcccttctgtttctaggaagagtctacaatcctaactttaatgcatttttgtctaaactaagagtcttcacattttttgaagtcacagaaatatttgtgaatatatatttttaactgggacttgattactttgtaacatgtatgtgtgtatacacatacacacacgtacataaaagggtaacaacgcaaaaggcaatactggtttgtgtatatatcatatagtggaaagaatattagattcaagttagatcatctacttccaacactgcagatggccagagccgtaaggcaagtctctccaatcaggtcttagtattctccttatttaaaaaaggagaaagacattaaaataccttcaaaattattgttgtgaccccaggcagagtaactagaatgaagtagaagaagctattggaatatgacgttgtctcatgtaagatcttttttttttttttttttttttgagatggagtcttgctctgttgcccaggctgaagtgcagtggcgtgatctcggctcactgcaacctccgcttcgtgtcgtgagatcaagcaattctcctgcctcagccttctgagtagctaggatcacaggtgagtgctaccatgcccagctaatagggaggctgaggcaggagaatcgcttgaacccagggggcagaggtcacagtgagctgggaatgcgccactgcactccagcctgtgcaacagagcaagactccatctcaaaaaacaaacaaacaaaacaaaaacaaaaaaacaacaaaaaccccaatattttaaaacataacagtagaaattgtgtttgtgaatgtcataagaagtttctttacttcttctagttctctgttgagaaacaatacagaatcgtatgctctgtctattggggcaacaattcaatcacagcaggataaaaattgacttttaaaaagtgaccccctgctcttgttttctcctctccttcatcagttcactaccagacctcacaccagagatgaagcttctccatgcagagaaagacctaaaactctagcgtgatgtactcatggataagaattgatcaacatgtatccagagcccaatgatgccaggaagaaagcctaaacataatttaataaactccctctctgttttcttcatttcctactactttggtttacttaaaaatgagtgtttgcaggagaaatctgagtgcatttttggcaagcagctgagttatctttgcttattcattaaacgaacagtgtgacggagaaagtccaaataggaaagacaaggaaaaatggggaaaagttgacttctcatcccaaaatatttcttggattaaaaggcaaactcatccaatcttaaggtttagagggctaaaataattgttccatatgtagctgttagaaggcattagatattaactatggcatggtgtctatggatatctgcgtcatctatttagatagtatgtgctgaatatcaaaaacattaagctaaagaaggttaaggaaagatggtgtttccccaaggaaaggtgtgcttatcctagtttgacagtctcctaggaaaacttggatactttcttacataggaaggacatataacatgcttccagagtcacagggtttgaagacggctgaagacgtcatcttgtccccatatgcggcccaggaagagcgaagtctagcaccacattgggactagaaatctacattttaaatcgtattacaaatttagagatctaatggtgtattagcaagataagtttcaaatacatcaacaaaatgataggcagaaggaacctcaaaacttttgtgatctgaattccccatttcatagatggggaaatcaaggccctaagagctgaagaaattgccaaaggttgaaaaacactcctcaaacaccaccttcctcctctctgggacttcatattatttcattttcttttactattctgcctgagctttgactttctggaattttaaataccaatataggaatcatcagctggtgtcaatcctcaataagatgacttaaagtttactcataatggtttagcatggtcagaaagtgaacattattcataacggtttttcatggtcagaaagtgaacactacaggtttggcctatgtgcctgtaaaatttagaaaaaggacataaaaaggaggagaatttaaaaatcacctagaccactgtcgatgctgtgagtgggaattcctacttacaaaggccccagtgcaagctccctcttagttagctgccttctgacccagctatctcaacagagttcattaactctgttaaaaccactaacttatgccatggtaattcacataggagaatggcataactaattaatatgggtggaggggcactggctctagcattaaagtggattgataactcactgaaatctgcatgatcacacacaaactccttatcttgctaagtttacgcttgctccactacacaaactgaacaccagctcttagtaccctcaatagctaccctttcctcactgcagaagaactaagtttttcatcagacacccaaatgaaactgatactggccgtcagtatcattatccactgataccagctaccaattgcttgctggtactggctgtcaatatcattgtccactgataccagctaccaattgcttgctggtactggctgtcaatatcattatccactgatactggctaccaactgcttgctcgatgactgaacataagccaacgacactagccccaagtactttcctaccttttcatccaccattagcataaggaagagaaattcctttgttgtcttcttgagggaaaaactacacaaaatagaaagccttaggctccattacataaagcgttgaaaaccacacaccatgacaataaagacccaagcatgttttcaataaattattttcctcttatttcacactgtgaaaacccacatttgatagactattttatagcaaatgtaccggttatcaataaataagtagagtttccacgtgaggagagaggagaaatctactcccagcatttgcccccttcatgggtgcaacagaacttgtagcaattctctggtttaaacaacaggtggcagtgtcatttctacattttccctggcaagaaacctttgcagtttgtgatttcaccttccaggaggcattaacagttttgtaaccgcctctatcgacagcgtgtgcatatgttcctatgtagtaaatgcaaatgcatgcaggaaaacattgagatttgtgtaaatgcagtttcaccaagtgctactctccccatacccacgcccctccccacacaatagtctatgcacaggcatcatttcccttgaggaaacagcaaagcagggaaaaggcagaaggaaaatcgactccatcacatatgttctgatcctcaattatcatatacatgtctgtcacccacccattcctgccacacatacaagagaaaggatacactacaaggtcctggggcacactttgggcaaatgactgagaaagcgaagttctgagaaatcttaattcacatcaagaaaagcactctactgtactgacatttctggtaggcgctgttttcactcttctgctacaaaagagcatgctccatatttgaaaggaatcaacagaaacaggtcttacattcccacaaggaaaacacagaagtcaggaccattctcacatgtgccgagaagacaagaccacgtttcctagggtttttgtgtgagctttaaataggagaaaagtgccatgtcaagaattcctcattcaatatctatagctcagttttttgttcacatgcattattttattttattattatttttgagatggagtctcactctttcacaccagctagagtaaagtactgcgatcttggctcactgcaacctccacctcctgggttcaagagattctagtgccccagcctcccgagtagctgggattacaggcacgtgccaccatgtccagctaatttttgtatttttagtagggatggggcttcaccatgttgtccaggctggtctcgaactcccaacctcaagtgatccacctgccttggcctcccaaagtgctggggctacaggcatgagccactgcacctggccacataattttataatgtagcagcaggtactctgtggtttctagcctataatgtaacagttattggtttgatatgttacatttatttaattttgaatctgtggtgtttttttaaagcaatttaacaatgaaaatctcgtcaatgcagcagggatgagatcaaactgactgatgggtaaatcaccagcctaaagggacacgccaggtattagacagtctggcatgtgtagctggagaagtactcaaaaatgtataaaagtcaatgagcacatatacggagaattacacagaaaataataagcagcactagaaagagatgatgtgtgttttttgtactgtccctgtcacatagcatcaaacatccacattcctgctttctgagatgagagggttggacaagtaccctcaagaagctttctggtatacggtacacagtatcttattgttttataaatagaaaaaagagaatacagaggaaaaaattaaaatacatcacctagagttcagaggcattggaggaatttggctttcatcagcaattttgcattaaaagcaagtatctgtcggccaggcgtggtggctcacgcctgtaatcccaacactttgagaggccatggtgggcggatcatgaggtcgggtgttcgagaccagcctggccaacatggcgaaaccccgtctctactaaaaatacaaaagttagccgggcatggtggtgcagcctgtaatcccaactactcagaaggctaaggcaggagaattgcttgagcccaggaggtggagattgcagtgagccgagattgcggcattgcactccaggctgggtgaagaacaagactgtctcaaacaaacaaacaaataaaaaagtgagtatctgtcctaagcaacacattgtcaagtgcggcctatatgatttcctggtggtcagataatgttgcattcatgctttctgtaggaagtggggtttcatgaaacagcatgaactatgaactttgaacgaagagtcacgggcttatccctgactctaggacttagtagcgtggttaatcacagccgcattattaatgtctccagttctccaaaatacggtaaatgacaccataacagatcttttgtaaagctatggtggatatttttaaaggattatttattcatagtaggtgtctgataagagctacttttagacttttggacttgtagataacttcttttaatttcctattaaaatacccaggaaggtacagaatccagtgttggggctcataaaccaataccctaaaatacagcgctttgacatcctgaactgaagaagcctccaggtctctctggccttccactttacccactgtctctcaatcttctctctctcccaagcagacgatgaacttgttcattggagttcccttatctgcccaaactcccagacctgccaaagaagaaaacaatcacctctggctctttccctgcgtcttcagtaactgaactcctatcccaggaacaaagactgaaatctgtcaacacacctgaacagactcctatctgctttgcgggcccaacagatggtcccaggccatggtatgttcttcaagcccactgaattccctaaaaatcagttcctaccccgttaaaatcatccacacttccccatctccctttcccctaagaagaagggtgtatacatctgtcccccagggcgtggtaggtcatcactgtgactctccctcatgcacattaacaaacgtgtatgcttttttatgcctttagcagctgattttcagcaaaacttcagaggaaaaaggggacattttcccttggccactccactagccacagtcctataagctaaagataacagaagttcccctatccaacaatctcaggaaagtttcctttaagttcagcattaatcactgaatgttctaccatctaacaactgtatggcattttaaaaaatgtttaactgaggttaaatatatataatgtaaaatttaacattttaagtattcacttcaggggctacaaagtacatttatattgttgcacaaccatcacgaccatccatctccagaactttcttcatcttctaaacctgaaactctgtgcccattaacaataacgctccattcccgaccctctcccctcagatcctggtacccgccattccgtctctatgaatttcaaacatgaggtgcctcacagaggtgaaatcatgcaatatttgcccttttgtaactaccttatttcacttagcatgtcttcaaggttcacccatgttatagcatgtgtcaaagtttcctttctaaggctgaattccattttatatgtggcacacattttgtagatccatacatctgttgatagacacgtgggttgctctcaccaaatgtgtacaaatatctgttcgagtacctgctggattccaattttggggggtgtatacctagaaagagaactgctggatcatataataattttatttctaatgttctaaggaagtagagagcattttgaaatgtgagatcgaggcctaagcagtcattcttgctaactggaatgctggagtgctgagctggtcatggctaggctgatcccgtcagtggcggacagaaaagcattgacatgaggtctataaaaaaataagtatcagccaggcactctggctcacgcctgtagtcccagctacttgggaggcggaggtgggaggattgcttgagcccaggagttcaaggccagcctgggccacacagtgaaaccccatcacttaaaaaaaaaaaaaaaatagaatagtaaaagggaaaggaaacatcatgctaaagaaacagaactggctgggcgcggtggctcatgcctgtaatcccaacattttgggaggccgaggcaggtggatcacctgaggtcaggagttcaggaccagcttggtcaacgtggtgaaacccagtctctactaaaaatacaaaaattagccaggcgtggtggcatgtgcctgtaatcccagctactcgggaggctgaggcaggagaattgcttgaacccaggaggtggaggttgcagtgagccgagatcatgccactgctctccagcctgggtgacaatagcaaaattcagtctcaaaaaagaagaaaaaaaaagaaaaagaaacagaacaacagcattacctgtgaaaaatctttcaacacagcaaacacaagaaatcttgctctcagtaggacaaaggcaggcagaagcactgtggaagaggggccaggaggggctgagatgagggcagaatgagggagcacagcgagctaactaaggtcaaagaaaaagaaaacaaggaagctggaattatgttaccgagaataaaatagacattggaaagaaataatggaaaaacagttcagccaatgtgtggccattcagaagcatcctgccttgtcggtctaatgctaagaatgatgggagaaggggcttccaatctttttctatgattttttttttgtacctagttaaaaacccactgcatttacagttatcaatgaaactgttctgcttaataccataatacaagtgtctttccaaagttttttgttccctgaggacagaataacaaatgtcagaacatgaacatttttagggcttctgatacatactgttgccaaaagtatcagcaaggtatgaggccatcagcactgccaccattaatttttattctttttttttattttgaaagaatcttaaacttagagaacagtgcaagaatagaatagtataacttattttttcttagctatttgaaagttagttgccaacacaatggcccatcacctccaaattgtgtatttcttatgcacaatgacattgtcctacacctatgaaaaccaggaagttaacattgatacattactaccatccaatcctaggttcaccaatcattccaccatgatccttttcacagcaaaaggttccagttcagaatcaaggcttctgtttgcttgactttcatgagcttgacacttttgaagactagaggccagttattttgttgtataatgcgtctcagtttggggttgcttgatgtttcttcacgaatagattgaggttctgcatctttggcaggagcatcacagtcatgatgctgagttctcatatcctatcacgtggtacataacttcaatcagtcttattactgatgttattaattttgatcactaggttaaagtgttatctgtcagacttctccactgtgaagtttctcattttctctttgaattcctaagaatttgggagtggggagagttactctgagagaatgcatatatgacattcctcagcaaacttaggactttaagcactgaactcacaaattcctattttattcagtgagttataacctattactaccgttattttgatgctgaaattgccacagatttggctagcaggagcctcttcaagctgactcctatgtccttctgctatatcctcatctttggacatttccttactttatgaaacaagaagacatcccaggctcatcttctacttctctgtcccagccctggaatcagccattcttccaaagagcacctttaagtagcgaacagtatttagaagccaaagtcccagactaggtgtgcactaggtgttacagttcccaggtcctctcagtggacacagccgggaaatatacgtatgtggaacacacagacacaaagatctgcatctatgtttatttctacacagctctttctctctgtggaataccaagagttcacaccagtctctctaatgaacagagttttattccagttccttccctttccaaaacaaccagccgtgtctctgttgccctctcctgcccggctgccaggtttccacgtgaatgctctcactcccctgagttcagacactcagctttgagccaaagtggcttccctctctcccaggaccccacgctccacagtcaaggcactcaacttgctctgcctcatctcatgacttttgaactgagctttagagaaacagtaagaacaagacattatcaatttcatagatgagtctgaatattttaaatgtttgccatcatatttctgtaaaaattgtgcttcacgtgctttgtctatttacctatacacacctcattgattttaaactttttttctttgtttacagatggggtcttgctctgtcatttaggctggagtacagtggcaaaaatcacagctcactgcagcttcaaattccggggctcatgcaatcttcctgccacagcctcccaagtagctaggaccacaggtgtgcaccaccatgctggcttttttttttttttcctgtagagatggattttgctatttttcccagactggtctcaaactcctgtgctcaagcaatcctcctgccttggcctcccaaagcactgagattacaggcatgagccaccatgcccagcagatttcttcttgattagtttacgctgtatgtgtgttaaaggtatcaatgctttggcttaaatgttgcagataatttcttgatatcttatttggttcttgacttattttttttaatagaaaattgtattttgttgatttagaaagcctgaaccccttgctacttttctatttcctctgagccccatttttctctgagctttttgcatttctgaacttctccattactctccactccagtgattctcaatcagggctgattttgctcctccccctggaagtctggcaatgtttggagacatttctgagtctgaagactgggtaggaaagtatgattagcatctagtggcaaaggcctaggatactgctacacaccctacaatgcacaagacagcccccacgaccaaaggttatccagcccaaaatgtcactagtgtcaaacgctgctctggagtctctcaaacgctttacagctattcttttgatttcttccaaaacaagacattagaaaagaaaggctaaaagaggaatatttttcatgtaggcaatgactttttctaaatcctaggtctgagttacaaatactggtcatagaaccttatagaatccaaaagcattgtcaaaaagaccaaccaaaaaaaccctatctttgttatttccacaaaagatgatcgtagctgtgttcttgacataaagggactcacctaattcataaagttttaaatctgtgtttgtcatgtggtcaagaattcatatctagattacctaggtccatctgtgctatcttaaatgccaatgaaagaaaaatgtaattattaatttaattttttcaaatcctataaggccagtaccaaggtactaaatgtaaatatatacatacatatatataaatgtacatatataaaatacatagttttaaaaataaagaacagtattacaaataaaattgttgctttcttggaactcaggcctttgaaagaaaatacatatatagcagcatggcatgaagcaatttaacaagatatgtaagatatattagaaagaaaggagatttttctcttcacaaacacaatatatatcttcttggttatagacttgttacttgcctgccagaagagtttactatcatcttcacaagtattcaattctcagaaccaagggatttcacagcctcctctacccaatcaaagcagtgtcttatggggtccgtctgaacgtaatcctgtcctactgacggatttgacatctatttctgccaccattgcacaagaacacagcagactgctgactgcaataagacttatctagaggctaacaggcaagcaaaatctatactgatttccttttcttcagcacaataccttttaaaaagtaccataaataaaacagtgttctcaagacctgtgattttcaacgagaaattactaaacacattggggaggcttcttgtggtcttgatttcctaatgagctatgggaaattacataatgaagagaattcttcttggcttcttaggtttcaaaagcctacaaagtctgtaaattctgtttcctttccaacaaacactaaacctaacttggtattcgaaactttaacctctccatttcaaatgctttagttttggtcctgactcattacaagaaaggaggctgttagaatagcaaaataataattatgatgaaatcataacaataataacagtagctaacacttattgaactgagcgctatatgtcagatagtattctaaatgctctatcggtgtaaactcacatcattctatgataagctacaaagtagatactcatcataataatcagtcgcattttatagataagaaaactgaagcccaggagtgtgaataggtttttctaggttagaagcagaattgaagtcagaaagcctgactgtaaactcatggtcttaaccacttttctggctctctgattcccaccctctcaacttttaacgtgactgaatctgaaactcatcattcattatagcatcaaacctacatctccctcttcttaaggcctacctgcatgagcatgtacctgttcatacagctcccagaacaaacgtgtataggtttgtctaagtaaacagcaaatttgattgtaaacataaaaactaaagagaatatcattgctttgtaaaggtaacggtgaatgattctcaacgccaataccagaaacatgtgacaatcacaaggcagtcaccaatttaacagagagaaggaaagtatgaagtgtatctctcagtctctgatagaagttcctttcttcacctcgggtgaaggtcaggagttccacttctactgcccttgctgtcaccaaacagcaaagttcaaggaagacagaggagctttgaagccttctgacatgggtacagaattctactatgtctttttgtttgagtacaaaatatagctctagcctgaagaaagacttagagttaatcttcctgtggtacagatggtatattctgattcctgatcacccacactgcgccacagagcccctgacacagaattgtctgtagttaagtaatgggaggtgaggaagtggcctcagagaaggactaacgtccacagacttgagttcgtacaaccacaaaaatacctgcctggccaactagccacccagtctagcataaagattggtcatgcagatttgtggaaagaaagaggtccaggaaatgcttcttggaaggcagaacatttacttattcatcattatattattgatcagcctccctacaccctgattaattatcactccattgatgaaaagctatctcaattcaattctattgctttctcagcaatacaggcaaaaattttacatagcaagttttttgtttgtatatttttattcatttttcagcaaatcaaaacccattcaaatggaaaatggaaagatggaaaaatgaaactgtgcatttcaatgtgatattgagcataggatatcagcagctcacttcgtgggttctgtgttgcttcgacattctgtctgtgacctcttggaaggtttgactggtaggggcacagcacttcaaactgtgacataatcagcgtttcctctcctaggttaagagggacactgatcgctggaaacatgaacatccacagcaactaagagtgagcactgctgaacacagccacagactgtggtccttcgttaaacaaatgaaagtctaaatcaaatgacgagagaacgcaaattcatgatcattatgaagcaaatgcattgctgtacttaagacatcagtccctctacagagaggccatcacctctttgcacaagtcaatatgggcaaaaattgttttcaaaaaccaggttggttctcaaacattaaaatgcacatatcagagaaaaatgctctctcaagcatctctatacgaagatgttcattacagaaatgtttgttatggtggaaaatgagggccaatgtctatcaataggagattgagtatgagaactacagtgcacagcgagggggtaagaacgtgggttctggagccacgcagccttgctttaaatcctgactttgacacacactaacagtgcgacctgaggcaacttacataacctctgtaaatcttggtttcctcgtctgtatataaagagtttagtaaaacacttgacatatacgagctcaataaatgttagcaattattattatgctacattatgtatatggacattttaaaaagatagggctgtatctatcagcgtagaaagatggcctgtgtcattgttaagaaaatgtttccagcaaattgtagatgggtataactaatataactctgcatgtgcaaatattgtgtggatacacatggaaagtattctgggacacataccaaattgttacaataaatccctttcaaaaattaggagtggctgggaggagaaggctttcacttcgcactttccatggtgccagggtaataccacctcacaacagtaaatagcaaaaatagcaaccttaactctagattttcttatctaaattttaattctgtgaagaattttccatttccctttttcaaatcaggatataggatgcaatttagaaagagtgagatcacttgttagactgtacgatttttaagcatcaataaagtataccaccgaacttctctaccaatccattctctaaacttcccaatcaggtgtgcctctccatttaggacacaggcaggtttttgttccaactcacagtgtaactgccctggtttcagtatccacggtgaatgagaacagctaagagacacaagtgctgggaattaaagaagcatctacttaaaaaccaagctcttgctaatcagtgagaagagtctcaagagatgatatgctgaaggcaccgagggagagctgtgttggaatgtctgtctgtgcataactgtggtccttcaaaacgagcaattagaaaacagagatgagataatatagctagctctcgcagattaatcaaatgtgtcttgttactagattagagaattcaaagatatgacagagaatattaaatgtctgaaaatgaccaagtgtagctgcttgaatcatttcccccacagttttcagtagaaaagagttgttctttcccattttccaaaatcattactattttagcattgtcaaggaaaaaaaaaggacttatgttttgtacttttcacagtgtagaggatgatgctcagaataaattgtttcactttgggagttatatttactagaagaatgaagctcttgctttccactttaagacaaagagagggacatacaacaaaaaagacggcacgttcaggggctacaggggcgtgagttcaaatcctggatttccaatttccagctatgtatctttggtgagtcatttaacctcagaacccacttcacaggactattacaaaactgtgtgtgtgtgtgtgtgtgtgtgtgtgtgtgtgtgttactgaaaaatatcacccagtacttagtacacacctagtagttgttagctactatttcagagagacttctgtggatggcatatactgatgatttggttaaaaaaataaagaataaagacagttaattctttcaaaattattatatgactatcactgttaggtgggaggggataaaatgaggaactacagagatcactgaatttacagcaaatgtcctggccaggtaacctagaggtcaaattgagatgaaaatcaggttgcttctatcatagtccaatattttttcatactccatcagattctgctttctgcaatataatatggaagcgagaaaacaagaaatattccaggatacagtcacagatgtactatatagcttacattttatctttttcccaaaaaagaggaacctcattctgcctgaacaacaaaaggttaaagatgtattggtggacagcatctaggaagagagatacaggaagtggacagcatctaggaaggagatacaggaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagggagatccaggaagtggacagcatctaggaaggagatacaggaagtgggcagcatctaggaagagagatacagcaagtggacagcatctaggaagggagatacagcaagtggacagcatctaggaaggcagatacagcaagtggacagcatctaggaagggagatacagcaagtggacagcatctaggaagggagatacaggaagtggacagcatctaggaaggagatacaggaagtggacagcatctaggaagacagatacagcaagtggacagcatctaggaagggagatacagcaagtggacagcatctaggaagggagatacagcaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagagagatacagcaagtggacagcatctaggaagggagatacaggaagtggacagcatctaggaaggagatacaggaagtggacagcatctaggaagggagatacagcaagtggacagcatctaggaaggagatacaggaagtagacagcatctaggaagacagatacagcaagtgaacagcatctaggaagggagatacagcaagtggacagcatctaggaagggagatacagcaagtggacagcatctaggaagggagatacagcaagtggacagcatctaggaaggaagatacagcaaatctaattcagaagaaaagaaacagattgccctgaatatgacagtggccatcagaaagggagctgtaccctccacccaaatgtgtcccaaacacaaagacgtctcacatccctctaaaaaccgaaaagaggtaccagtactgtgacggtcattttctggaattcattaattgaatcatgaagagaattatgtaaggtcaaaacactcatacctcagaaaaagctgcgtcctatacactaggctagcccacaccaaccacaaagaaagcacagacagaaatttccaggacttggtgtctttgcaaagacagagactccagccataagcttagcaatgtaccctcttgatgaaggaagtgagcatgatctctccctttgtcatctgagtgatgtatgattaagctcaatagaggtatagattcagtgatgttactgagaggaagcaacagaattttcagtgacctaaggtgctatatgtgagagtcccaagtgttctaaagaaaaacctggcccagcacagtggctcatgcctgtaatcccagcaatttgggaggccgaggcaggtggattacctgaggccaggagtttaagaccagcctggccaatatggtaaaacactgtctctactaaaaatacaaaaattagacacacgtgctggtgggaagtcccagctacttgggaggctgaggcaagagaatcgcttgaacccaggaggtaggttgcagtgaaggcagagattgcagtgagccaagatcgtgccactgcactccagcccatgtgacagagtgagtgagacttcatcccccacccgccaaaaaaaagaaaagaaaatgaaaacccataccagaaaaaaagtttctctttcttcaaaaacagtccttcttttgaccttccctaggtcttgcagaagagagcataaagaagtcttagatcaaatactcatttatatcagtgacttctaagtaattacctgcatctataggatatacagagtttaatcacatacccttgaaagacgcactccactaaacaaaattataagtacacctcattgcgtgtactgagcttcactctgctgtgcttcatggatcttgtgtttactagatagaaggtttgtgaatcctttgttgaacaagtctattagcaccatttgtccaatagcatgtgtgcacttcatgtgtctgttgtcacattttggtaattctcacaataattcaaactttttcactgttctatctgtgatgcttatcagtgttctttgacattactactgtaattgttttggggcaccatgaacagtgcccatatgagacagttaacttaatccatgaatgtgtgcattctgacagcttcaccaacttcattcctgtctctctccctctcctcaggcctccatatccctgagacacaataatactgaaattagcccagttagtaaccttacaatggcctctaagtgttcacgtgaaaggaggagttgcacatctctcgctgtgattcaagagctagaaatgatgaagctcagtgaggaagacatgtcgagaactaagataaactgaaagacacatgtgttgcacaaaacagttagccaacttgtaaatgcaaaagaaacactcttgagggaaattaaaagtgctactccagtgaacacacaaataatcagaaagtgagacagccttattgctgatagggagaaagtctgagtgatctggacagaagatcaaataagccacaatattcccttaagccaaagcctaatccagaggaaagccctaacttgcttaaattctataaaggctgagagaggtgagaaacgacagaagaaacggtggaaagtagcagaggttggttcatgaggtttaaggaaagaagccatctccgtaacttaaaactgcaaggtgacgttgcagcaagttatcaagaagatctagctgagatgactgatgagggtggcaacaaggaaaagcagactttcagtgtagatgaaaccgccttatattgggatgagataccatctaagacttccataactagaggagaggtcaatgctttgcttcaaaacttcaaaagacagaatgactctcttgttagggtctaatgccagctggtgactttaagttgaagcaaatgttcatttaccatttaaaaaatcctacagcccttaagaactgtggtaaatctgtactgcccatgttctaccaatgtaataacaaagcctgggtgacagcatatctgtttttaagcatagtttactgaatatctgaagtccattcttgtgacctactgctcaggaataagattgctttgaaaacattactgttgattgacaacgcacctagtcatccaagagctccgatggagatgtacaagaagacgaatgctgttttcttgcctactaacacaaaatctagtcttcagcccatggatcaaggagtaattcaactttcaagtcttattatttaagaaatacattttgtaaggctatagctgccatcaatattgattcttctgatggatctggggacagtaaattgaaaaccttctggaaaggattcactattccagacaccattaggaacactcatacttcatagaaggagatcaaaatatcaacattaacaagagtttggaaggttgattccaatcctcatggatgactttgagggggtcaaatcttcagtgaagaaagtaatcagaaatgaaaaacaaggcattacaactgataccacagaaatacaaaggatcattagagactgttacgaacaacaatcttgacaatgctgacaaactgaaaaacctaaaggaaataaatcctagacatacacaacctaccaaaattgaattaggaagaaggagaaaacctgaaaaaatcaataatgagtagtggaagtcctagtcagagcaaccaggcaagagaaagaaacaaagggcatccaaattggaaaaaaggaagtcaaattgtccctctttgtgaatgacataatcctatatacagaaaaatctaaagactccaccaaaaaactctttgaactgataaatgaattcagtaaagttgcaagatacaaaatcaatatacaaaactatacatcaataacgaagtagtgaaaaaagaaattagaaaagcaattccacttacaacagctacaaaaacataaataaagtatctaacaataaatttattgaaggaggagagagaactctagaaggacaactatgaaacactgatggtagaaactgaagagaatacaaacaaatggagatgtcccatgcttataaattggaagaattaatattgttaagatgaccatgctacccaaagcaatctacagatgtaatgtaatacctgtcaaaataccaaaccacatgtttcacagaaatatttttttaaatcctaaaatttgtatggaaacacaaaagaccatgaatagccaaagcaataatgagcaaaaataacaaaacaggaagtatcacactacctgacttcaaaatatgctacaaagctataggaaccaaaaccatatggtactggtataaaaacaaacacacaaaccattagcatagaatagagaacctagagataaattcacatatttacagccaaccaattgtaaaatgtgtcaagaaaacagactgaggaaaagacaccctgttcaataaatggtgttgggaagattccatatccaaagcagaagagtgaaaggagaccattatcactgtatacaaaagtaaactcaaaatgaattaaagatttgaacataggacccaaaactataaaactactagaagaaaacacttcaggacattggtctaggcaaatattttatggctaagacctcaaaagtacagccaacaaaaatagacaaatggcactatattaaactaaaaggtttctgtacagcaaagaaaacaatcaagagactgaagagacaatctgtagcaataaatatttgcaaattacatgttcagcaaggaattaatatccaaaatataatccagttaaaaagtgggcaaatgatatgaatagaaatgtctcaaaagaaaatatgcaggccaggcacggtggctcatgcctgtaatcccagcaccttgggagacagaggcgggcagatcacctgaggtcaggagttcagaccagcctggccaaaatggtgaaaccccatctctactaaaaatacaaaaaattagccaggcgtggtgacacacgcctgtaatcccagctacccaggaggctgaagcaggagaattgcttgagcccgggagacagaggttgcagtgagccaagatcctaccactgcactccagcctggctgacagagtgagactctgtctcagaaaaaaaaaaaaaaaaagaaagaaaaagaaaaagaaaatatgcaaatggccagcaaatatatgaaaaaatgttcaacatcactaatcaccagggaaatacgaatcaaaaccacaatgaaatatcatcttaccacagttaggatggctgttatcaaaaaaagaaaagataacatgctggtgaaaatgcagagaaaagggaactcacacactgttggtgggaatgcaaataggtacagccactgtagaaaagagcacagcatttccacaaaaaaactaaaagagaactaccataggatccagcaatcccagcactgggtttcctttctttctttcttttttttttttttttttacaaaagaaaggaaatcaaagggatacgcacacccccaatgcgtattgcagcactattcacaatagctaagatactgaatcaacctaaatatccatcagtggatatttaactccataaaagacatacaagtaacaccactctactttcacgcatgaagcattaatggataaagaaaacatagatacagacatgatggagtactattcagccatagaaaagaatggaatcctgtcatttgcagcaacaggaatgagcccgaaggacattatgttaagtgaaatatgtcaagcacagaaaaacagatatcacatattctggctcttatgtgggagcaaaaaagatgttgttttgtgctcatcaaagtagaacttgtgggtattggaggctgggaaatggaagaatgggagggaggttgtttgatggatacaaaattacagttacatagagaggatggagtttgcgtgttctgcagcattgtacgctgaatatgctcaactgtattatatttttcaaaaagttagaggagagtattttttaatgttcacaacacaaataaatatttgaggtgatggtatagtgatcactctgatttgatcattacatattatatacacatatgaaaatatcactctgtatcccataaatgtgtacaattattatgtgtcaactaaaaaggaaaaaaggagttgcaccatcgccacacctgtcacatagatcataaatacaaacccgcacacaaattacgttatttactatgtatcattgatgtcagagccctaaaaagccttattaagcctcttgactacagttttcaaacttttttttgcagtggaacgcttacatcaaacaatgttacgtaaatcccaaaatagaatcccccagtaacagtgatctcatgaaatcaaggcaaggcatgtggacgtgtttagtgggggtgcacaagcatgcctgtgcttgtagggagaggacagggctgcttccccaaaacactgtttgaaaaaatcactgatgtattacaagcttcttattcccagacaaacttagtatggaatcacctgccaggtaaggaacttgcttatacataaagtgagggctatagactagaccttttatctgtatgtttctagcaatgttttatgacactattatacagggttttcataggaaatcacataaagaaaggaccattgatacgataatcattataataaatcatactaaatgatcttggtagcaaactagttgtcaagcaaagaaggattatgggtttattcagaccaacttctggaatcttatttaggtattaaatatatattaaatatcaaggtcagaaaccaaatgaagtattaactggcaaaatccattattacaatagaaataacattgatccctggaaataaaaattatttcagattaaaaagaagttatggggccaggcgcagtggctcacggctataatcccagcactctgggaggccgaggcaggcagatcacgaagtcaggagatcaaaaccatcctggctaacgtggtgaaaccccatctctactaaaaatataaaaaattagccaggcgtggtggcgggcgcctgtagtcccagctactcgggaggctgaggcaggagaatcgcttgaaccagggaggcggaggatgcagtgagcagagatcgcgccactgcactccagcctgggcgacagagcgagactttgtctcgaaaaaaaaaaaaaaagttagtgaagaagctgatttcaaagggttttactgctatgaagataaaattaggttggtttcattctagctttattgtagtctgcagagactaaattgaaatcagccattttaattcagaaacaatatttaggctgtagaaagcagagtgataaccaccctgcctttgtttaaaatctctgagacagaagggatatttcctgtagcagcataaattacagagactctaaagttacgttgaaacgacccttacaccctcgaagcaacgtgcaattttgtggctgtaattttctcaaactgcttaataaaaccttctcctttttatcagaaaaaaagaataaacaaaataccaagaactccataaaaggcatacaaggaacattactccactttcagccatgaagtattaataattaactgttgggcaggcaaactgagttagcagtcttttcccacaggacatcttcctgtcaaaatgtcacccagaaataaccctgtagattacaggaaggggctgcaattccccacagtgcatctcataaccataaatggcctcagagtttcagtacctgtcatgatcaggtcacctaacacctgggaatctctcactctccccctcctctacccacatatttgccgctaacacaccaataattgatagtatctgcatttctgagcattaccagccatgagctgcctgccctagcactgaaggagagacagatggcagccagacagaacgggatggagagctcatatccgagtcctggctctgcccttgattcactgagcaacaacctctcaccaaagatgggatcataaagctccattccctcgcattcaaatgctaggaatcctaatttgataatttctaccatgaactttggtgtcttctgtactcatatttgctttctgctcttttgaggaaaaaaatcagatacaatattgtgactatgaaatcatcttctcatttttagtgattcaaggtcaggtgaaaacagaaccgttagtttccattccaaacactgatacatgtaaaaggttatatactttagcagagtcctcactggaaaagatgtagatttggagagttcaggcagacatgggttcaagtactggctccactacttaactagttatgtaattttgggtatgtgaactaactactctaggctttaatttcctcaaatgtatataataagaatgataatcatgaatgctttagggatcgctgcaagttgcaagctaaacctgctaaatatgcaactagcatacaaccgagcaatttgcattcctgagcatttatcccaaagacatgaaaaaccatgttcccataaaaccagtgcatgaatgtttacagcaactttatttatagtaataaaaaactggaagcaacacagatgtccttcaaagggtgaaaggttaaactgtggtccatccacaccatggaatactaattggtaataaaaaaaaaactagggataagggcaacaacctggataaatctctggagagttattatcctaagtgaaaaaaaaacccagaaggttacacactgcattttctatttatacaactttcttgaaatggcaacattagagaaatggagtacagattagtagctctacaggttaaagagcggttgggatgtaaggaaagtgaatgtatctataaaagggcaacgtgaggaattcttgtggtgatagaaatgccctgtttcttgaccatatcaaatgtcaaaacatcaatgttctggccgggtgctggctcacacctgtaatcccagcactttgggaggccgaggcaggcggatcacgtgaggtcaggagttcaagaccagcctggccaaccatggtgaaaccccatctccattaaaaatacaaaaattagccaggcgtggtggcgcgtgcctgtaatctcacctactcgtgaggctgaggcacgagaatcgcttgaacccaggaggtggaagttgcagtgagccaagatcacgctaccgcactccagcctgggcaacagagtgagactctgcctcaaaaaaattaattaattaattaaaaaataaattaaaaatttttttaaatgtcagtgttctggttgtgatagttttacagttttgcaagatgttgccatctgaggaaactagataaaggttacaaagtcctctctgtgttctatcttacaactgtatatgaatctataattatctcaaaaataaaaggtttacttcaaagaaattaaaataatcatatttcagaatatcactgcaaagattaaatatatagaattgagcaataatttaaaaattattacgtatatgaaaaattgcctagcacagacagttcttggcaataacagaagctcattaaatgttaatttctttcctctaagaagttgtacatagacagaatgcatcctagtagatttttatttgtggatcaaatgaagacgtaactccatgaaagggtctgatcataacatacacactttttggaacatttagcctttttttccctatgaatctgaactttgaggaagtattatttcacgctaaataacattcatccacattcctacagcaaaactgtacaactcaggtgccaactaatttcttccatcaaaaaatatgaccagtggagcaggttgtaggggattatgatccagttggttaagagtcacagtcaaaaaagatgaatcaaggccaaaaattaattggcatgctcttttacagacaatgaagaaagaacatgaaaagaataaagcttggtttcatgtgctcaagagttcacagctagttaagacaggaaaagtctcatatatgaagactcagagaacaagtggagaacagaccatcagtgcaaaaaatctgcagaagaggtggaggtgagcatggctgggggcaaatgagtgcagaagagggaggtgagaggtgagcaaggctggggcaaataagggaattgggggctgctggctccacacagcactgtcggactgcgtgaagaactgatggcagacgcacgaccttggccttctggaggaccgcggcaatccttagtactttgccgacgctgcaatgtaatcccacctttcccagagttctccatcccctgctgccagatccctgccgcacaaattcgcttgtatgaagctcctggctactttataagtatactttataagagaaaatacagacacacagacaccttcctcccccaatatatgcagacagtatgaagcgtcatagtgttccggcctcaaaaataaaattaggaggaaagcctgtggcacagcaaacgtctccccagcctcccacctgaccctacccttccaggtcactgcctcaggagataaaatcacccaggaggccctgtttaaactcaattctaagttaaggcctgaaaggatccatacactgtccaactctttttcatgccaaaattaatatagtaaacatatctttgtttcagcaatcaaaacctggcaatttgccatgtcaacccccattccacagccacgtgtctgaagaacatatgctttcagaatggcgtttatgatctcaatgccatcttgctgcaagccttccagctaggatgttccctgtagttgaaataaacggaaaggaagtttctgagttgaagtaaaccgaaaggaaggagggtcacagccccgcggcacagttcccaggatgactgctgtgccactcacaaaatgagccttttgactgactccagcagcaggacgggactgtcgtttcacgaggtgagctacgggcagacagatgtatccgaatcgcattaattggaacatcttgtcacaggataagagaatttccatttctctgcggatgcctgtatgctacacatggtatctggcaggtgtgagaacctcgtctttgattgcctatattcccaatctcctttctttgcctattttcctgctgcaaagcaattacggctgaaaatcagtctgcaacatgcgctcatccatattcaactctttccacttcaggcaaatcttgcccagaaaaaaaataataaaagagagagacttataaatccagatttgtcttttattttgatcctctgattgtccaggtgtttacttgttgataatccaccattttctccacatcaaaataaatattctaaagatgcagctctaaacaactaaagcatgtacctgtcttaagtgacaaggagggatgacacacctacaaaactttcaataaatcgaaccaacagatgggagcagccagaaccagttgaaagtgcaaatgacggagcatttaaaaaatatacagtgtcattgattttaagtatgttgaagaaaaaaatttaagaaacagtacctgggacttataccaacaggccaaggttaaaattgggttgaagaggagacagggcttcctcctggaagtccttcaagttatcatttcacattggatttgccaatcagcttttcagatcttatctgataattattgaaagccacaggcagggactagaattttgagatgtttctcaaattttcagatgaaagctgtttacctggcccttaaggagattttaaacttattttaatcagtattcaaaagacacaacaggatgaccatccccccatccacccccgcagtctccttctccagaggcatccaatttcatcatttcttgggatgttattttatacatacacaagaacatgctttatatcttccttttcttcattttttacacaaataaccataaactacacatcctattttattttctctgtactcttctttctctcttttttttttttttgttttgttttgtttttttgagacggagtctcgctttgttgcccaggctggagtgcagtggtgcgatctcggctcactgcaagctccacctcccgggtttacgccattctcctgcctcagcctcctgagtagctgggactacaggcgcctgccactaagcccggctaatttttttttttttttttgtacttttagtagagatggggtttcaccatcttagccaggatggtctcaatctcctgacctcgtgatccgcccgcctcggcctcccaaagtgctgggattataggcatgagccaccacgcctcgccttttattttattatcatcatttagttatgaaagccaaagctgagacaaattctctgtactcttaatggcataactgagcgttgatttcatatgaggacacaaagagcttcctcatcgttttttatggcttcagagaattcccttgaatggatgtagcataatttatataaccagttccctacagatagacatttaggttatctccattgtattcctattacaaacaaggttgcaataaataaccttacacataggtcatttcatgtattagctaaagtatcatgtattagctaaattcctataaatgtaattgctgagtcaaaggatatatgaatttataattttgaaagatattaccttcatatatacatatctgtatctatatagtacctgtttccctatacccttgccaatacaaggtgttaacattctgctgtttgccaatctgataggttaaaagtgacatttcagtatcatattcatttgcactgctcttattatgaatgagctgaggagcttttcatctgtgtcataggaagctcacccctgaggacagcatcacctggactccctcctctgataacttctgggaggcactagcaggaggttagcaggtggaaggagagatatctttcccatttccatcctgcttcaaggacatatttctcacagtggctacatcctccatgatcacagccttcttcggatgacccatctttcctgctccggcaatgccgttctctctctttgtccctgccttcaatcccagggatagtaatagcttcccacatttgcaggtctccgagcgtcacaatgtcattccctttttgtccccaaaatcctgccctcacctctgtaagttgccccatttggggagaagaagcatttgtggagaaacctgtttgctattgctttgttttcctgagacactaacaaacatatctcctgcctatttttctactggtttgttggtcttttcatattgatttgtagttgtagcaactccttattcatcagagcaagagttggcaaacttttctgtgaagtgccagataataaatactgttggttttgtggaccataaggtccctgttgcagctattcaattctgccaccatagggtgaaagcagccacaaacaatatgcaaacaaatgagtgtggctgtgttctaataaaacttgattgataaaaacaggcagcaggccagatatgggccttgggctgtagttcccaaccccagcattagggaaattatcttttctctgagatataagctgcaactatttttctcccagtttagttttttacttgtcttatagtggctttgccatgcagagttttaaagatctcttattttacgtagtggaatttatccgtaatttatggcttctagtttttatgtcagagggaaagcaaagagttagtaaaaccacaggaaactcaaagaggaaagactgtaccttaagctagtcagaccatgctaccaccaagagtcttcttaatgagacaactactcatccttctaagacagaattatcaaaaactctttcttaaaaagcaaacgaacaaatgaaaactttcgacggaaggctgagacacaaaatggagcgagcatcctggtgggagccaggacgtacctatccacatgtgcctcgggtaactctcaggccactgtattctagacgttaaaaaacacttctcgacacaaatacgaatcctatcaaaagaaaattagaaaagtgttttctaggtgatcgctgtataaaaatttcacaaatcacccattctatcaggctttgcctagctccaacatctttccgacatcagtgacatgggggcatctgttagagttcttacaactaggggatctctcgggatttccacttcatactcattcttctgttcctgcatgactgtgctccagggtctaaaggctcctagccttagtttgtaatgaatttagtttttgcattctataaatttaaaacaaatatctttgtggaaattttgtaagtagaaacagggaaagtaaaatgttgccaattaaaatacatgttatttgcataaaataggcaagactttcaggaaaaaaacactggggaaaggatgggaaaaagaacaaacaaataaacaaaaattggccgttcaagtctctaccagagtttaatattttaaagtcacaatttcctttccttgttttctcctaccatggagaagcagacacagttataagtgaaggaacaaaacatagaccgtggaaatttggaggtttcagcatggatttgcatcctaaaaaatacaaatagcaatgtgtaataacaatttaaaatctctcttgttgaattacaaaaattatcctggcaattgtagtcggttgctctgtcctgaccaaaacaaagttattcatatttatatgccctcatccccatatacatgcatattgagatgtatattttatttatatgttcatctagatgtaaacataggtatatgcagatatgcacccaccacacttcactatactgtctacaacatgcatattagaaaatgtgtatttaccgaaaccaacatataaaaccaaagtggcaaaggctttggggaataagaaagacacagctctgtaataagtctaacacctgtgaatgatctgtagcagccttcgaaatgtgggattgctgtatccctcaaactgatactacaaactgagatttcatgtctccatttacacaaattgattccataaattctactaagcgccaatgggtaagactcacagcatgtgagatcaaaagagtaggagtaactggcgacagtttagttgagccacaagatgacaaacatcagtcacagggtagtaaggaggggagaatcatccagagaaaagccgtggagaggcgttttctcaattgattaggtcatgctgtaatggagccaagggcgcaggttcagtactctctgccaatgacctatattgtatttcaaagacacagaccaggcccaatagttctcaacatcttgccactagatcaaaagggatatgagaagaagagtggctaagcccaagcttatttcaagtactagaaaagtaacaacattaacgcagcattgattagtaccattgtcttagcgtaagttacagttaacgtccgacatgatctgtgatgtaatagaattaagtaagacatttctcccggctagtattaaactgtatttattcagtcaaccttacaagatcctatcatgaaacagaaatagcattcacttttcaaatagctgtattctaacacgtggtttgcaattaatattgggctgttttggatatttcctgtattacatatacaaccgggatattaataacaacaaagatgaaaacagaagaggatttatgtagctccggaggggttcaataagtaggaacatgacccggattcaagcttcctggcacagacaccccaccatcacagcttattcagaaattaaatacttgtgcttcgccaccacaaacgcaagtgctgccgcttatcttttttctcacgaaaatgtgaccttgggctcagaatggtgctgacccaacgtctcacttctcttagaagaagtatctcaatgaagctgatgctgccgtctgagcactgctttctcgtaggaatttgccaaattaacccaaaatgcagccagccaccaaacagagaaacaatttaagtttagccacgtggggataaatccttctggatgtcaaggtcctcagctggggcttatattaaaccagtagttaccgactccattccccagaacaaaatgactcatggggctcccgtatctcctttcatttgaaaaggtgctgaggtggtaaaatattctgaaaactcctgtagtcattgattcctcagttcttatagagcgctagaattttgtggtctacatgtcactgattgtaacacatcttaatatttgctgcttagaaatatgtttgaaaatcatgtaaaatatcgcacaaatagcaaataactagaagatagatggttgtgtctttttccctctctgatatatataaattctccaagaaccacatggtagaaaaaagacagatatatagtcacgcactgcataatgacatttcagtcaaggacagaacacacatacaatggtggtcccataagattataatactgtatttttactattccttttctatgtttagatacacaaatacttaaccttgtgttaaaattgcctcagcattcagtacagtaacatgctgttcgggtttatagcccaggagcaagagacgatacttcacagcccaggtgtatagtgggctataccatccaggtctgtgtaggtacctctatgatgtttgctcagctatgaagttgcctgaagatgcacttcccagaaaatattcccacccttaagcaacacacgctggacccaccatcctgagggtggaaagaagctctttagagtccccacagagtgaaatgacttcatgtttctcactctctctcctcagtgcggacttcaaaataaaaatactaatcatcaaaagacaaaattctgcatatgctgaaacctacataacagcattctgaagtttctaatagtaagtttcttattagcttgtcccaagttaaacttcttttgtgaaaggaaagtctctgtgtgtgtgtgcctgggcatgtatcccagtgttgccagggccctacgtcgtatgcacacgataagtccaagacctgtagtgggtaaactcagcaatgttcatactctctaagtaggtaacgctaaaggaagagagagaaaaacattcatagcctgagtgatcacataaactgggtatatcagaaaaatcatgacttctggttctggaagagaattggagggggtataacctctcttccaatggacggactcagagttatacctagctcaatctagatggtatgtaatctttattgggaaaaaaaaaaagggtgactaaatacatacgctttaatcataatttgtattcctagatgaaactaccaataaaaattgctacctgcgtatttcctgggcccttatgaggtacactctgaaacactttttctaacactctccaccacaaaattggttttattgctttcatttcatagttgagaaaatgatggattcaaaaagattaagcaatttgttcaaggtcttatgactgataagtcacattttgaggatgggaccccaagtccatttgatttgaatgcccataatcctctaactgcagaaagcttcaagttttctgtgtgttctggaaggcacagctacaaagaaaagctaatatttccctctaaattctacctttatatagctcatcatttgaatttataacactctccagcagtaacaaatacttacgtttctctggattcacagatatatactaaatattttaagaatggagagaaactaagattggaaacaaattaatatgacaggaaaaaaactgtggaggaaaatccatgggaacgtataagaatataactgtaattcaagagccacatactcagggtttgtaaaaattcctaactgcagattaagcagtgaggagctcagcaccttccacaggttcacactccaagccacggagcactcagtggcaccggtctgctctttgggaacaccgttcaattacctctctccatgtaaggacttcgcattattagtgaaccgattctaacacaggaacctcctatgatgtcttaagttcagaatatttctccctgatcaccccagaagaaatcagagctgcgttaatcaatcattctcttacacggtttcctttgtatagaaccactttgcaccctttttggtaagttacctccttcttaatcttcaggactaagctcaacacacacttcaaagcctttctgaacccattctagtatggctgccctgttttgtcttcccccaaccccagaaaccctgtatttaccttcaacaaagctttgaccacacattctctgctatgttttttactggagattaattttttactcattttgttgaggctatttccaggggctctgaatagtggctactcttaataaatacgtaaatatactcttagggataaatgaaaaatcaaatggtccgagtggcctaacacaatttccagaacacactgggaaatgtttgtctcttttttcagccattgtcactacttctttatccccacctctatctacacataaataaacacatgccaacacctgcacttaagtatgcacatgtacacatatacacagcatcgattactccatggattaactctgcttcatctactacctttcatgtaaaaacaagacaaaggaagaaatttaagaatttatgatattcacacaaaatcacataatctaccaaagtctcctcatgcattgcctttattcagactaatatttactgagcacacagtactatgtaaagcagtagaagccaatcaattaaaatgctcatatgttctgaacataaaatgcttcaacacccactacagacattcagaaagatccaaaaaagcaaaattaagtcctgcccatattgaaactatatcttgagatagaaccaacacaaccaaaacaaggtgactattttaagatgaggaatggctgggaacacaggaaataacccaatgggacatgagtgtggctctcagcctttggacagatcatgtgacaacaaataaacacacacgttctcctgcagggcataggtttctggtgaagaatcagtggtgacttggagcaagacaccagatgataatttgataaatgctgtttacctttaaaatgtgattaaacagcatttatgatgaacatgctcagccaatgatgaataatatgtgcagtcaagcacaacagaaagtaattgtctgaggaggtagttcttccctggcagcttcccaaagctctcacagcgtgccttccccttcctcccaaacactggagttggagttagagccctgccagaggagaaaacctggctacagagagtggactggataatgactcgcaccaacagtttcggggatctccaggtacagggaagcctgttcgcacattcacctttaggaatattcaggactcgctctacctgctgcagtgtccgcacgtggttcctggtgtggtttatttttctctcacacctcagtgaggttctttcacagcctctttagtctaagatttcaatttttaaaacggagagagatcattccacaaaatattatatattccagttttcttctaattcaacagttctacgaataaagaccaacttgaactgattcacagtgcatttttataaattaagaggagtttctgtgcaaaaaaaaattcattacctcaatttagttctcagtgcaaattataatgattcctggttcaatttatagaaaatagtttaaacaactccatgtccatacacaccaaaataacatgttctgggtaagatacacaggtgttcatacagtaaacatgagaactccatgtcaaatggagatatcgcatgatgtctattttaccttcagagaaatgtgcacaaactgggtaatgatgatgccagtacaagaacttgcaaataaatgggttgtttgggcaagaaattttgtaggtacgtaaaaccagaactaatttatagatcagtcaggctccgtctcatgcttggcagagaggctagaggtcactggtcactgaggaaaaaaatgcttacaaactgatttccagcccagttagcaattttaccagaactctttattctatcaaggctgcagaagagaggtaatgaggtcccatatgtacaggtgtgcaacaaattaggtcaataaatatgtctgttaaaaatacttaaataggaaaggtaaaaattacttaaacatgataagaaccattcagcaaaattcaatagcagacttaatgctcagtggtgaagtgttaaagccatttttattaaaatgacaaactggactaggataaccattattgactctttataaaatattgctttgagagtataaaatacctaggaatccaacttacaagggatgtgaaggacctcttcaaggagaactacaaaccactgctcaacgaaataaaagaggacacaaacaaatggaagagcattccatgctcatggataggaagactcaatattgtgaaaacggacatactgcccaaggtaatttatacattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcatgctacctgacttcaaactatattataaggctatagtaaacaaaacagcatggtactggtaccaaaacagagagatagaccaatggaacagaacagagccctcagaaataatgctgcatatctacaactatctcatctttgacaaacctcacaaaaagaagaaatggggaaaggattccctatttaataaatggtgctgggaaaactggctagccatatgtagaaagctgaaactggatcccttccttacactttatacaaaaattaattcaagatggattaaagacttacatgtcagacctaaaaccataaaaaccctagaagaaaacccaggcaataccattcaggacataggcatgggcaagacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttataatctacccatttgacaaagggctaatatccagaaactatgaagaacttaaatttacaagaaaaaaatcaaccccatcaaaaagtgggcaaaggatatgaacagacacttctcaaaagaagacatttatgcagccaacagacacatgaaaaaatgctcatcaccactggccatcagagaactgcaaatcaaaaccacaatgagataccatctcacaccagttagaatggcgatcattaaaaagtcaggaaacaacaggtgctggagaggatgtggagaaataggaacacttttacattgttggtgggactgtaaactagttcaaccattgcggaagacagtgtggcaattcctcagggatctagaactagaaataccatatgacccagcaatcccattactgggtatatacccaaaggattataaatcatgctgctataaagacacatgcatacgtatgtttattgcggcactattcacaatagcaaagacttggaaccaacccaaatgtccatcaatgatagactagattaagaaaatgtggcacatatacaccatggaatactatgcagccataaaaaaggatgagttcatgtcctttgtagggacatggatgaagctggaaaccatcattctcagcaaactatcgcaaggacagaaaatcaaacacagcatgttctcactcataggtgggaattgaacaatgagaacacttggacacaggaaggggaacatcacacaccggggcctgtcatggggcggtgggagtggggagggatagcattaggagatatatctaatgtgaatgatgagttaatgggtgcagcacaccaacatggcacatgtatacatatgtaacaaacctgcacgttgtgtgcaggtaccttagaacttaaaatgcaataaaatatatatatataaaatatatatattttatatatttttttaatatatatattttgctgatgtaagaagaaattttatatacatatatgtagcaggtgatctttatttacagataagattacataatttgaaaatccaactttaataaaaaatccaactctaataagagaatgtacttagatacaaagatgtaagacaaatatacaaagaaatcattagttttctctgtaccagagataaacagctagaaaatcaaatgaaaaatattttataaaaagtagcaacttatatcaaatgccacacagtataaatttaacaacaaaatatatataaactctatataacaaacagaaaatattattgaaagatataaaataccatatgaacaaaaagataaacatatgttcctgaagaggaggttactttcttaaaatgtcatgctttctaaacttaatacatacatttaattccatatattccaattagaatccagtggtattttttcttctccaacttggtaaagtaagtttaaagctcatttgcaataatgtccatacagaacagtaaagaaaagtgtgcaaaagaatagtgggagtggaattgtcttgccagataccaaacttactacaaaccatggggaaaaagaaaagaaaagagaatgattctagaacagggacagaaaagttgaacaattaaccagatagcacagaaaaaagccaagtgttatgataactttaagccaagtgttaaatcactcaattgtgacttttcaattgagtggggaaaagaaccatttgtataataaaaaggcattagcatatgtgcatctccacctgtggaaaaaagaaagctggattgtattacctcaaagcatacacaaaagaatttctagatagactaaatatctcaatcttaaaaattattcaccagcctgggcacagtggctcatgcctgtaatcccagcattttgggaggctgagggagtagatcatttgagcctatgagttcaagaccatcctgggcaacatgatgaaactacatctctacaaaaaacacaaaaaaatcagccaggcatggtggtgtgtgcctataatcctaactactcagaaggctgagacaggaggatcgcctgagtcaagggaggtcaaggctacagtgagccatgatcctaccactgtactccagcctggcaacagagtgagaccctgtagcagaaggaaaaaaaaaaaaatgtgaaaataattatatagctttgatataagcaaagatacccacgacaggaaacccacagggcattttttaaaaaaacctacatagtcatattccagtgtaaaaaatgtaaaatttgttagtaactgaagtcaagagacaagtgacatcctagcgaaaatatccgtaaaatgttgaacaaagtgttgatgtcacaaagaacacctataaatcgataaggaaaagaccaaaaattcaccatgaaaatgaaaaaatgaatagtacacgtgaatcacaaaaaaggaattgcaaataaccagtatataaaatggtcttcaacctcaagaacatgcaaactcacgttagttaacactatttacccagtagattggaaaaatatttcatttcaagcatttcactggtaaaatacattgtgggtgaaattataatccattacaaacaatatttcttggggaaatttggcaacaccttctagaatataaaattcacgtggccttgaagaaaagaaaattctactttgaagagccttttcagtcaaaataaaagggccagtgtgcaaagctgtatgcactagaatgtctatcgcatattttagtgacaaaaaagtaaaaatactgggtccattaatggggcatgactgaatatatcacattacagccatttctacggaacataatgcacacattatgcaaaaaaactgtattttgctgcagtgagatgtaatatagtatacagtagtaagggctctagaggatggaagcccgacagcccattccaagtctgggcttcaccacttcctaaccttgtgaacttcagcagcctccttaagttctctggacccgtttcctcatcagcaaacagggagaatgatagcaacttcacaaggttattgtaaggctcaaatgagataaagtatttaaagcaaaaaaaaaaaagtgttcttaaaatcaatttcaagaaaattaagtcacaaagtaatgtctgttgtgggattccttttttgtcaagataacagatcttatctcacttaccattgcctgaacaaaccaggacattgtccatctgggatggtttttgtccaaacaggaggcgatagttattaattaaggaagcgagactgggtttggactgtggcatacgacgagaggatttggctagttcttagtaaaaggagaccatagcaggcatgcagcattatgtacagatgccctaagagactgagaaacaaggaaaatggggttggaggcattttgaggggaggagcaagtgtgagcatgagcccaaccctgagatccttcaagagcccagttctagttgcaggccacaagtatcctgacaataaacgactctgtgcttcttagactctgcaaggggaagacttatcaaagccacctcacaaaaaacagagtcgttaaatatatactatgtgttttttttgtttgtttgtttgtttgttttgagatggagtctcgctctgtcgcccaggctggagtgcaggggtgcaacctcagctcactgcaagctctgcctcccgggttcacgccattctcctgcctcagcctccccagtagctaggactacaggcgcccgccaccacgcctggctaatttttttttttttttgtatttttagtagagacggggtttcaccgtgttagccaggatgatctcgatctcctgacctcgtgatccgcccatctcggcctcccaaagtgctgggattacaggcgtgagccaccgcgtccggcccatactatgtgttttaaacacaaaaaacacagtatgtatttaacagacgtcaactgcgctgtgccagttcagctaggctaggcttctgcctgtaactgaaaaacaaactagcatttcaagtaaaatgagtaaaaaatataaaaacacattgtaaattatcattttctaatacttaagtcagcttatgagattcctcccacacctactcagtggctcacaaaccctcggaaggaagaagcactgcataacccatctcaatgtttcagtcattacttaccacttcaatagcccactaataaacagtggtttccaccaagataaaatatacaaatttttcaatagacgtagtaaatactgaacaaaagtaaacagaagttgactataatatcaaaaagcagtaccatttagtattagtctgaaagcaactagtgaacgcattaatataaccaacaaacaacctttcacgaaatacttagagattagggccataaactacaagctagtgttcttttcactttgaaatgaaagatcagaggttccatataggccttaattagactcatagtctagaatttttctttctttctctaattaagaggatcacgcaaaaacactgaagtagtagtgccaagatgattccagccaggtagcccagtgcaacacacacaaaaatagttcacagagataatgttacccaattatgaattcagagagactcaatgtacaacatatttcttaagacacagctacaagacagagagtagggcatcatccataaaaggttgggcaaaagatgagggcctcaaagccaggccaaactgggtggtttttcacctagaataatataaggtagtctgcctagaggaacaatctctatcactgttgaggaagaaagccaaggtatataaatgaagaagaggttctaagtgtcaggtccaacgtaaatggtgaggtcataaaaagcaaaaggaatttctaggccagacatgatgaagatgagaaattaaggggtatgaagataacaaattgggtctttgtaagcaggttagaactaaaatggtgaacgctgagactgccggaagatttttgttgtgttgtaccagttggatagtgtgtttgtttgattatgcaggtgcacacatgtatataaacaagctgggaggtagcgagctcctcccaagaggaggtgtaagtttcatggcttaaaggagtcaggcaaaaccaatgttccacctaatattaactatcaaattatattttaatattgtcccttactgaataacaattcaggattgcttgggaccaatagtaaactgattgaaaaaattatccaaatggggataagctatgaatgttactaggatcatatgatgagaggtaaaaggatgggcaaattcaaggctacagacacaacttgattcagaaaatatgaaattacgaagaggaagacataccaagtactattctttggaaagatgagatgtttgttaagcagagcttaatattaacttctttttttttcttactcctttttttttttttttgagacaaggtcccactctgccacccaggctggagtataatggcgcagtcacagttcactgcagcctccacctcccaggctcatcacctcaacctcctgagtagctgggaccacaggtgtctcccactatacccagctaatttttatatgttttgcagagacagggtttcaccacattgcacaggatggtctcgaactcctgagctcaagcaatccacaagcctctgcttctgaaagtgctgggattatagacatgagccacctcacccagccaatattaacttattttttaatataacagactagggagtaacacagaagttggtcctcatatctaaaacagagtaaaaatactcttgactatttacattcaaataatgtaactaagactaacatgagtcactttccgttttccaatcaatttatagattaaatgcttatacctgacaccagaaaaaaatagcaattaaactgtaggccataaaattaatttcttctgcagtacaaaaaaaaaaaagaaaaatgtaatttcatttctttttgacctagattatgccaattgcattagatgttttatttcccatatgtatcagaatgttcaaatagtatataggctactaaaaagaatcattcccaaatggtactctccccaaacaacaaacttctcttattaatcatgctgaaactgtatgcttacaaaaaaagtgagcaaaattggaagcaagagccttccaaaattaaatgaccaactaaatcagataggcagatttgaatgttttttaatcaggcactgctggcatgatcacaacatttaaaatacccaaatgattctacataaatctaactcatcatctttcttacaaaaagtccagagctctaatgaagtccataatgatctggataaaatacacttaattagattataaactgcaacataaaacggctgcatcatgccttttaacatttttctctctgaagatcagaggattgaaagggggttataaaacagcccattcatttttcttgtcttttaaaggaaggaaaaaaccattaggcagaactaaagttccagacaacttttaacaagtgacatccaagtaggtcacattcttagacctcctcagagatgcagggaacgatgatggggtcaggtgaccaacacatcaatgggacggcatgtgatcagacaactctggggaatgctaatgatttcctatgtgatgctgatagtacaagatgtactttatgcttgatgatatctagatgagatagataacaggaaaaaaaaaccaaggctaattaaaatgcatttcaaagataatcctaacatgattttctaatagtacgcaagtccactgtgagtttgagatggtgaattaaagacgaatctattcatccacagatacatctatccactcatacaatttatgtgtttatttttggttgagggagacaggaggtgagaaacaagcatgcaacaattgctaaaaatgtctttaaatatttatctacagaattctcaaatgtgttatcttgactactagagactaagagcatggcctttggagtgaccagatctcctttgaatcccagttccaacatttgttggctctgtaacgctcaggtgcagttatgacatctgaacacagtgagaacaatccatgttcaggaagtaattatgggagattaagtgtaaggcactttgtactttgcctgtcctagaataggtgttgcatacattaaatcacaatcaaaacagacaagcacatttgggataaactaaataagatctctaaataaatgaaagggccagcctcagtggctcacgcctataatcccagtactttgtgaggctgaggcaggaagatcgcttgataccaggagttgaagaccagtctgggcaacatggcaagactccatctctaaaaaataaaaataataataataattagccaggcacggtggtatgcacctatagtcccagctactggggaggctgagatgggaggatcgcttgagccctggaggtcaaagtgagaccctgtcttaaaaaaaatttttttaaaaaaagggacataccatgttcacgattcaatattaagatgtcaaatctcccctaagtgatctacatttcacaccatttcaatcaaaatagcaggctttttaaaaagctaacaagctgattaaaaaatgtttatgaaaaggcaagtgaaaatagccaaatcaattttaaagagagaaaaaaaaaagttagagggcatacactacctgatttcaagatttactaaaaagctatactaatcagaatggtgtggtactgaagaaaggatagaatagtgagtccagaaacaggcctacacaaacatgggcaattgatctccaacaaagatgaaaaggcaatttaatggagaaaggaaagtctcttcaaaaaaatgatgcaggaacaactgtatatttgtgtggagaatcaagaaaacccttatgccataacatattcaaaagttaattaaaaatggattatagttgggcatggtggcaaatgcctgtattcctgctactcgagaggctgagacaagaggatcgctttagcctgggagttggaatccagcctgcataatgtagtgagacccgatctctatggaaaaaaaaaaaagattataaattgaaatgtaaatgctaaaacagaaaactcctagaaaatatttgtgactttccctaagaaaatatttcttaaataaaagaagaaaacacaaactataaaagtaaaaattgatcaaatgaactttattaaaattaaaaacttcggctcttcaaaagatgccattaagaaaacaaaaagacaagtcacaagtaaggagataatatttgcaatgcatatctgacccaggacttgtatccatgtcatataaagaactcttacaactcaacaacatgaaaacaacccaaaataatataggcaaaagattgaacaaatacttctcaaaagaaaagatacaaatggcaaaaaagcacttaaaaagataagcagtagcattaactaattagaaatgggaattaaaaccacactggactgccaccgagcacgtattagaatggctgaaattaaaaagactgacactaccaggtcttggtgatgatgcagagcaactggaactctcatatactactggggggaacacgaaaagtcacgactacttcagaaagcagtcttgtagttttttataaagttagatataatactaaccatataacgtagccactgtgaccacagatattttcctaagagaaaacgtatgtcatacaaagatttgtacatgaatgttcacagtgaatgtccatcaggaggttaatggataaataaaatgtggtatgtctacacaacacaacactattcataaacagaaaggaatgaattactgataggtccaataatatgaatacatctcaacaccattatgctaagcgaaaacagttggatgtaagggtacatactgatttcactttatgtaaaatgcaagttgatgtacagtgacaaaaaggagatcactaatcagctggggctgggggtgggtgagggatagactgaaaaagggtacaggtacaaagaagatatatagatggccatttttatgcacataaaaagatacttaacattagtaatcattaggaaaatgcaaattcaaaaccatgataaaataccaccttaacactcattaggatgactataaaaaaaaaaaaaaaaaaaaggccaggtgcggcggctcacgcctgtaatcccagcactttgggaggccgaggcgggcggatcacgaggtcaggagatcgtgaccatcctggctaacatggtgaaatcccgtctctactaaaaatacaaaaaaattagccgggcgtggtggtgggcacctgtagtcccagctactcagtaggctgaggcaggagaatggagtgaacccgggtggcagagcttgcagtgagccgagatggtgccactgcactccagcctgggtgacagagcaagactctgtctcagaaaaaaacaaaaaaaaaaacaaatgttggcaaggatgtagagaaactggaagccttgtgcgttactggtaggaatgcaaaacggtgcagctattgtggaaaacagtctggcagttccttaaaagactaaacacgagctgggtgcagtgatacatctgcagccccaggtactcctactctgcaggctgaggcaggagactcatttgagaccaggagttcaaagccagcctaggcaacatagcaagacctagtctttaaaaataaaagaagacaagaaaaaattttaaaaaataattactatatgatccagcaattccacttctgggtatataacctgaagagctgaaagcacagattcaaataggtattggcacacctttgctcgctgcagtactattcacaatagccagaaggtggacataacccaaatatgcatcaacagatgaatggagaaatcaaatgtggtatatacatacaatgcaatattattcagccttaaaaaggaagggaattctgatcaatactatcatattggtgaactttgaagacattatgctaaattaaagaagttagacacagaaggacaaatattgtacgattcaacctatagaagtacctagaattgtcaaaatcagagagacaggaagtagaatggtggttgccagaggctggggcaaaaggggaatggggagttatcatttaatgggttcaaagtttcagttctggatgatgaaaaagagttctggagctggacagtggtaacgggtgcagaacaacatgaatgcacttaatgctactggattgtatacctaaaagtggtcataatggaaaatttcattatatatacattttactacaataaggaaatagtaaagaaaaaagtggcacagaaatattttggaagtaatggaaatgttctctatcttgattgtgactgtggcttcatgggtatataaaactgtcaaaattcatccaattaaatagattcatttaactgcataaaattattgctcaataaagttgatgaggggaaaaaaagacactagcaaattagcaagaatatattttatgcctctcctccctgcctttcctcatttcatcctgcaatgcctaccagttttctatttcataggaagcaggagaaaaagaaaaaaacggagggagtgcgggcagggggacattcattcaacaaatacttagataacctccatttcatatgttactccaataagcctgagtgttacaggtttatggatgaggaaactatatgaagtttggtatgaagtcgtttatccaggtcacacgagattaagtggcaaagctcagtttgtaaccaccgtgtttctaagccttcacaaatgtgcattgtaaaaatgttctccctacgtgtgatttcaccagacctacatacatgaggggaaataacaagaggcaaagccatgaaaattgtgcactatcaacaagataaaaagtgtggcaaaaatgataaatgttcaagctgatggatatgctaattaccctgatttgatcattatgcattatatacatgtatcgaaatatcactctgtagcccataaatacatgtaaactaaaaagaaaaaaaaaggacataaaatgtgtggaaaataggtacttctgttcacatttaaggacttcttgcaaagagttattgaaacctttgtcttttgtaatttctccttacttaacaattgggcacacagattaagaacacacactccacagtcacacttcccaggtcccgtcctactgctgtgacctgacgtgatctccctttgcctcagttttctcaactgcaaaatgcggattataattgtaactatctgggcacagtagcacctgcctgtggtcccagctactccggaagctgtggtagaaagatctgactccaagttcaagtccatcctcggcaacacagtaagacattgtctataaaaataacaataataataattgcatctacctcaaagggcttttgtgatgattaaataatggatgtgaagtgcttaacatagcgttagaggcatacgaaattctcaataaatattagccttcctcttccatatagtctacctataacagctatggtctatctgtaatagctaggtacaggtagagttacatgcagaactgaaaaagaaaaagctacttttacaggtagtggtttgaattcactaatgttgtccttccttccttctttcctccctcccactctctctcccttaaaatgcattgctgttcctcaaatatagtttttgcattaaaaatgtatgatggatacagatggcaaatacgcatatgaaaagatgctccacatcacatgtcatcagggaaatgcaaattaaaataacaagaagataccactacgcacatattagaatggccaaatccggaacactgataacaccaaatgctggcaaggatgtggaataacaggaactctcgttcactgctgatgggaacgcaaaatggtacagccacttgggaagacagtttggcaatttcttacagaactaaacatactcatcacacaatccagaaatcttactccttgttatttacccaaaggagttaaaaacttatgtccacacaaaaatctgcatgtggatactgacagcagctttattcataactccccaaacttggaagtaacccagatggccttcagaaggtgaatggataatcaaattgttgcacatccagacaatggacaattatttagcactaaaagtaagtgatgttatcaagccatgaaaaggcacggagcaatcttaaatgcatactactaagcgaaagaaggcagtgtgaaaaggctgtatgatcccgattatatagcattctggaaaagataaagctatggaaacggtaaaaagatcagcggttgccagggatgagagttgagagagagatgaacaggtgaggcacagagcacctctgtataatgccataaaggtaaatacatatcagtattcatctgtccaaacacggaatgtacaacaccaagagtgaacgctaacagaagctgaactttggtgataatgaagagtccatggaggttcatcagctgtcacaaatgtcccactctggtagaggatgctgagaatgagggaggctgtgtgttttgtgttggaggtgggggaggagggcaggagggatatgagaaaactctgtaccttcctctcaattatgctgtgaacctaaatttgctcttcaaaaatcatctttttaaaaaacatgtatggtggaaactatgaatgatgaaagaaaaccccattcagtaacctgaagcagcacgttatcttacgaaataataaatgattcatttatctttggcagaatcgggtcattttcctgcctttctctttctagggaaataaaaattttacactttctcaaacatttggaagattgtctttcaaaagccagtacaaggaagcttgaggaaagctttttatagccaagtataacagctggcagtctagaagccatatacaacattttgctgttctacagaacttatagcagctcacaaaagcaaaaccatttttattgaggaaacaataaaaattgttggaaattttcaaaattaaatagtatagaaggacttttattgtaataaaagtaatctatagataatgtttctcatagttaacaaaggtgcccatttacctactcaaatccacatttcttttttttttttttgagacggagtctctgtcgcccaggctggagtgcagtggcatgatctccgctcactgccagctccgcctcccgggttcacaccattctcctgcctcagcctcccgagtagctggaactgcaggcgtccgccaccatgcccggctaaatttttttgtatttttagtagagacagggtttcaccgtgttagccaggatggtctcaatctcctgaccttgtgatccgcctgcctcggcctcccaaagtgctgggattaaaggcgtgagccaccgcacccggcccacaactccacatttctaatggactgcaaattcaccagcggtaaaagtaaacgagggaggcaatagatcctttgggtctgatgttacagccaactcaagtggcaggcttttgctagattttctaagccagcagaggcagggataataaaacacatttacctagagaaaaaaaaaaatcaaattaagatgactttaagtattctatactaacagaagaactattaaaagtagttaaatccattgttctgaaaaactgaacagagatatgaccaactggaggtgttttgtctctctcgactccactggcactaggacctttttctcctattttattatcaagcatggtgagccagccattgccatgcccaagtgctgcatatcttgtgagtctaaactgaaaacaacatatctcagacgttatcttagacttgaggctgaggaacagatggatttaagaaaaaaaaccattcctttccttttaaaaggtcttaaaaacttttgagaagcttcaggaaaaaggcaagtaagatacgattattttgtggcataataagatttcattttctgaaactcaatcaggagaactaatgaagaagaaatgtgccccttgcttgtggaagccagcttaaactggtaagagcccaatcactcacagtatttgttaagcaaaatccatttatgttggaacagtaggcatttaagcattaatatgaaagttaaaatagagaagacagtacagaatacttaagttacaatttcaaattcgacagtgttgacagagctactccagagaccactaaatatattgctttaaaaaaaaaagttggcggggcataatggctcacacctgtaataatcccagcatattaggaggccgaagtggaaggatcacttgagctcagactcaggatagaccagcctgggcaacattacaagaccttgtctctactaaaagaaaaaaacttagccaggcatggtggcacacatctgtagtcccagctacttaggaggctgagatgggaggatggcttgagctcaagaagttgaggctacagtgagccacgattatgccactgcactccagcctgggcaacagagcgagactgtctcaaaaaataaaaataaaggttgcgtttttttttttaaacattatatatctgagaagatctccatatataaatatttcattttaaacagctaattgaaaagttccatacatttatatgtgagaacatttcataaggttttaccttatcctaatcatatcttaactctaaatattccgtttaacgacaaaaatggcataacattcccaaagcagcaaaatgtctttcttgatttctgaagataaaaaaggaaaaaaatagaaaaagcagaaaagcaataaactgttattcattttaataaatttttatgatccctcagtcattactaaattggatcatatgataatttctcctttggttatcatttttattgacaagttttcagctgttttttcttcatttgcaaaatgagtcctagatctcatgtctggcataatcactcagctcccataaagaaagacatccaggacccactttatcttcatgttacttttctaagccagcccatcaaaagtctgaggagacagtcactcttactgctactgacaataccaactggtttagtgtacactaactggctgactacacacatctattccttttcattcctaacagaatgctgattttattcacatattcattctcattagaaataaatgttttaggccaggcatggtggctcacgcctctaatctcagcactttgggaggccgaggcgggcggatcatgaggtcaggggtttgagaccagcctggccaacctggtgaaaccccagctctacaagtacaaaaattagccaggcgtgctggcaggcacccataatcccagctactcgggaggctgaggcaggagaacggcatgaacccaggaggcggagcttgcagtgagtcgagatggcaccactgcactccagcctgggtgacagagcaagactccgtcacacgcacacacacaaaaaagaaatgtctcaagtgcttaaattcttgtaaaaataactgcaaaaagatatatgagtaaggactggtaggtaccatatgactatttcagcaaacacatatcacctggaaaaaatgtgctgatagagtttctttaggatcaaatgcgtggtagggaaatccacatcaagtccaataaaatggtaaaagaaaaaaagaaaaagccaggcacagagactcgtgcctataatctcagcactttgggaggctgaggtgggaggatcacttgaacacaattcaagaccagcctgggcaacacagcaagacgccatctctacttaaaaaaaaaaaaagaaaagaaaaattagctagtcatggtagtgcatgcctgtagttccagctactcaggaggctgaactgggaggatcgcttgagcgaggctgaggctgctgtgagccacgatcacatgactgcacccagcctgggcgacagagtgagaccctgtctcaaaaataaaataattttaaaagttaaagctaacaaaatatacacaaaaacccagaaacagtgatgtgaaagaagcttttgattcgttagtgatgaaatgagagctgccttgatagaccggcactattacaaagacgtgcattgcctgatcaagaggtggtgcttctcagagtttctaaaccaaagattgaattcttatttttcttcatggagggaaaaaaggccacaacgttacaatataaaaatctgaaaaagggaagtgaattgatttttcatctaacttaataaaatgacttatttggctgatatttccttaggatctcaacaacctcaagccaaaacttcatagtttttcagggcagcacaaacgaatcccacaggttaaatgaagagctgctcattaggactgagaatcaggaaagagccttagttcatccacatgtgattcattcacatcattgacttaaagatcgtcaccattcattgttcctgagtggggagaaaaaaatccacagaatatttccccgagatcataaagaggttagtcactgatttggggatctttatagtctaccatttgacaatgacttggcctttctgcgagaaaaaacatccatcaggagtaccactgaaaatgtgctgaatttagagcacctctccacagtgactgcaattacagaactcctaaatcactgaaaacactctgaatcttggttttaaacatcttgtgacaccagaagaggacaaaaattgtcctagtgatgatgaacctaatatgtggtgtgtctgttttggattacaattttcccaattacaaatgctagtcatttggaccactaacccaagaatgccttggttaatttctcaaggacaaaatgtttacatattgatatattttaacatttcatttttgaaatgaatgctattttatttttcaaaggcagatgatgtcttacctacccagtgtatttataacccctttgaacacttgacccatattcctaagcatccttatggcacttaaaatgcctaaccagttccaaatgttcaataacgtttcagcaaatgcttgctgaatgaattaattaatgagcgaaggtatgttgaaaaaaattagattttcctggtaacttaattttgaaatagaaaacatataataataaatgctagctcaaaataaccctagtaaagcaatataagtgactaccttggaaaacttacagcagaatgcatcactgctcccactcccaaacctgctaccacttttgcgttctttatgctatgagaggtaccactacatccacagctgactgcatcaggaagagcccaagaccaccttcagtttcagttatctactaggcagactctcagggctcggcacacagtcgtactcacagctgcagtttattacagggaaacaacaccaagcgaagtcagcaaggggaaaggcacatggggagaagtctgtggaaacagagtgggagcctccaagggccttcccccagggagtcacaagggaggcacttcactcctcctacaaaaagctgtgataacgtgagaaatgtcccagtcagggaaacccattagagactcagtacccagggtctttattggagttcaatcgcctgtaggcagcctctaattttggactcctggaaggacagcaggggatcagcataaaccataatgttgacacaaacagtttaggcactgtcagccactcttaccagataagggggaaacacttgctgaaatctcagttgctaaatgtcagccaagggccaaacttgtgggcctgcccttccttcctttcctccttccttcccttccttcccttccttccttccctccctcactcccattccctcccctcccctcctctcccctccctctccttcccttcctccctctctccctccctttctctctctctctcttaacagtcttcctctgctgcccagactagagtgcagtggtatggtatcagctcactgcaagttccacctcccaggttcaagcaattctcctgcctcagcctcccgagtagctgggattacaggcgcatgccaccatgcctggctaatttttgcatttttagtagagacagggttttgctatgttccctacgccagtctcgaactcctgacttcaagtgatccacccgcttcaacctcccaaagtgctgggattagaggcgtaagccaccacgcccagcccaggtcttttcaaggataagcagtttaggcctgctaggttaactcttttctgcacagcgactaggccagaaaccaagaaataatcccaattcctacttcttcactgtccctcatctcttctaggccaaatcctgtcaattttgctcctgagtaacttccctgtactcccttcttcctgtcctcactatcgggctttaatggaggcctctgttctctcttgctcgcatcactgccggaactcctaccttgtctcctgcctatccttccatccattctccacaggctctttgccgggaaggctgcccactgccctcaacctcccgagcatagtggaaaacagggcctttttctgatgtgcccaagttttctctctaatttctcaacactttctcccttttgtactctctgttctagtcaaactgaactattaaatgcagttctcagaaagcatggcactttcttacctttgtcactttgttctggctacttgtcctctacctagaatgcatttccacttttgcctgggttaagaagtatgtaggctttagaagtcagctgaggcaccaacacaaatcttccccagatatccccgtctcccagtctaatacctcatgcctactcccctccacggcatttatcccactgcactgcaatttcagtctattttattgatctatcccctatactgtgtgtccttaaaggtgggactgcgtatccccagtgtctagcatggtcactgacaaattgttcatgtccaataaatacttcttgactgaataaatgtcacaacttcagcagggttcccctgaggtcagctccatcccccggccttctagaccggactgaacttagacgattttggcacagacactgggaaccgtgcatcgttcatgttatcctctttgcattggctttgttcaaaagctaacagccaaatatgtggtggtcttcctgtgaccgtgtaggtctgcagagcctataatctgtatactaattacacttttggtttcgacttaccttccccaacctcttactctgattacttcacttacactttatttgtatctttgtgtgtgtgcatggttttttccaaagctgaaattccttctggactaaagcaggatataaatagatatgtatatagtcccaaagagatgagaacactgtcccattgtttagaggaggtgaaacctcagtttttctcagtatcccattcctagctaaatccaaagtctcctaaagcacaacttacaaaaagagctattttcctcctagttcttcagctcaacttcatgcaatgaagttactctaaataaaggaatgcatacgtgcacccatattttcttcacaagacttaggagcaagactcaaaaaagtgaggacagatgcgcgccttactttatccagtcaatgtgctgctgaaaaactgggtaaaatgagttgtttaaatagaatcaaaatgtcagtttactagagatgctcactacttacagaaacaccacggcaaatccatgaagtaattatggggtgaaagaagtaatcaccctaaaacttatctgccttgtaatcccagatttacaggctgaggcaatgttaaagtatgcttattagaaaaccctcaagttctactgtgtataaacatgcaatcctcttcgtttgtttcatcacctataaacgtaactcaagttaataaccagccagaaaattcaaattaatattaaatactgaaacactgttatcaccaaattcacaccagaaattattagcacttcaaatgtgagaatgttctcaaagccctgttaattccttccttctacccctacttgacagacattccttgacaacctcctaagtaaaacattccttctctacatgtcaatagattccacctaagaaaggcaaagtccttgctgtcaaggaacttatagccacgtagagttcactctttttgttatatctgttactaacatgagacttttttcttctttaatccaaattttcatttcatttttttctcctttacatctgtttttgttgtaaactgccactcaggagataactttcattaatttgccttataaaatttctaccaaaaccaactaaaaggacaagagaacatagaagaaggacagtacatgcagagttttaaaaaccttaaggaagattaaaagctcgtcaccacataaatgtctaaagttattactaggccctaccaatttgaactttgggatgaaaactccttatgaattcattacagatttgaatttttaaggcaattcagttcaactcatctcaagtacgaacacagtcattcaaaccgggctaataaaaggcagcttagtggacatcctaaaaggttgaattttcatgaattaacagattggcaacgagcttctcaacaatttggatgtaaacaagacatttagaaagctgctgaaaactgtttcttcatgtaggttaagaattagtcttccaatattttttacattacaattcttatttttcaaatttttttttacaaacagtgaaaaggtagtgtgtctaaaattctctgcactgctaaataagtacagattgaaactatcttataaatgaatttgacaatgacctgtgacctagaggcaaaagcagacagtgctgtttaagctgctcagtaaaatttgagctaaactcgaaatgtagaagcaaatactttctagaacacctgatagatcaatgttttaaaatccttgctaattgcttaagttttcattcttttgtaatctgctccttgtgtgtacttaacctactcacaggtatttatgttaattcattagatccctcagggtgggccgggcagactattatctgaaagcactggtgcatagcttcctgggtcagggacaaataaatcttttcatataattgcatgtcgttttatgtgttgctgtcttcccactgggaaaaatgttaaaatatttaaggcttactatctggtgtgattgtgattttataattaaagtctgggacaggaggagagagtggcagaattcagtactttatctcagtaggaacagtctttctttgaagcggtaaacttttagatagtcaataaaagtaaaaattccggtgaataagagctggtagagtccttttgaagtcacgtaccaccatttgatgacaatctagtttaataaagatagagctaaaagaataagaaggactgtatatgtcacaaagatcgtgattctcttcagtgataaaatcaagtaaatattgtcatcaagctaaaatatacccaattctaatacagcaactgtttacctatttccaaatttgtctacataccagacagccagtgggggagaatggttttattttgttcttaattagaacagtatttggagctggaactatctaatgggcaagtaagccaagcattctctcatccactcactcccttcagcattcttctcttacccctatcttctggaccaaaaaataaaaagtctagtcaggaagtggggagtgggagttgcgggacaaggtatgagttggggagagcatctgggttttatcaccaggtgtgtcaggatttgcagtttcttgaaaatctaaatcttcaggttgctgtgcagacttgtgcctcctggtacaaataatagctgcgcccacacacactaatgcccccccacagcccacagccttggggcgctccaaggagagtgagttcaataccagcagtaagggcgactcgctcctggacgtgaatctagcatgcaagatcattttcattaaacacgtaactgcacagcgacgatttacatctcctcttatttcctttgaatgagaagcagacgcataacagcaatctggaatagaaagtggagcttttacaggctgttgtatgtgcaccaaggccgggagaggctgaggtccgtcagcatcatgtggcaggaaaaccgcaaatagttcgaaaggccacactctccggcaccgactgagtagctgctgcaggaagggggacaaatggtcctcagcaagaccctcttcagaaggaacaagagaccgtgtggagggcccatgagaatgaatttgtggtttgcaactggtttgtcatgtctcaaaataagtaaatccagtatgtgtgactgtttagaaaagcagttaagggcggttgagtctttcttggttaattaagtgattttcatctggaggtatgtttggaggaaggagcctcctggaaagtaggatcagaaagaagtgtttagtgtgaaaaaatcagttccagatgattttgtgtatatgcctcgtgtttaaattcagactgttaagtctagacactggaaatcaaactacaggtcagcaaaaaaaaaaaaaaaagaacacccacgcagcaaaaagctgtcatttcactgccacctctgttaaaagggtacaaatatgctatgcttgcttcaaatctatgttttataattctcttctttataacaaaaagtcttctgacaacacaatcaaaaacgaatagtcagaagtaatgatgatctaaacctaaatggttaaagtctttgctgatggatgcagagctcaggagggaggctatgactgggagggggcagaaaggctgagggaagaacaagaacatagagacggagcgcagggtgcctgcaacctgctaccagtcaaacccctaccacagtttcctcatctcgacaaaaagcataatcaggtacatgagtttactgttcataataatgaactacagaagcatttgttattgttacactaataaaaaccacaataaaaaatactactcttattagtaacaaatcaaagaacctccttaatatgaagtcagtgtgaatggttcttggaggggagccagttccgcaggcataacagccatccttttgcaaagccatcaatccagaattaccagtcatacctccaacttatgccttaccttaccccttatgtcttaccttatgcttctgctgaaaaagcgaatgaaaagctggtctcccttttcaaaaatgaaaccatcaaaaaccaacatgggaaggagaagaatcactgactaggatatgtctgtgcagaaaacaaggtggctctcatctgaaaatataacatgacaaaggcgaccaactacatagaacatcatttagattctctccaattttgagatgctgtagctggagcacagagataaccgcccccagtcacacagcctgtctgcttctggactctgtattcttagtcatgaccttgtagctgccttatcatgttctaccataaaaatgaaaattgtgaaacagaaaatctaaatcaaaatgttttaatttgtaataaaagaaaacaaactgagaatctgcaaaagttgtgaaaattttcttctgtgtgaggaaagcttcgtgccagatatcttaaactcaacataaatatccaacacatttcacataaaacagaacaatactgccatggtaatgacgctcctcagttagacaaaaatctcaagagcaggcctgtctgctgatgttcatcactaacctacagtgtatgtgcatttgtttttgccaataaactatgctgttgccagagattaaacataagttcctaaatgcatgtatgattgtttgtaattacttaatattaataagccgaactgataaacacaatcccaaatcaagaaagaaagccaacataaaacagaaagatggcattgctaaatcccggaagacatcacctcgagcttttcatcatgccactttgaagttcacccccatccaaaccctttgtggcttcctctgaagaatcctgaggcagaggcagcagcaggctcactcctccagctgcctgcgaaggctgaattccatttattccatttggggttggtggtgggcaggacgaatgagactgttgtcattcttcccaggaatgcttagatggacagtgagctattggactgccccagataccatcatctcccccacatccctcctacgtggagccttagtttggggggaagtgaatctcaattgcccccttccctctccccgtcaatgaggcaggcttgtggaggtgctggccacttcttaggcctaaatctgtgttcagagagtggatccatgctttgagagatggttgccctgcccgtcctagactatcttgaagggtgagaggcacaggaacttagagagtcaaagactaccaagagacacaccgaaaactagtgaggtgggaactggcaatttctaaacctacggcaacagcagtctctggtccttcttttcatttcccgggacctccatcctgagggctgaactgataacattcatcttacttttatggatgatgaggaaaatgccacaagtgagtttaattctcaaaggagaaagagaaagtggtatctaatatcgattaggtccaaatatactctcttggtgttttagccagaaatacatctgggcatttctgcagcaatctgtaagagactttatacacgtatccatctcaaaataatgcgcttttagttattagcttttattcatttccattttgtctttttaaagtgacatccaaaatgatgaaaagcttcagggtactacaacaccataagataatcttcctgtattcacttccccaaagtacccagagatgggccccaagaggagtcctcctcacgaagaggtgaagcaccgacctgaggatctgtcagaaccctgatcaaaaagcaacagaacaaagtgaatggcgagataaagtggagagggagccattgtgtttacgttcacctaagcaaagtcctaattagtgcccagtcctactggaggatggttttaatggcatgcaccttttatcgcctgcaaatgcttaagggtcagcagaacaagccactgccttgttagataatgaaacacagataaaaatttatgtgtaattggtatgttttaaactggtatttaaaagctatttatctcttagtggggacaaatattcttttaagtcattaattggcaaccataaattttaattctattctaggcataattattacagatttcaagtaagtaggctccaaaacaatgaggctttactggttcgatcagaaatacttgttgaagggtttcctaagaagattacaataggataaattaattctatcagcagaagcactggagtatagaatgtcaaatacagtaaatccatatgtaataaacatagatatctaagatgtgtaagtaagtaaaaataaggatgttgcagatatatatacaatatggtgctgcttatcaaaacaacacaaaacaattttttgtgtgtgtctgtaaaaaaaaattgtgggagtggggatgtgtaatgctgaaggtgaggtgccaaaatgccagcagtggctacttctaggaaggagggtaggacggtgggagaaaacagggattaaggacaatgatgaaggggaattttgcctttgttataaaatgttttaaattatttaaaataaagttattgcatttatacattatttgtgcaattaaaatatttcaaaatttcagacttatttatccccactataatcacaagtagtgattactgagtatgggaagagcctagtacctaggggtggtgccattataatcccaaaggacacaatcctgaatgccatcatccctgaaaatattggtatacaggcctttaaaaacaaaaaaggcctgagagtaaaaattagcctgaagtcgaaatctctgaaatcgaaaatcctgaaaatcataatccccaaacactgaaaccccaaatgctgcaatcctgaaagccaagttctggggagggattcgagtgctttccgctgtgctcactgtcgctgcatcctgtagttctggggagggattcgtgtgctttccactgtgctcactgtggatgcttcctgttagttctggggagggattcgtgtgctttccgctgtgctcactgtcgctgcatcgtgttagttctggggagggattcgtgtgctttccactgtgctcactgtggatgcttcctgttagttctggggagggattcgtgtgctttccactgtgctcactgtggatgcatcgtgtagttctggggagggattcgtgtgctttccgctgtgctcactgtggatgcatcgtgtagttctggggagggattcgtgtgctttccgctgtgctcactgtggatgcatcgtgttagttctggggagggattcgtgtgctttccactgtgctcactgtctttgcatcctgttagttcgggggagggattcatgtgctttccactgtgctcactgtggatgcttcctgttagttctggggagggattcgtgtgctttccactgtgctcactgtggatgcatcgtgttagttctggggagggattcgtgtgctttccactgtgctcactgtcgctgcatcgtgttagttctggggagggattcgtgtgccttccactgtgctcactgtggctgcatcctgttagttctggggagggattcgtgtgctttccgctgtgctcagtgtggatgaatcgtgttagttctatcatgttagacaggactcttatcttgtggttgtcttcatctggaaattagctatggtttaagatgtgtacaggtgccagattcacaaggggtagacttgtagacttaattttcggtgtcagcttgactggattaaagagttatctagtaacttggtaaagcattatttcagatatgtctgtaagggtgtttccagaggagattagtacatgactctgaatggagtaggtggagatctgcctaaaatgttggcgggcaccatccaatcagccttgggtccagagggaacaaacacagatggtaaactgctttctctctgagagatgagacagacttttcttctgccttggacgtaagaaacattattccaagtacacgcattatcacaatgctgctttgtgtataagcatggtgcatgtacataaaaacactgaaacttcttccataaatgaagaactgccttttttctgtgtctccatttgtgaaagataaaatttcttgagaccttggctctttgagtgactgtatttgtggcagtgaccagaggtttttgatccatctcatcaaaacatgtctgtcagggtatttttgatgactgcagttacaacgatggatgcatacaatttccaaccatagtaataagcgttcacacatttcactttctgacctatttctttataaatacagtttgtctgttcatagctataatagctgagtgactcccattagtatatctgtgtgttgatgcttgcaaagagaacatgtatggtattgttgcctattttactgtgtaaagtggcctataatgtgttcagtcatgtatttatatgtctctaaagtcttcttttaaaattgtaacaaatgtattttaaatatttttaaaactttattccacaattatatttttgaaattttggtctctcagaattgtgatttggggattttagaatttagggattttaggctggagctagtgaatcacacctataatctcagcactttgggaggccaaggcgggcagatcgcttgagcccaggagttcaagaccagcctgggcaacatggcaaaacccgatctctacaaaaaatacaaaaattagccgggcatgatggctcctacctgcagccccagctactcgggaggctgaggtggaaagattgctggagacccggaggcagaggttgcagcaagccaagatcacgccacggtactccagcctaggtgacagggcaagactctgtctcaaaataaataaataaataaaactagactttagggattttaatctttcaaaatttcaacatttggaattatggcattcaagatagtgtctctcaagattatggtccaaacctccatagaggtactggaaagcacaacgccagatactacagaagttccgtatgactccattctggcgcaaccatatgcccatgtgtcaggcacaatttcctaagaagaaatcaagtgtaatagatggcaaattggtctcggcctaggtcaagcttgtccaacctgtggcccagcatggctttgaatgtggccaaacgcaaacttgcaaactttcttaaaacataagtttttttgtgtgatttttgttcttttagctcatcagctatcattcatgttagtgtattttatgtatggctcaagacaatttgtctccttccagtgtggcccagggaagccaaaagattagacacccctggcccaggtcagtagcaccagaaggatatctagataagatcaaactaaattaataagcagtctgcagctccaaagcattgactttgaccagtacttttgagaatccttaggctaattcctagtaaagcatgttttgcaaataaaaaaaaattatcttccttttttattggtttgccaaaaaaaattaaaaaaaaaaaacaaactgtgaacatacactagaagcaacaaccataataaaacttctggtaataataaggcagctcctcccatatataacataccaaatataacaactataagctctggattcgacatttaaaaaaactaactgaaggtactagagagtggccaaaagcagacagaaactggaagggagttaacacttgaaaataaatgaaaaacactagatgagtttcttgtttataaagctttttaaattgaagccagaaattttctggctgtgccagctggggcaactgcaagttggatagaaatctgcagcttcttaaagaaacaaaaggaaagtgacaggaaaaaaatcccagtgagggccagagtctagtgcataaaatgcctgaatctctgggtgacccctactatccacatgcattgaggagaggcccagcagtccggaaaagtctaaaagaactgaaaagtgatttcagttgctgcccttcacaggggtaacaaagttggagcacacatctgccaatataatagcatgctaaagcaatacacacacacacacacacacacacacacacacacacacttcagaggaatataagagaatccagaaacctataacatattaaaaatgttctgaataaaacccaaaattactagacatatgagggaagaggacagggtgacccattctcaagaaaaaaaaattcaatcaatgaaaaccaacccaaaatggcccaactgcctcaaaaactaggtaagaatgtttatagtcagctttcattactatgcccaagaaaagacaggaaaatatgcttgtaatgaacaaataggaaatatcaacaaagaatcttaaaaatgtgatatgaataaaatgtgaaatgaatgaaaaataatccaataaaaatggaagaggaagagaaagacacaaataaaagaaccagagagacggcagtgataagaactcagtcttacatggtaagaactcagcatgatattgttgcctgtgaagacaaaaggaattttccattttcttatgccactaagtttgtggtactttcttacaacagcaataagaaacagaaatgtgctgaaagagaaggagaagagaagctgccaatctagaatcctctatccagcaaaaaattgtctgcaagaataaaggcaaaataaagacattttcatataaaagaaaactaaaataatttattaccagcagacctgtactaccggaggtgctaaaggaagtccttcaggctgcaggacaatgagactagatggaaggctgaaatttcatgaaagaatgaagggtgctggaaatggtaaatacgtagggaagtataaaagactctttctctgaatttcttcaaaatatatatggctacttaaagaagtaaaatgttgtattgagggagctttaaaatatgcaaatataatatatatgacatctgtaagactgaggagttcatattttacatgaaatgggacaatgttaactttagactgtgaaaatttaattatctgttttataatcctagagaaaccattgaaaaagaacacagagacatatagcaagaaaaaaaaaaaaaaaagctcagccaaaagaactttggcaaaagaaccgaaagataatatacaataaaaatttttttcatggaaaatagttttggaaatgctactatgaaatctcagcaaattctatttcttgccaatgtattcatctgcataagaaatggtaagggatacatctgtagatttaaacacgcacataaacacataagtccactaaaatggtcagattttctactcctcattcaattaaaaaagaaactatataaagaaagcaccaaaagacaaaataccaaacccgtctctacttcagttctctgttccattcacaattctcacccaggaaagagaaattcaaagaaaagacagagctggaacttcatttcctatatatagttagccagcattcttcagtgttgtctacacattcacccacatccaaatgtactgccaacagaccaacacagagaagtgctgagttaggtttcagtgtgtttctaatatatcccattttattcaagacagaataaaattttgtttcaatgtgactcctctgggtttaaaaaaaaatccaaaatcttagacttaactatatagtcaatcaactagtacataaacaaatgacttcagtacactaatgctgatagccaaaatagtaaaaaataagtctaaggcatgtcacttacttgctctttctggctcatttattttaactgctcccactagcattctgtctggttttgttttttttttctagattaattcaattctcttccctttggatgagatagaaaacagaacaaaaaaaatgaaaaaaaatgctttgcttcacaatcagtcagtatttattgaatgtctttattgtcacacagtatttattgaaatactatcatttgccaggcatagaagaagacgagataaataagatggccccttatcgtctaagacttaagtaaaatacataggatatatatacataatagatataaaacaaagctgactgtttcatgaaagcagaaaggagagagacaatcttttcagttggagaatcaggaaaagtttgtccttgcaggatgaggttttcagaggtaagctgggggtggggaaccagaagcagaaataggagaccagggaagtgtaggacaattcagggaaaggtgactggctcagtatggctggagcatacaggctacactggtggaagctgtgagagaaaacatggcatgtctaattatggtggctcttgaagccaagctaaaggtcttgagcctcatttgataggcagtgaggttcacagaagatttttttaaattgtggagtgacatttttcatcatttaacaataaacagcctttggaagtattatgtgccaaaaacatgcaaacaagtaatagtacatcaaggaatcccacaaaatccaacctcaggcagactgcagttgagtagggagctaactatgtaaagagaacaacaagttagaaagccttagtgaggattatgctattgttctgtctaagccaagatggcaagcctgggattgccttaccaaattcaagctcccagactacatatgacacatacatgaaagaataatttaaaatttaaaaaaaagagagaagaggaatcttttttttttctgtaatcagaatacctatcatccaggaaaaggtcataaaacagtgcaaaataacaccacaggactaaaaaaagatttttttttaatgtggcaaaaattaatacaggatttcctttgcaaattatccaggctttttcccattctggcgtagatgccactactctatgtgcccataatgtcctgattcttcctctctgtaatgacagttctcatcccacaggattcaagttgcctgtttatgtatctgacacctctgctattttatcaactctttaagggaaggaattgtgttttatgaatgacattctcatttttaaaaagaaaacaatcgtttgtcaaataaaaacaaaatctgtcttcctttctttagactttcaaaattagctcaaataaaaatatattattgttgacattcagtaaagtacatgttggcagcctcttttaaagtgcctttcataaaacaagcagaagatatacacacagatacacacatacactttttaaaatttgaaataatataagtgctcttactgtaaaatgtcagacaacttttatctgaagcattcaaaaatttctcccctgccccaaacactccttattgggctattgttatcccagtttcactcttagaagacttaaggagaaaaagcattaaatagaatttatgggaggtcattgatttggactaagctcctacactaggccccgagacacgaagccaacatggagttattgagactaaagttccaaactgaaaccaacttgtttaacctgagaaagtaggagagagataatagtctaatccccaaccaggccacttttaggcaccgtgataaggaaggcttcttctgttttaatcttctatgaaaaagtaactttgaaatgaccggccttcttgttccacttctgcttcttcagccgtcttctgcctatctagaccatctcctcctgcgaggatgtgaagtccatccatctttcaaggtcaagaagtttagactttattaggaggcaatggagagtcgaagaagaatagttcaattcactttctgtagaagtgactgaaggaagggtacttccacaactgcaagcacagaagccattaagaggttgattcagcgacccatataatggtggcctcaattaagggactggcagtgtggctgaagaaaaacacctagctaaaagagaacaggaagcagaactaaccagatgtattgactgactgaatgtaaagataagggagagggaaaagtcaacgatgatctataggtttcctctaaacagtcattaaacaattatttactgagcaccaagtatctaccatggttccaggtaccagagatacatcatcagacagaagaatgtctcatttttatggaggttatagtttagcagaagatagacagtaaacaaataagatgtctacaaaaccttctctcatcattctttttttttttttagagtaaagtgaaagcaactttattaagaaagtaaaggaataaatggcttctccataggcagagcagccaatgtgatcattctggccaataggcttcttttgtcttaggtgtgccagagtacaccacgcattttggaactagatggcacagagcagattcacatcatatgtacagcttcactgggaatccttcatcccaatgaagctgataaagtctgaaataggacatacacgttaaaagaatgtctgaatgattgtaaggatttttctggcttctagcaaaaaagtaaaatattgtttgtacttctgaacaatttaaggaattttgaaaagaactctgactctacttttttcccatcacataatgaagattgatgtatttattacttggtggtgtgaattagaaatatgataaatttaaagtctaacttgtttcccatccaaacttcccaactagactgcactgtattttttatttttctctaattgttgtacatgggtaagtaaaactcgtgtaagtttccgcatagttcacactcatgggaaacaaaaactgcgccttgtatatcatcatcccccgactgtctgtcactcacagaattcaaggcacatatgaagtgctcaataaacaagagcttagaggaaatcaatgaggcttagtgcatagccttattgcaaactgtggtctccaatgcaaaaacaaaataaaacaaaaaccccacaactaaaaacaaagtaggggatgttaacaagagaacaaggatatgaaacctatctcatgaaagaataaacatttcacacagaaatcataaatgttggtattaattttaaatgacatttgtcagccatagaaagtgatctctaataactcacgatagagcagtttaatgcccaaataattgaaaaaagaattggagaggtaacctaacggcagataagattaagtaaggaaaatttcaatctgtgtgaagaagagaaggctttaatttttcaaccctttgggacaatttggaacatcagggctctacaccaaaactcgactttatttatcctatatatatcctttatttaggatccctaaatttattttttactttcttcatgaactcgtaagtcagtctcctagggcaggggtccccagggctgcggactggtactggtccatggcctgttaggaactgggtcacacggcaggaggcgagtggcgggtgagcaggcatgaccaccggagctcagagcagtggcagcactggattctcatggagggtgagcaggcatgaccactggagctcagaaaagtggcagcattcgattctcatgagggcgtgaaccctattgtgaactgggcatgtgagggatctaggttgtgtgctccttatgagactctaactaatgcctgatgatctgaggtggaacagtttcatcctaaaaccatccatcccctcctcaccgccccatccatgaaaaactgtcttccacgaaactggttcctggtgccagaaaggttgggaaccactgtcctagggcaaccttgcttgtgtgggtaaagttctttaagaaaacgggagactctaggagaaaaaagaactattattattgtaaaaagaaagattaccaaggactcttcttttaccatacaaaggaggaaatccttactacaccttagtgtccaagttcagtatacctttttgatataaaatacacagaaaagcttaatatttgatttatcttagtgtattatctatctcccccctctagaatgcgaactctataaaggcagaaattttttatctgtgttgttaactgctgtctccccaatatctacaacaatggttaacaacactaggtagtcaacagtagctaagaatggacgaaagaatcaaggcttggataacaaaacagctcgtttatggaatgcatgtatattttcataaggataattagtgtgtgtaatcaaaagcaaagcccttctgaaagaagtccatcaccaatacagataagttaccactttgtttgattatcataaactatcaaacaatgcaacccactgaaaggaaaatgtgagacaaatttaactcctatgaccttagcgttgaggaaggaaagatttacatagcgtccattgattcgctctgggaagagtgtggttaccttcaaaatctaaagtcaaaatctaaatccctaagtcaaaacctaaaacctaagagctgaaagacttctctgtgtttaagcaggcatcctgttttcactctgtggtatctaaatagaagcttcaaaaggagactctgtgcttgtgtttacaaactgtgagactgctcaaatatagaaacggaagactttttgttgttgtttgtttctagtttttctttttttcttttttttgagacagagtctcactctgtcacccatactggagtgcagtggtgtgatctttgctcaccacaacccctgcctcccaagctcaagcaattctcatgcctcagcctcctgagcagctgacactacaggcctgcaccatgtcacctggctaatttgttgcatttttagtagagacaaagtttcgccatgttggccaggctggtctcaaactcctgccctcaagtgacctgcctgccttggcctctgaaagtgctgggattacaggcatgagccactgcacccagcccctagcttctattttttttaattactagtgtaccagctcaggattgaatacatctctcctcctgctagaaaaaatttaaaataacctgagcaatgtagctcatacctgtaatcctggcactttgggatgccaagggagaatgattgcttgaggcctggattaacactccaagacctcatctctacaaaaaaacttttttaaagaaagaatttaaaatagaagtatttatttctttcaagttagcctaaaggccaaatcgagctcctggatatttgaggagttctgaaaccacgtttgccaagatcatgacggtgagaggaatctggcgtgactaactttatcttgcttctagtctcacaggctggctgcccttgctcattcctaggcacaggccaagctaaccatgggagacaggaaggatggtcatagtccctccctaaaactaaacccctctttgctcagggaccagagccgcttttgtaaaactaatgaaaggccataagattagggttatgggaggggcctgcaatttgttaaaatgtaggcgtagtttctataatcccttactgctcaggagtcatgtggccagaggtcacaagatttgtgacttcctcaattgctcctacagataacattactattgtagtacctaagattggtctttcgaaacgtttttcagacgttagcatgctggcaaccaactcacccccctggacctgtgacttatgactcagttggtcccatggcccccgcccagaggcatactcagcatagcaggaccgtttcctaccctcctatgattttatccacaaccaatcagcagcacacattccctagccccttgcccgccaaactgtccataaaaaccccagcttctgagttcttggtgagactggtttgagtaataactccagtctttccacttggctagctctgcattaattaaactctttctttactgcaatatcgtgggcttggcgaaatggttttgtgtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttcagttttgtctgtgcagcagacaggaagagccagttgggtgactacagttcccttcacacagaataaaagttcctaaacaataacacagctaatctcacctacaattcaggtaagtcaaaactatgagccctttcccttactgagtcccaagtaagggggattctggtccaaacaaacaaaaaacccacacaatacacacataaaggtcacaatttgtatttgctcaagaatcatataactcattataaaccgaaaccaaacgaaatgaaagactttattagtaaaaattatgaaaaatttgaaaatatgtcaaaaggttacctttatattcttttaaatattggaccacagtctaaacaggcccacccaaggatttttttttaatactgtagtattgtttggcttactacttattatctatcagcataaggactgctaagtaacatattaacttgcagatttttgtccaaaaggatgtaaatgatttttgtgtgatagaaagatagccccaaagacaacagttttattgccctgtaagacattaaccaactgacaattcctttttttttttttttttcttttttcttttctggagacaagagctcactctgtcacccaggctgaggctacagtgcagtggcatgatcacagcccactgcagtctcaacattctgggctcaaacgatccttccacctcagcctcccaagtagctgggactacaggcatgcaccatcatgcccagctattttttgtattttttgtagagatggagttttgacatgttgcccaggctggtcttcaactcctgggttcaagtgatcctcttgtctcagcctctcaaactgctagggttacaggccactgcacccagcccaatttactgatcttacaatcttattctagcattctatcagtgcctatatataatttatctgtggaattttctgggaatcagcatcaccattatgttgattccctcattcatcaggcaaataaatttatgacacgcacttactatgtatttacgagggtcattgttttacctctgaaaaatatattttgatatcttaaagttttggtatattttcttcttagatgcctacagaatataggaaaggtaagctgttactggtctatcaatggcaacaaaagaatgtaaattgattgcattattcattcttcagcaggctgattactgatactatagtcataccattgaattatttagtaacaaaaaatctagtaaataattacaaattatcagtgactaccatattctttagagcacattattttacccctaaagatgcgcattaacattttgtgattagagtacctagaagactacagaaaagagcagaaatgatcactaaatgctgcatgtacctcctgtgttttactcctaatgcagctttaaagctgtacatcctaaagaatattgcattttctcttttaacaacataaattttatctccagcaaagaaagtgttacactatctatagtaaattttaaacacttcaatatagaagtatttccagtgtgatttatgtgtatctgggttagtttccactcacaccctaatggtattagttaacatctgaagtaccctaatgaggaattaatccagaggtggatgtttatcatctgacacatggtgaccatctgccacaatgccagaggtagctactgatggggtccaagacatcctaccccaaaatatggtactttggcatattagatattttaagctgaaggatttgagaaaacagaccttccccctccccttctcccctgaaaaaggttataaaatctttcctacgttttatgaccttccccgaagcaggtcaaaggaccctaatgtgtgaggtgccctccctatacccagaagaaaggggcatccttatctccaaacatgcagtgacatagagacctgaacaaataggtcttactaagcatcctccagtttataacattcagctcatcccccgctttgtcctatcacatttctctaagactctccactcttcatcaaacctactatgaaacaagctcacgtttaactgcttcttcgggtcttcatttccttatgaagtctcccatgtcacataaaacttgaataaatttctaataaaataaattttattagagggggtcccagctacccaaaataagtagcaggaaagatacttttcctcccctttgctacaaaacattttcaaatatctttgtttctgatcaaccttaaaggatttgataatttgcattatagataaaaatatttttccttggtgaaacaaggggtgtttaagatatgtggatggctaaaaacagtagaaaaagaataattagtttatttccttttgcctttgcttgaacaatgtacaagaatctagcatgccgaatgactagaattaccataggttgcaatttgcctgttacagtcccagtttacatttcttatcccaacataattattaagaatgccctctttggttctcaaagcattctgctttggaccacaaattatatggacaccccaccacagcatacctttcttaaaggccccctaggcttaatactaggatggaccctgtatggatttttgtcagcgaactgctactaggttagctgaattccgaagctaacgcactgtttcacctgcttcaagtgaatctttctgtgataaatttatagaacaactggtgtgacagtttttgcgcctgcctaataaatgtttgtatctgtgcatgagtcagtctgagacttgcttttattacaacacactgcctgggactgtgcttgcaggtgagaagaccttcagttttcatttgctcctatctactagaggctacggatatattttctttttttttttttctacacttcacttattagatttattactaagtacttgatgctttttatttttatttttagatttcagtaaaatagtttaatcaagtcactaaacaagcaaatgacaacaacaacaaaaaagcctcagagagagagaagggaaatcaatatctagttgctaccatatgacacctaaaatgccaaattttctttttttttaatttttttaatttttatttttattttaagttctgggatacatgtgcgggacctgcaggtttgttatgtaggtaaatgtgtgccatggtggtttgctgtacctatcaatccatcacctaggtattaagcccaacacacattagcaatttttcctgatgctctccctcccctcgcccttccgacaggcccagtgtgtgttgttcccctccctgtgtccatgtgttttcaccgttcagctcccacttatgagtgagaacatgcggtgtttggttttctgtctctgcgttagtttgctgaggataatggcttccagctccatccatgtccatgcaaagggcatgatctcattcatttttatggctgcatagtattccatggtgtgtatgtgccaccaaagctcctctatctggcagttccttgcagatgaaagctccccccatgattcagaataagtagagcttttggccagaagagttttcaaattcttgcccttatagctacaaacccatgagcctatttctagatccttcctgttattcttattatagagggaataagcatctcttgctactttttatcactagaccaacatctttcttccctactagacataagttccatgaagccaagaccgttgacttccttaatcatctctagaaccctgggttctagcacatttggtactcatcagttagtcaatatctgctgaatgagtaaattttaaaaagtgtccttgatttctcctccagaccattagttgttcttttcctgttcaaatagtcggaaagcaaaggcaaggaaaaaaaatctcagaggctcacacaaaaaaagctacaaggaaaaacaagttcagttagttgttttccgtggtatctatgaaacttttttctaaacaaataatgtgttctgtccaaaacactttagcctaccaacatagcaactctacgtgcaataacggcatgactgcactgattctgtgtcttgattttaactttcaacaagtaaaacaaacacaatttgcaaagcagaattccaacactgctgtcattacggctttagataaagcaccactgacaaggccccctctagattctacatgaagacttacgcggactgaaacccgtcctcagtactccaactgttaaccaaaccgcctcccaactctaaccaactacatcatagcaagcaaatctttatatgtaaacatagaaaattattatttttatctagttgcacaatgactttctaactaagcttttattgaaaaaacatacatctcactaataaggaaaaaaaagagcaatcacttgtttagaataaatgagatgctcttcgtcctctgtgagcccctttgactcatgaattggtttaacttctgaaacctccagtgtagactgtccctatctacagcgagcgccatgcacttatgagcaggaaacacccatgtgacaaagctcagaactgtcacggaaaggtaacccaggtaaaagcgcatcaaaacaaggacacacacacactctctctctctttctctctctctctccctctctccttctttctctttctttctctctctctctattcaggagttctcaatttcccatttctcccggcttaaaagttaagagtaatcacgcctgtaatcccagcactttgggaggctgaggcgggcggatcatgaggtcaggagatcgagaccatcctggctaacacggtgaaaccccgtctctactaaaaatacaaaaaaattagccgggcgtggtgacaggcgcctgtagtcccagctactcgggaggctgaggcaggagaatggcgtgaacccaggaggcggagcttgcagtgagccgagatcatgccactgcactccagcctgggcgacagggcgagactccgtctcaaagaaaaaaaaaagttaagagtaatgagggaaattccatgaagtagtccaactaaaattttattttatcctagaggtaagtctgaggacattgattagtgcttatttttgttttcagtacaatatccccaaaagtttgaaaaattagctttgtcacaatacacttcctatattacatccccttctaataatttcagacagcttataatttgtataggaagatggcaaatgtttttatctttatgaaatttatgtgtacatacacacacatatatattttatatccagaaaagttttagctacatttttagtttcagaggctttgaattcattgattattgtgtaggtaattacttgaccttatatttatttgagatgatcttttattttttgagacagggtactgcactgtcactcaggctggagtgcagtggcgtaaacacggctcactgtggcctcctgggttcaagagatcctcctacctcaacctcccaagtacctgggaccacaggcatgcaccaccatgcccagctaatttttgtacttttttgtagagatggggtctcaccatgttgcccaggctggtctcaaactcctgggctcaagtaatcctcccgcctcagcctcccaaagcgctgggattacatgtgtgagccactaagcccagccactcgaccctacttttagaaaattcaatacataaagatgacatttccctggaacattctttctcctataaccaaaacattaggcatgagttacattttccatgtccatgagtagcacttcatgttattatatttcctaagaactattttaattataaattttagatgcagtgaattattttgggaaaggtgcatatccaacccatccctatttcgagccagaatagcttagattcctgaaatcacttcagttgctcctttaagaccgtgagaaaggaacatatgaatcttcacaaaccttcacagaagcttgttgaagattttggtttctaaaaatatttctatttcacttgatccagattttcatgttatatttcttttgcacaccatgaaaacaagttttcaactactcaaccaaaagtctcgggtagaaaactgcccctttatctcatgatggtatgaacaggagatgagtagacaaaacttttagacctttaccggctgttcctaccccaaatgccagccactcacatgttttctcgccctccaaattgctcagttttcatgatgctgcatttaaaacctatgtctgaaattggtagtttgctttttttttttttttctgggggaggggtgtttttacaagggagatttgggggaaatgtgggtatggagaaattttctttccattttccactggctggcactagaagaatccagtcagtttttctctgttctttttctccctctgtcctcttggtaccaaagcagtcaccatcacaaattccctttctttctattagtggatatggaattatctagcattattaagaataaggtgaaactgtctcagacccaggcttaaattgcaaaatgacaaaatatattaaaatactagagtacaaaagaaaagatacagaaaaattctacaaaggtatatatgaatggccaaactgtccaacatacataatccttgcataagcacccagtatgtcctaacagagaaagaaaccagttccagaaaaattaagtcaaaataatcacatataagagcttctctcttttagcccttcagtgacagctgaacgttggtcattaaatgggcatggaagaaacagagagaacaccatcttctgtttgaacaaaatcctgatctccaccaagaactgaaattgggtcttctccacttggaagactcctctctctatagagaaagagagagagctgtttttctttctctctctcttttttttttttttagatggagtctagctctatcacccaggatggaatgcagtggctggatctctgtctgctgcaacccccatctcccaggttcaagtggttctcctgcctcagcctcctgagtagctgggatcatgggcgtgccccaccacatctggctaatttttgtatttttagtagagatggggttttgctatgttggtcaggctggtctcgaactcctgacctcaggatacacccgccctccgcctcccaaagcgctgggattacaggcatgagctaccacacccggctctttctcttttcttttgcctcttaactccgcttctaaactcctcttgtgtgttcatgtcctaaattttgctgacgcgaaatgacgaagcccaggtacgtaccccagacaacgtagccacttcatactgggaacctcgtcggggaaaccaaggtacagcagtcaccgaaatggtgagcagaggaacggactccaactctgccctttcatttcaaggctctcggcctaaatgttagaaccatatcaaatcagtaacaggcatccgtcagccagttagaaacgcggttagcacggctgctgttcaaagactgggatgccaggcgtactggggaaaacatggagaatctcccagcacccatgggttgctgggcatgttggccacgtgtgaacaagcttcctttcatgaaggacttagccatcgcttgaagctggaagaggttctggagcaactgaggatttctggctggggctaccgcccagtattacccaaaccctcctggactgaccccagcctccaccgctggatgggttgtgggcaacaggattccaactttcctatgtagtttcctcctttcctgtctgcacccaccatacctcctgtcttttccactcggaagacccctctctatagagagagagctggttttctttattcttctgcctattaaacctcagcacaaaaaaaaaaaaaaaagaactgaagtcggttctggactcatccagggaaaatgtgctttaaatttggctgtggtgttctccagtggtcaaggagaatatgctattgatttgtgctctggcattaccactgcacactgacaggcagttcttttaaacacatacttgcgtggtttagacaatgtctgtgtatgactgaagcttcacttgaaatcctagtagttcttggaaatatgtgagctcaatgagctaaatatagtgccgacaggtatgagtgattagcatggtgctaactctgcatcaggaatatcaactttgtgtttccaatgctactttcaactttaaactcaaaggttttttatataaacgtttaataatacctatagcctttctattgggcatgaattcaaaacagacaagaaaataggtgtcttaaccacattatcactgctgatcaccaacaaaactgttaataatcatagacacagaaatctggatatgtcctctagtcatttaacacaatttttttttaaaaagtatatgtagcttttactaataaatattatataagattctgttatccattcaaatcttactttaagaaaaaagtcaatttagactaaaggccatgtatgtggtattatacttcacttttgataaaatctgattaattataaggcataatcttactttttcaggctgagggtcattttaagtgcttattttttccaaagaagtgaggaaaaaatgctgaaatgatttcaaaattcttacatgcacagtgcaaatttaaattgctgttcgaaattacccaagacccatcagaaaagaggaaaccacaggagaactagaaataaacctatttccattcttggaaaaccatcctgtacattaaaaaatgtcacgcttctcataaaaactggcaaataggccagtggaatagaacagagaatccaaaaacaaatctgcacatttacggtcaacccatttttgacaaaggcaccaagaacatacattggggtaaggacaccctcatcaataaacggtgctgagaaaactggatatccatatatagaagaatgcaagtagaccccacctctcaccacatacaaaaatccaatcaaaatggatcaaggacaaatgtacaacccaaagctatgaagctactagaagaaaacattggagaaatgcttcagggtattggcccggcaaagatgtcttttgagaagaccacaaaagcacaggtaacaaaaccaaaaatagacaaatgagattatatcaagctaaaaagcttttgcatagcaaacaaaacaatcaacagagtaaagagacagaatgggagaagatatttgcaaactctccatctgacaagtgattaataatgagactatataaggaactcaactcaatagcaaaaaaaccaccaaaagcaggaaaaaaaaaacaaaaaatgggcaaattaactgaataaactgaatagacatttttcagaagacaaatgcccaacacatatatgaaaaaattctcaacatcattaatcattatgaaatgcaaatcaaaaccataatgagatatcatctcaccccagttaaaatggccattttaaaaaagacgaaaaagaacagatgcttgcaaggatgtagagaagggggaactctcatatcctgttggtgagaatgtaaattagttgagctgttatgcaaaagaaaacattatgaatgttcagtgaaaaactaaaactagaactaccacgtgacccagcaatctcacaggtgggtatgtatccaaaagaaaggaactcagtgcctcaaagagatacctgcactctcatgtttatcacagcactattcacaacagtcaagatacgtaaccaacctgtgcccatcaacagataaatgcataaagaaaatataatgcatatatgtgtggtggaatattactcagccataaaaaagaataaagtcctgtcatttgcagcaacatggataagcctggaggacattatgttaagtgaaataatccaggcacagaaaggcaaatatgttatgttctcactcacatgtgggagctaaaacaatttgaggtagagagtagaggggtggttatcagcggctgcgaacagtagtgggggatgaagagagcttacttaatgggtacaaaaatataattattacgtacaattattatgtatcaataaaactaataaattgaaaatgatttaagttcctaaaacttgataacaaaacctcagagtaataatttttcagtttatttttttttaattccaatagaaattctattagcagaagataaaattttaaaatggtaacaaagggttctgtgcatatttggatacatttaatatataaaaacaatcccattcattggcagtccccttcttacccgccaaatacttttttagaaacagaaccacacagcccatacaaattcctggtttactagaagtcggtgtagcgtgtgtttcactatcctgcatatatcccctatgcggacaggggcagagctgtgtctaactaccaaaaacccacttggccataagggaggtggggccgaacatgtcctaggaacacagctgtattctcactacaaggactactccagccgctgtcatgggggcagctgcctgcgggagaccaccaagatgatgcagtgtttgtgatattcatgttatttctaatcaaaggaaaaaacactaccatgagggctggtgataatgttacactgaaactaacaaagacagggaaaggtacctcatgtgccaggtcctgtgccggggactttccatacactgcgtcctttaatccacacaccaactccgtgtgggaaacacagcagtctacccagcagtatactaccctaggagggctctgataggttaagtaactttcttaaacttagaagagaggactgaaccataagcccagtccttgcacttccgcctgctgtgaaagactacaggatttaagttttgtatcattatgacttagtgtatctggatacttggggctctctcagactgatcttccagagagcatgtcccccgcctcgccaccaacagtccataactttccagacttttaaagccctctgggttgtaacaaggtcaaagaattgccgttcaatgcccaggcagatacacaaaggtccagagccactgctttttctatagcaaaacgcacaggatcactcctggctgtccctcaggattttaaagtgacatatcacatgagccatacttcatttcttcacggctaatgtccctccagaaataccagaaatcagtatcataacaaacctaacacacatcacagttcccacttttcatatctaacctgcatctaaatctgctgagcgtatctcggagcctctctccagtttgcctccttgccattccctccctccatggcggactttcctcttctgtggccctgagtgtttacggcaagccccgcattggtatctctattagaccctctgcccctcccagtgacgtcttgatcctcttctgctcgggcaccatcttcttcaaacagccttctctggtcccctcagctgaactgcaggctcctcttctgggcttccaaagccccgtgcacatatcatcgcatcaatgatgcccagcactggaatgtgtttgtctgtctctccccacaccatgggcttgcgggtggctagcacaaatacaacttcatacttctttccttcacaggaagcaaaacaattcgaaacaggagttaagactgtccaggagaaaggggaaggagcccatggccatttcgtatctcttcatagctactcaatcattaatttaacaaataacttatcgaacttatactgtatgccagataatgtgctaggcactccaagggcagaagtgagtgcacacaggggcaaacaacacagcagaggagtcagcacgcaaatgtaatatgcaacgataaggtgcagacaagcttctttgggagcacagattaggaagacaaatcatgtctaaaggattcaaagaagactgcacaaaacctggacatctgagcttgggactgatgcatctgtgggagttaaccagtaaaagacacaaggaaagggcaggctgacatcaaaaacaccagtcaaatcaatcaagccataaccaggccttaaacccagctgctttctttcaaaggagaaaagcagcccgagcaacacagtgagactctgtctgtacaaaaactcaaaactaagcctagcatggcggcacgtgccacagtcccagctactcaggaagccaaggcaggagcatcgcctgagctcaggagcttgaggctgcagggatccgtgattatgtcattacaccccagcctaagcaacaggcaagaccctgtgtcaaaaaaatacaagaacagtaaataaaggagaaatggcctgaacatcaacttcaactcctatttttcatagagcagggccattactaaaactcccttgaaatatccatacaaagacaccttctatcaagccatgattatagtattttcttcaatatttattggaaattacataaaatatttcccccatgaacagcacacgtgcaattctgtgagaacagagtaaataaaaccgatatatatcaaacagtaccttttctgcagttgagaggtaagcaaaagcatcctctgtttaataaacaagaaaaaaatgttaaggaagaatgtagaataggttgccaccaaatatgcaaatgcattcacgcttaatacctattcttagctgaagtgtctagaggttgctttgtgtcttgcgcatcaatctcagagcaagcagaatagatgatctgaaatattaatcctaaacgggtcttgccagtgggcagctgtgggctcgcagaacctctgtgtagacagtctcattacctacttgttcaggcctctttgctggcaaaaagtatagctgaataaacagaaagacaagatctgcaatgcctcagcgctcagaaaattatgacgatgggaagaatgaagctctgaggtcaaaatcttttaaacagcaataatctttgcactacatcagacacctggcaatctcagtccattgtacttatgggaatgctttttagatgttctgattaatacgggtacttgggagcctaaacacaaagacctaactagaatacattgcaattctgagcctcaggcaatgtatatgaaaaagataccagaactaacttttgttgaataaaaggattcacggttcttgcaaatggttatgattgtaacaaatgtttatcattgtaacaaatggttatcattgtaactctaattccagttacgtgacaacaagtacagtttatgggaaaagacatgtgcaacaaccaccaaatgatctgtccatcttaccaaagacaatgaaatgatgagtccctgctagtttctagatattatttatccaagttgttgatttgtaggtgctcattccattttctcctacataatccagtaatctataatccagtaagaaactcacaacatagacatgcaatttacagtttctgcatagggtcattaaaaattctttcattacaaagtatttcttggattcttaaatatttggaaaatgcacaaaacacgtgaaaaatatagttgttcagacaaagaaacgtcattctgatctcatgttttctccccaggaacagacttcacagcaatccattccctttacatttattgtttccttaacttgcaccaagcctgaggaggtcagtgcttggcacacattaagaaaacaataaatagggagggggttacaaactatgctgattccctgttctatgcctcactctgggtgaattcaaccgtctgaagggatagcaaagtcagaagtatgtggcaagcagcaggatgccgagatggttccagctcagacaaggttccaggagagagagcctacccatctttcccaggccaaaatgttttccatgtaataaaggtcaccagtggttgccaatatgcgtatacgaactatattggcttggtcagagttagctggaaaagcaaaagctctgtagtactccagagttctcagatagacctgtccaaaacctctcattcctttgttccaacctttaatttccaacccccacaatcccaccccagtttccaaccagtactttcaccgagagggctgtaccactgcctgagaagtcacacaataccttctgcttcgtgaccaactcagacttggatatctacctgctacctatcatatcaatatgatgtagaggagtgtccggggccctagacctaaatcactttgtgtggcacctgcatcagccttccttagtgacaatcttaaatctagttggttttctttgagaatttatttccttcccaagtatatttctgtgattaaaattatgtggtgtcagaagtttagtttcaattatattttacagacacccgtctacattaaatttaccttcttgcttttccaccatccttagttttgtcgtagtgtttttgttgcaaccctgttcttccttcctgtgtctaattatttaaaaattaccactaaactgatttttatattttatttccatcaagataaacaagatacaaatagatgccctcaaaaaagttaatgatcaattgggtaaaactatatctatacccgcacccaaaaagacaacataattcaatgcacacatgcaaatcaagaacaagaaagatgatggaattagctccaaaactactaaccttcacattaatctgcctcttgcatgtcaatagtttatttcaaatattcggtccctgtcaatctaagaaagtcctaaatccaaagccctgcgggaatgacatgagtttcctggtgtccagcacacgttcgaaatcctgctgtgtgaagagggttcagagaggccaaaaggcaccattcatggactttaggagaaaatattttgtattttgtgcatttagaaaaaggctacaatttgaatgtttaaatatttaaagccaataaacaaggagctattatttaatttttaaaaaatcttttttcaaatttccctggaatattttatttcatttacaaaataaatgtatgaagatgacaaaatcttagaacttttttgaggctgagtgacacactttatctatactgttctaaattttacattaacaaaattatgttcatcacttagaatgtgacattgtatttagaaagtcagcttcccttgtcctattaaaatggtatttagattgtaagtattttattatactcaacttttcaaaaacataattattatataaagaaagatatgtgtagttatatgtacatgtatatacactcacacacacacatttgtaatcctttcaggcttacacataaacacatgttaaaatattgaaaagcagctccaaaaataactaaaatgtcatttgccaaactacttctaggctatctctgggaatagtagaatttttggtcataaaaggaacaaaacatttcctattttgcttttctcccacccttttccagccaacctcttctaaccagtctccatctttaaataatgctagagacctacaatagttttcaactatcagatttaatctctttggttgtatcagactgataagttgaaaataaatggtaatagccagtttgtgtcgggcctatcgggcaagttgtttcttcagaataatattcaatttgatacgtattttgaaacaaacatttactttgtttcatggccggctgtgaataaacagttctctaagttattagtgaagggacagcaaaatttgaccattctatctacccatctgcttctctgtggcaacaaactgatttccatgggacgcttgaataaagcaaggctgtctgtccaaaagaagtagaactatgtcctcaataggcaatggaacaatgactgacactgagtcctagcactgtcaccaatatcccgaacaatcaagcttcaaacccaaaaaggtgcaaataaaatttaagactagtttgggtttggtcccaatggggctaagaaaaactagtgattgttgaacactggattcactgacaactggagagaaaaaattaaaattccaacattatgatgtcaataataatttcatctgcagcaacattcaggaagctgatgagatgatcctaacgggtgatttaaagtgaaagggaaaaaaaacacccttggcataatttaataagatcttcagactgaagcatattcaagggtttcatgaaagaccttctcatggccttttaatagctctttccaattccaattaactggttaaatgccaattctcattacctcatcagaaatccaaagccagtcttttctgattaaatcattaaataactgttaacagtacaatgactagtaagtatttatggacagcccagcactgatatgcagctttcagttctccgtgccaaaggaaaaactggagtgggcgatttaaaatcataataaattctattcatcttcggaatgtgctaggatatatttatctaatatattcactcttcttaattgttttactggcactaatacatagattgggaagacaggcatgatggctcatgctggtagtcccagctactttggaggctgaggtaagaggatcccttgagcccaggagttcaaggccgtggtgagctatggttgcgccattgcactctagcctggtgacagagcaagacttcaacgcattaaaacaaaaaaaagtttattttagattagtataagcttttcatactctctaaatagactgcagaaatgatgattaaaagggagttcatttttgtggaaaagccaggtaggtagtgaagaaatgggaaaacatgtcaactgtgacctgccgctgcctggcagcatgacgagtcagatggccccactcaggagtcactccaaggcctgtggacgtctccactgggcaattaccacaccaacaggcaatgcctatgtcaactcataccaaagctcactttttccacagatctgcctgcaacccttgctttccctcctccctgactgcttgctgacgctcaggactggacaaacatggctcaagagaccagggttctggttccaagtccaagcttgtcaccatcctcccaagacagaagatattcaccctcagagttggaaaaggtcggctctgccacgtcctctttccttttgcacttttattttttatattcctgagcatcctgggacagagctcctctgagaaaatgaatgcgactctccagaggacgatccacagcaaacccaaagcctcctttgcttacaagttatagaaagatcccacgaacactctattctctatgcaacttcttgtccatgcagtcttaccatgaggaggatattatcatggagaaaaacaggctttgacttaaaaaacaaaataaaataaagcataatcaactaaaactaccatttaacttatgctgtaggtcactgcagcaaagaaatgatcaagtttcagtatcttccagaaactagataaatcgtcatagcttgtttaaatgaatacatcactagtaatatgtatttttaggggttttttgtttttttttttttttttttttttttttttacagagtaagacgcttataatatgtgaagttctgtccacagttacctgagatgttagggttagttgagcttaaaatagatacttccaattagaagcagccaaatataattttttatgtgagaaaataactgcaatgctagtatgaccctttattttcctagggctaaagtcagaaaacagaaacaaatataaaagtatcacattcatgtcaatggcttagtgaagacaggaccttattatcctttaaatgctgcttaaaatgctcccagactcgcccgtttatctgctcctcttccagcagagtgtctggcacaaaatggctgttccttcaatctctgccaatccccatccacatctttcaactggcaggaatttccctaattaaatgctacctgcagtatttttatcacactctcaatcatcactgtacttaaaagcttagctcataactgtcttttaatactttaaaaaatatggcttatgtaaattttataaaaatcatttaattgtacattgaaaatggtattttatggcatgtaaattatgttcatatgcggttaggttcttgttctcaagttatttcattttgcttctttttctttaaaatttattcaacacaacagttcaaggaatgaaaagattccctctttttctttaacatcttttcactcttcccggtaggcaagcgtaagataaacattaagtgacacataaattgcctctttctgtcttttgagctcaatgccctgaaagcagcccaatctcctaccttttatgtttgttggtaaatttaaactgaagaattaaacaggatgcaggtgtttgaaattctctttgttcggcctacgtaaatacctccattatccattttaacaatctattcctaaatgctgatgattcccaaagttctatccggctttaatttctccacagacctttgcatctgagtacataactgcctgctaaagatctccaggcacctcatatggtttctggagctgaactcatcatccttcttcccagcacgcacaggctcttagcaatgcttccactatgtacgtagctcaagcttgaacctgtgtcacctcgaactccttgcctctctcctactttctgacttgaatccacctcgatgtcctaccaattttactttctatttattaactctttagtctgtccccaatattgctgctctagttcagattccaaatatttctcacctgaaccactgcaccgtctctcaggtgtctcccttcttctctacatctcagatccccttctccataatggccagcacaatcccactgaaactccatttggttgcttacttctccattaaagggtaaaccctttaatcgctgttcctctctttctcactcaaccacaaattctcacatgccatatagaacccagcctctgagaatctggccccagccatctcttcctctaaaccctacagtcccttcttggaatgtctctcttgttttcaccggctagcacgttctcatctcctaacagtattctaggccaggcatggtggctcacacctgtaatcccagtgctttgggaggctgaggcaggaggattgcttgaggccatgagttggagactggcctggccaacaaagtgagaccttggctctcaaaaaaaaaaaaaataataataataataatcctacctactccggaggctgaggtggtattaaacccaagtgtttaaagcagcagtgagctatgatcatacaagtgcaccccagcctgggtaacagaaggggaccctgtctctatcaaaacaaaaaacaaaaactattctccttcactgacattcatggccccacattctcagcaagatttgctaattttgctacggctcctgtgagcctatccactccaaccacactgctgtatttaagtgcctgtcctccactttaaaacgtgagctacctgagggcaggatttatgtcttgtatttctatccacaactcataatacaatgattcttacaaggtaagctgtcaataaatattgaagaatgaacaaatgaatatagggagttcaaacatgagaactaaaggtctatatcagaaaactgtcagtcaagattctagctgttataatacagaaggccccatcacattccccaagacaaatttatattttcccactgtccttaattttatttcttatactctcattcctgaaataatgttgattattttgagaacagaatattaaggctatcgagagtgatgcttctctctcctcttggatgcaaaaattatctgtatcttcatccacaggaaaacatgtccctccctgtgattcagtttgtccatgtaaaaagaaaaaaaaaaaagctcgtgctcctcacctggccccccatctcttcccaaaccccactcattcactttcacctctgagacagccctcagatttattccctcctctaaattcccagagccactgctatagttgaggtcgttatcatctcttatttagactgttttgacaacctcttaactaatctctccccttctagtctctccctttcataacccactctttatgcgcctgggctctaaccaaaactgatcatgccttaaaatcttctcatgtgaataagaaaaagctcaaaattattagtgtgaaaatcaaagccttatactgtcttgcttcattctacctttctaacctcacctccctgggtgcattctagaacccacccatctgctgatcacttctcagcaggtgctgtgtgccatctctcctcatttgtgctcatgcttttttcctttgactttatccctctgtcaccctgaaaactccctactcatccttgaagaaaaccttgttcagatgggccattcttctataaaacctttcaacctgcccaattacaaatcatgactcttttcagggtttctgtagcatttatcttatacgcctggtatggaacacaaactattagttctagctccactctaaaatgggagctcctttgaaagaaaagtctatgaattacacatctttgaatattcactggctgagataaggcaagaacaagtcttaccactgaattttcaggagcacctaacaaagctccaagatggagataaatttgtggaataaaagaatcacccacttgtaagagcgaatatgcagaactgggtaaatgagttaacataaaatactttgaaaacataaatatgtccaaaatgatttaaacatttactgtgaaacatccctggtatacaaagactagaacggtgctactcagagcatgctgttcaccagagactgttgtggatccactgtgaaataagaaacaaaataaaaagaataagtatttagaaatttctacagcaatgtgacacggctgatccatcaaaatgcaggctgagtgggctcgtctcctgggagaaggtactggctggttcgggtcttgtcgaacttgtgtataaaagtgacacatggggcaagagctgcaggctggtcatgttgcaataggacgatattcgtctgggacagactggaaatggggggaaaaataacacaagcctttcgcgagacagtttaaaaagcaaagggagtaaaataagaaactccagtgtaccagaaccaatttcctcatgtttaccttccatattcgcttgagacctttcctccccatgataaaaaaaaaattatagatacagttgaaaccacctctatgtccttccccaacccttgcgttccccctcctgctcctatatcattttttaaataggctactgtcaaaggaaaagcagagctggagagcagagcaatgaaaatattttttatcaggactacagcaacagggggaaagagatctcagtcaagaccccaggctgaatccaaacacagcatcggcaagtgggaatttatagccaaagaggagggtggcagtcggtgaatgaaaaattattaagaggcaaaatcacaggtaagaggacattctggccacaccatcctaacaggattcttgccaaagacaggccaagatgatgacacatcacccgatgggggatgaggaagccgatcagacactgagactgatcagatatgaaggactggggttctggctaaattgacttagcagggtccttgctaaaatgcacagatgggccctggtggggacagagttcaggaacctgactaaagtttagaaaagcaaagaatctttgtcagcaccaaatcccgtttaggaggatgaaattttcctgttgaggattagggtcatgttttatttcaccaaaaaaaaagcactaaaaatgaacaatgatcaatgttattgtacagactctagcctgctaaatattatgtgaaaaggtgctgtgcccccttgtctgtgacccttcagccacaactcatacaactcaactcctgaactccaagtgaaaggccctgtgctgccccaacctgcagagggagaaacaccttactgaaatgtctacaatttggaaagaaagactaaagagcatgttgtatggctgtagaaagaataacacagacaacggatttattgctaataaaacagactaagaacaatgggctgatgagacttaactaaaaagatgtttattccaatgttagaggttacctcagagaagacacacagagaaaagaaatgcccgaaatgccaggtggaaagtaatgggctttccacggttaatcaaatgggcactgccatgccaacgtgcctcctgaaattcaaaccctctatttttgcatggctgccaactcatttccaaaacatccactgctaatcaaacttgtttggctgcctccttatcgaaactttacaaaactttaatttcagcctcatgagccctgcagctgtaaattaattgaatgaaattgacaaacattatgcagtgagataaagcactttcaaagtcttttccctattcagttgacttagctgcccagcatgccagttttgcttgacatgagttcagaatccctggaaaccttcctaatcctactctctaggccttgtgcctattcatggaaccatgttaacccatatccggaaaattaataaacctcggatgggtttaagcactcaaaatactcctgatacttcttgccattcattacattgtagacatcctttgcaacaggagaatcctcctcaaaagaccacgacggcagcagataaaatccctgaggttataagcatacaacaaaatgtctcatttaagattactgcagtctgaagccaggaattaaatttgctgaaggtgcagtcacttatgccttagttaaataaagatagtcccaaaactgatttctgaacttacccatttctcaaagggagtgcaaaattatcatgatttttaaacagcaaggcgagtaaactgatcgcctctgtatctgccaactgaacaaatgagtcagctaatcagtggttacatacatcacactgacagagaggagagaagaccattaactttctgaaatgagaagtcctaatataccgaggtgccacaagtcacttaggatttccgtggttatgaaagaagaattgaaacgtctcttccctctggtgggttttcacagcacaactgccacagcttccaactgaggtctagtctctgaccttccctcttcatcaatgttatcagcatctggaagccctctggcctatgtggagccatggggacaatggaggcagtttcaaagcttctgtcttatgacagaaaacctgggtgtaaaacaacctctgatatgaactactaagggacttgtatagattccttaaactctccgaaacactgttctcaacagcaaagtgaggagaaaaacagctctcaagtagggttggtgtgaacgtgaaaaaagagaaagtaatacaagagttgggcatataataggctcttaaaaagaattttgaaggccgggcacggtggctcacgcctgtaatcccagcactttgggaggctgaggcgggcggatcacaaggtcaggagatcgagaccacggtgaaaccccgtctctactaaaaatacaaaaaattagccaggcgtggtggcaggcgcctgtagtcccagctactcgggaggttgaggcaggagaatggtgtgaacctgggaggcggagcttgcagtgagccgagattgcgccactgcactccagcctgggtgacagagcaagattccatcgcaaaaaaagaaaaaaaaaaagaattttgaaatggaaatgtatctatttttcctttctttagaaaacaaacagaaaatgaagccaacatatctcatcacagattgctctttaaatatgcgaccttataccaaaagcagacaagttcacaaagagattatttttataatttaatcacagaaaagactagactatcaggtagttggtggctacagaagtgactgctccccactgaagcaaggaatggatagaataagtccttgaaataaatgctcaggtcttcccttagtaattctggacagtggggaaattagctcattcaaacaaagtttattaaataaataaaatcccagcacttgtctctttagacaaaaaccacatggaaacaatacaaaagattgctaatgctttggcaaatgaatcactcttccaaatgccatttacaaaagcccaccagacctccagctgtgctgatgccatgggaacccctagggcaattataagtggatttaactcaagaccagaaacacaggagtaatttttaaagacccaaaaacttccaaataaataaatctggaaaggaattactgtttacaccacagagccacaggttcaaatagccaaacttaaagaagaaaaaacacacatgtatatatctacttcatcatgtaatctctgaacaataggaactttactgagttgtcactaaggaaagagcaaaatctaagataggtagtttctggaaaatgaaagtccagagaaacttggccataaaatgaaaattataacggacttacagagctcgtcttctttgggttaagaaacaaaggtcttcttgtgcaaaggaagaattcgaaagaggaattcttaagtagatggctgatgcatccacgtctaaacatccaaaatctaccaagcacctattacataactaagccctgtgtcagaggctgtggaacaagaaccactaaaacttatctctgacctcaagaagtttatagttcagggaagtgactgacaatcataatacagaggcataagggctatccaaatagggtcacaggttacgctatgaatacaggtatcacatcagaaaattaccgtacttaaaatctcagcaaagagatcacaccctcacacaattaatgttatcaacatccatccagtctctcaagctcaccctcttcaacaatctttgctttactgagttccgggtggactatttaaatatcatacaaattgattctgacatcacaatcactgcctgcttcctaaaacttgccctccaccgtctattataaatgctttccaatcagtgctcccattcttcattctattcaccacttagttactagaatgtttttctcaactatgaatctgacttcactccctttcttgaaaacctcctgtagttcctgttgtgtacgggataaaggtcagacaacttagtatagcccagctcagtccagctagcaaagcaaatactagctttattccctgcaagcaacgtaagacaaagacaaccacactaaactcagtattagcagaccaccatcctccctgaggcctccactgctttgcacacactcttctctttctcagaaggtcctttcccctcctcctgttggtgcagccaattctttctcttccttctaatgcaccatcttctgtgtagtcttctttgacactaggtagggttacatctttgctctgtgtttctataacactcttcatatgccatggaactgcattcattatattggtataattttatttgtcttttttcttcctagactgtgagcccctggagttcagggaccatttcttaatcatattccagaacctatcacaatgaatgacacgaagaatatatttgataaaaatctgatgaatgaaccactctaaaatgcaactctaataaagaaaattactgcctattcagttggaactgtaccatgttacaaacgtaaaattatgtatagtctgataaagaaatactataatagccttggaaacagctcacatacaattttttttataaatggattcattaccatataactggaccagcttactgaagagtagccctacagcagtcacttcgcagtttgcaattcatttgaggttcaaagctagctcaagggaaaacaacgttagtattaacaaacttatttttaagcttaaggtcagaatttaagggaaaataaataaatatagtatgttctaagaatccaaaggaatttttaaaaattgccccctgcagctgtaatttctgcatggatgagaaaaccttaattgcttgctggcttccaagaaagccattaacctgcatttaaaaattcagctttcatcaagaacaacctcacatatccagctctcatggaaaaaggaatagaagcctctgacctagttttcaattattaccaaactactgataattgatctcctggtctccaggtttgtttgttttactaaaataaattccctctggagctgcaggtgcttaccatggggctgcgcaggtggaaagcagcccagtcttactatgaggatgtccgtttgccatctgggaacaaggaggaagaagcagagacctgggcaagacctcagagtaagtgtcctttttggcggctcccaggggtccccatcatgtgttataggaaggcagaattatttgagataaggataggagctgaaataagcagtgctaatactggttaaaagttggtgcttcagctgcagtcacaacagataatgtctcttcagttatatttccaagctatttctcatttggcaatgtacacttacaccaaaactgtgaaactctcggaagtggcagaccttggcaacaagtgaatggaaactgtgaattacagtacatgccactgagtaaggggtgcacatctagaaaccagaaatcaggttctgtcttggctcagcgtctaactagatgtgtggacttagacaagtcatttaaccattggggattcagtctcttcatctgtaaagagttcatttagatgatctcttaagtccctaagatccccattgttaggtccagggtcaggttccagcccatgctgaggccggaagggagtgggtagatgaatggcagacagctgaaagaacactcagggggctacgggtaggtgaaatacaattttattcagcagctctcttacactgtgtgtctcggctgcttgttccagccactcccaagcacagatctctgctggctctctctccctttggggtcaacagcttaactctttccctctgagcgcaagcaagctgagctgtgtcctggctccccgctgcaagacagacagatctggtgctctctctctttctttgggtgcaagcacgcctgcacagtgtcaccagggcaattataccttttaaagacaacagtggcaaagagccaagtgatggccctcccatgttatggctacatagctgtttatattacacatggagttgcgcgcctgcgctacagacttgctgagtcacccgggatgtttacctcagcccatcctgcctggctgcagtgcagccatgttccttacacctaccaatttaaaagtactgtaattccattttaagggttctaaaccatgaaccatgttcatggtttaggattttagatatttctcatttaaacttaggagcgaactctgcattaggacatttctcctttcattgtccataagataactcaccaaatccttgcgcaaagagaaacaaatataaactacataagaaatgacaggtgagccttaccaaggaccctgacccatgcataacatcttagtatagcatatatatatatagtatatgatagaaacatgccgtgggctttcataccctctacaatagttcattataagtttcatcccccaaagaaggcaacttacatacttaagtttttctaaatagaatccaggtgctttcaccagtgatgctctccaagggatcccatcatagtaatcagtctagccagtgccaacttcagttctactaaatttaatgccctcttattttgactcaggaataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaaggtgtgtatctttcctctttataagccctctggcctcaggaagactggtttcattcatgtggtcatgtttttgcacagcttaagactaaactgtatgatccttccttctgggctcctacaagggcatgccaaagtcccctcaaataaccaaaacggtgcacatcccctttgcgtcccacagcagtctgctagtttatgtaataccataatgacagctatctggagtggaacagtgacactgctttttcccagactacttcaccatgtgaggtaaacggtagaggcagcaataggtctgctcagtctatggctaatacaagaccttgcttatgatagacttcaagagcttcttattagccagctgttaattcatacaaactgcacagaaattcattctggagcaatattatttgtttcacattatacttaaccttgaaaaggttagtttttcaatgggggatgattatcctggatagatgcataccccctacaaacatgaaactggcaagttcactaaagatttctcaagagccaccaagctagcaaaagtcgcaaccaaataatattatatactctgcccttcagagcaaccttcttcatgctgaagtcttcagttcacagaatgactgacttattttcaaaagaggaaggctgtattgcatattgtaactctctccaaatctatacttatgagctaattcttcaaaaggtaagatcaattaccacacagaaggagaagccatccattttcttgaagctgtcaaaatttgagctgtctcccataggatttccactgacagttaatgaaaaaaatcagtatctgtcaattttggaagaaatttaaaagtggtaagatattcttataaatcgatgttaaaattttggtataattattgtatatttggattactttatttgctttcctccaaatcatttctttactaaatttccctaagttagcttaataatgaggttttcttaaggagaaatctgttggttatacacataaattgctaacaaaaaagggatcagagctaaatggatccaatttttcctccttcatatgctacaatacaaggctactgcagaatttacaccgtgaataatgtgtattttgaaaacccaagcttagaatagtagtattttgtttcactatcaaaagacaaagcaaaaaaataaaaaataggctacactaatgtacttttaaaaatatacttggaaaagaaacgaaactatttcatttaatgctgtcttatagaacagaaatgccaatatatttacacagaaataattcagcatcttgaagtataagtaaaaacactaatgaagaccaaatttttagagttatttcatacaaatagaataaatttaggcggggcacagtggctcacgcctgtaatcccagcactttgggaggctgtggcaggcggatcatgaggccaggagttcgagaccagcctggccaacatggtgaaaccccaactctactaaaaatacaaaaaagttagccaggtgtggtggtatgagcctgtaatctcagatactcaggaggctgaggcaggagaatcgcttgaacccaggaggcggagcttgcagtgagccgagatcacgccactgccctccagcctgggcaacagagtaagactctgtctcaaaaaataaataaataaataaataaataaataaataaataaataaataaaatttaataaaaagagactacccattgtttccactagaattgctgccaagggaaatataccttttaaggatcaaggcttagaattgcttttcgcttattagaataaaatctatcagcaatctgaagaaatacataaacaatcagcaaattctagttagatggctacaaactaggtaaattactaaaatgtgccacatgaagataaagttagtcttggtaagaacaaaggtttcaaataatttttgctcttagatgtttgctgacagataaaatagagaacttcattttcaccaagtaacgcaaagtataaaaaggcatcggtatagtgctgtgctgcttttgttaaaatggtacaaggaggaaaagagagtatcttctaaagtccttgaatgggaaagccgtagtttatcacgtcgtattatcactttctatttacacagcatttgtttctcccacagacagggaggttcctgtggacagaaacatctgcttcctgcttatcctgtatctcagcatctgaatggtcatgactggaacacaggcagacttcagaaataaatacataaatatctcatactcctcgaatcttttagaaaaagagtgtgggtaacaataaacatatctgctgagaaatgaccacctcactctactcttctgcagacttcccattctgtgccgagtcaccctcagtaggcctaagtgtgacgatcctctcagcactccctgtaaacctatttaggaatccgcgaaagaaagagaagaccaccaggcagactggtgatgatatttcttggggaggctgtgcagtttttcatagtgaagcctacaacttagattttcagcactaatagaaccccattatcaggaggagagaaaagcactaatttcagatgggctctgacaggggacagttttaagaatttatagagagacatttccgtgtccagccaggatgtaatcatggaaattggatttaccttcccatccatgtgtaacaccaacatccagtggtttttcatgatactgaacaaaggcagcaatcactgagagactgggaaataaacaaaaggactgccccaatttattaagaaagcttccagaccacaatgaaggtaggtggtgtggagtcctgacaaggtaagttagcaccaacaaggaagaggccagcccccgatgggggagaacaattgttctgagagacagctaatcacaaacaacctgcttgtacaacatcctgttcccaaataccttgctctgcatataccccagcagcacaatcctctctgcacataacccctccagcatggccctagaaaacttcctttcagcccctgcctcttggcagacagcctcttctctgctgtgccggccattgcttcccgctaataaacttgttctcgtttttgttgttgttgtttcgagatgaagtttcactctgtcgccaggctggagtgctgtggtgtgatctcggctcactgcaacctctgcctaccaggttcaagcaaatcttgtgcctccgtttcccgaggagcttgggattacaggcgcccgccaccacgcccggctcatttttgtatttttagtagagacggggtttcaccatgttggccaggctggtctcgatctcttgacctcgtgatctgcccacctcggcctcccaaagtactaggattacaggcgtgagcctccgcacccggcctaaacttggttttaactcgcacctgtttcagtaaattatttacttcccgtgaagccagccttagccagtcacgctcacaacaagtagaagccaggcggagcctgaaggaggccctgagttaaggtgacaaagttgagagtatagggagaccaaaaaaggctagagtttacaggacagaataccagagaggaaagaagtgtacagggagagaaatcaacaaatctgcagaaggtcagccttaaatattccacggagtactaatcagcccatgcacatgaacatactgcctgaagctgggacaggaccagctgaaagagttagaggtaacagtagcaggtgctcaaataagaccacgaatactgcctgctcccatcaaccagagtagaaaacctcaaggttcaaggggtattgaatagaagacccaaagagccttgcctcagtgacttgccctacactaaatactgctctggtcccacctaagaaagattaaaagcaagaccccttcccctacacacactaaataaaactgtttccaaataacttcactgtgttacagggggaaaaaaagctcaagaataatttgagggatacaaaaatagctagtacccaaaaagataaaataacaacatctggcattcagtcaaaagtcgcagcttcaagaggacaaatacacgtgcagggaaaaagcagcatggtttcactggacggcagtgcattttcactggacagttgtccccagtgtcatagatgaggtcactgatgacagaaaagaaaaacatttcttgaagaaatcagacatattacttttatacaactagtgctcatcaaataacaactaccatacagagagagaatgagatgactagcactggaaagagataatagatgagccactgagtactttcaataagaattaattgtaatcatggctgggcgtagtggctcacacctgtaatcccagcacttccggaggccaaggcgggcagatcacctgaggtcaggagttcgagatcagcctggccaacatggtgaaaccccatctctactaaaaatacaaaaattagctgggcgtggtggcacatgcctgtaatcccaagctacttgggaggctgaggtacaagaattgcttgaacctgggaggcagaggttgcagtgagccgagatcataccactgcgctccagcctgggcgacaagggcgaaactctgtctaaaaaagaaaaaaagaaaaaaagaattaactgtaatcctatacctcaagcaccctgagatggacacacacacacacacacacacacacacacacacacacacacacacattctgctaaatactgtaccatgctataaatcctaaccagtagagtacagctaacacttcacttctcactttgtaaatcacattgaggaggtttctttcacagcttatcttatgaaatggggctgaaacaagtcaacagattaaatttatcaaaatataaaacacacataatggatttggaacagaactgcagctgtatcttcactggctctcctgcagaggaagataccatataactcaatgactccttcttttaacttgtaagtcagtgaaaagaggcactagtttcctgttaaccactaaaccttgtccattatcttaaacatagaatacatcaaaacacctgataggttttcagtgagaagccctcagctatgctatcttactgtcctgaatcacaggaaaagaaatatagaatattaatgagaaatagaacagctttcatacatagcacatataactagttagccaggcccatcaacatgacttggccatcatttacagaaaaatagtattgctttaattaattaccacattttcaaaggttaagggcatgaaaccaatcagtcagcttaaaccttgttcctttcaacaaacgggaaaattttcacaggcaatactttaaaaataaaacaaaaaaattagactgctaactgactccaaaaccaaaattcagtcaaaaggcattaactcccctgaattttaacaagaaatgaaatggttttccttaaaaactcttactccagtggataaattataaatattagaatgaactgcaaaaacccactagagcatctgcttttctataaacacatagaatgtctactggaaaacaagccccactgaaagctgtactgaattacaaataatccactctacacttgcttgtcagatcttagaacaaaacacacaaatatatccacttcgcagtatctgtataaatggacaagtagaaatccgaatcatgttatctgaaaatgttttgcaatcatttttagaatttaataaataaaagataggactttccactttcatttccttgtagtgtatttacattgcacagcaccttccgttagaaggaaccaacacagatgtgggctttctagttggtttctctgctgcccccttctgcttcaacaaaacacagtaggcaggcaacccagatgccaaaaatacctctcgaagccaggtttcgcagaataaacaaatccaggatgactgattatctcattttttaaaagcattttcatattacaattgaaattatttcacgtgctttctgaaatctgatccaggtgtctggttatacaaactcagtaatgacaaggtaaggtttccctcccactcctgaccccagtgctcgctcttgcgcactctctctctctcccttcaacttagaaacccactatgtcatgcaggcagccagaaacttcaagaaccttttttatttcaagttccagggtacatgtgcaggatgtgcaggtttgttacgtaggtaaacgtgtgccatggtggtttgctgtgcctatcaacccaagaatcttttatagtaaaaacataactactttaaaaacttggttctttcatttccgaaaaacagtagaataacattatttctttgcattggtcaaattacatattctttctgtgacagaatttctttctgctaggaacttaagagataatagttacaatatcacgatcatcacacatagtacaaacagtataggtcctaggaggcaaagaccaataactgtgtaatgctgataatgaacttttaaaggtaagggactacacaaacaatagtgattccgaaaatgctcagaatatatactgagcaaaattctctgcaacgaggtatataaacctgaagtgctaaaaaatttcacaaataattattttaaatacacactaaaggataaatttaaggtaaaaacagtagctgacttttagtttatttttccagaactcaaatgtcaggccaaaaaagtcaaagcagaaaacatcataaatgatacctttaaggttattcaaagagtgggaaatatttttaaagcaggtgagatttttccaagcagaaagtgcaccaaatactgaaatcacggaagacagaactcaactccattcctcacctcaaatgcaccgaagacccttagagacaccctagaagcctccattaaatcccatcaggaagttgcatgtgcaggtattatgtgcaatatggtgcacctgcaccccaatgatccaaatgcctcaagctagaaccatcactgacgcttactcaagaatgtcagcgatgggaaacattaaacgcacaaactgtggcgtgttcgtttctgctggtttcataccctttccaacaaatcctccatcctctgccagggaaatctttgtaaatcaacatctgatgagacacctccaggtgatgaaaaatgccagctagtctgaaatacccattctcccttcttccttgagactcccaatttttttttaaaatgtgtgctaaagagaagtgttgtatgaaacttcaccagaacttaaacttaaaaggtatgaggcacgtgctttttttttttttttggctcttctgcctttctttctcaatgcaggggtaatggctggagctccagcagccaccttgaaccgtgcaggaccttaaggatgaaagtcaggtgcagcacaaccaaaagaaagattgacatctgaggaccttctaaagatgcttctctagacttggaatacttccctctagacgtcatttatttttatttttaattttattatttttttagagacaaggtctcactctgttgcccaggctagagagcagtagcacaatcatagctcactgcagcctcaaaatccagggctaaagccatcctctcgcctcagctttccaagtagctaagactacaaacgcatgccaacatgcttggctaaattttttttttatttttggaagttggtctcaaactcctggcctcaagctatccttccaccttggcctcctaaagtgctgggattacaggcatgagccatcacacccagccaagacttctcctatttgagagtataaactgttgtatctttctgccactgtagttgggtctctgtcttgcagctaagtccaagctgtaactaaaacactcactctttttgttctttctttttttttttttttttgagatggaatctcactttactgaccaggctggagtgtaggggcatgatctctgctcactgcaacctccacctccagggttcaagtgattctcctgcctcagcctcctgagtagctgagactacaggcatatgccaccatgcctggctaatttttatattgttagtagagacgggatttcaccatgttggccaggctgatctcgaactcctgacctcaggtggtccatccacctctgcctcccaaagtgctgccattacaggcataagccaccacacctggcctaaaacactcactcttgaacaactctctatcacctaccagaagttctaagccctgctgcctcgccagtttcatctcctgccatgtacgacatacactatttttcttaagaattctattctctatgtctctatgtaggagaggaaaatgtttcttttcttacccatcagttcgtggctgagatccctataacaaaagacagattgacaagagaaaagcatataaatttattttaatgtaggttttaagtgacccaggagccttcagaaatgaagacccaaagaagcagggaaattggtctatttttatgcttaggtctgacgaagaccagagagttatggggaagtgtgattggacaatgggaatatgatctaatggtaataaattggggaaaacttagcaacgcctgtttgttcacattcttcttggtatctctctgcctttgaggataaggatggtctcttctccaggtatagagagtatgcctctggaatgaaggatttataacttgcttcaggagataaggatgagtagaagataagagcgaccttcttgcttctgctgtttgttctaatgccatattttggggtagcatgtccggaaccccatcacttatcatgctccaaattttcatagatgaggggtttcactgcctgaaaccagaccttaatccaccctctactgacctactaaattcctagtcccccttcctaaactcaagggtcgcttcccgtatagtttttgctgggcctctcttctccggccctactgaggctctcctcttcagtctttctcctccttccacagcatcccattcacagtttctacttgttggattcctaaacatctgtatatgtcttctacaaatcaatgggctcttgagttcagggagtatgttgtgtccagttctgtatcttcagcacttggcataatgcgtggctcataatgacattggctagatggccaatattttgatttataaattatgggtcacaggccagccaaacttgaatgtgatttattctgtgaaatcatctccaacccaaccatccctcctgtgtgtttccagacactctgaatgtatttggggttagttatgtacacatctgtcttccctgctaggctgtgagatccagaagggcagggagcacgtatcacacaagctggtacccccacctctaagcactgtgcctggcttacaccacctgctcaatcagtattttctcagtgttgacaaaaatgactacatgaaggatggctttctttaatctcatgttcattccacgttgctacagtggggatacaaaaacgaataaaacacatttcttgctttgagaaggatacagtctaagaatattagaaaacatgaatacagcttttaagacagaacatcatgttgtgtctgcaatctctagcccctaatatgtactaaactttaaatattttgtgatataaagacaaaacaaaagtaatattttactaggacattatcctaatacataatttctcttgctctatgagtattttttttaagccacccagtaaatgtgtagcaacaaagaaccatttggaagttattccctgtcttgcagactgagtcagatcatggctaactgatggtcggtcctctctcatgtttcttgttttgttttgtgtttagggttatttctttttctttgcttttcaccattactatgaattttgaaattccttccattttgcaaaaaaaaaaaaaaaaaaaaagctttcctaattattgttcattataactgtaatcttttaaaaatgaaagagtccaaaattcatctaaatgtctgttaaaatgaacagaagttgacttaagatacagtgtagtttttagtctacatatttaattttcagtgtattcccagagaaatagcagtgttgattatctctctttcatgtcctaaaattaatagcagctcatactgaacccgtctaatggaaggataaagacttaccctccaggccagtaactacaaaatgactgttgcaggaagtaggaagaacatatgctggaaactggttctaaaatgagtaatcagtgatgtcattatagggaaaagagtgcagcgttaatgacagaaaccgggcatatcatctgtgacaagagcatcacaatatagcaaagcgattactacagagttctaatcaaataaaatatcacaagataattaaactttccatgttcagaatgaaacttcagttaatacaacacctacatcctctggagtggtattcaaaaatagttcaattttaaaggaaaaactctcattctccaaaatttcaaatataaatatcccttgcagaatgaacaggaagaaaagactaattaaaaaaaaaaagaatctccaatattctttggagataagtagacacacttataaagaatgcagggccaggaaaggtagctcatgcctgtaatcccagcactttgggaggcagaggcaggagaatctcttgaggccaggagtttgagactagcctgagcaacatggcaagatcccatctctacaaaaaaatttaaaaaattagccagcaatggtgatgcacacttgtagtcccagctactcaggaggcgggggcaggaggatcacctgagcccaggtgtttgaggctgcagtgtgccaagagccaaggtcgcaccactgcactccagcctaagcaacaaagagagtgctgtttctcaaacacagagtcacacacccttatgaaggtgtattcgtatatgacagaactaagaattctgaaaactactacttgctaccatatggcaaattaccaaggctccgaacatctgtcatgtatttcaaaaatgattcactaaatattaatcccattacatgctaatgaaatatccctagttgccaagtaattttcaaaaatgcaccaactaattaaagaccaaatcacatatttgactaaaggacacgtttcatttaactcttagctggacactttcattgaactctggattgcccagtaaccaaatgtaagatgacattgtgtatggtgaccaggccgaactcagctgatgtcctaaccaaggacaccaaacaaacatgcccctgctctccgggactaatttcacatctgcactgaaaaacacaatgaagggcgtagccatgattaacttcaggccaatcaaatggctcccaaaagaggccaattttaaatctatggatcacagaacttcttcataggaagtttctgtcaagggaaaacatactttgagttttttgattttactttgatttccgtgaaacactctctataataccttatagagctaaagagaaaaattaagaggagataacagactgtcctttacaatgtactatcctcttttaccctgttctctcactgaaaattgaataacaattacaaagttcaaaatcacagatatctgacatttggaagtgccagaacacctttcaaaaaatgagctgaatatgttcaaagcaatccaaaattaaagagaacttcaaggtgcaagcaggtgataatctaaacggaagagccatctgatgcaacagcctacatcattctgcattggccctgcatggtggctcacgcctgtcatcccagcactttgggaggccgaggtgggcagatcatgaggccaagagatcgagaccatcctgaccaacaatggtgaaaccccatctctactaaaagtacaaaaattagctgggcatggtggtgggcacctgtagtcccagctactcgggcagctgaggcaggagaatagcttgaacccgggaggcagaggttgcagtgagccaagatcacgccactacaatctccagcctgggagacagagtgagactccatctcaaaacacacacacacacacacacacacacacacacacacacacacacacacaaatcattctgcactgactttcctaatggtggcagtccttgggttccatctttttatttttgtccctaataaaattgaagctattaaaattgtattacatgcttgtattgttttacataaggcagtatgctaagtccaaaatgcctaattaaaacattacaaagggatgcatactgtccatttttcttgtgttttttttcccctgagaaatgcacaattttacataggaaccgttaacgaaatggcaaccctagcacccaaagatgggactagtcctgcatctgctgccatcagcctttcttcctatcaacgcctcttacaagtcatgtctgtcatccttgtcactatatctatatctacgaatataccacattttctttattttaaaatctctccatttaagatcctttccacaaaagatgttgtcttcgtatttacctcactgccaatgcttaaaccatattttgtgtataacaaagtcaataagtgttgaattaatgatgaattatcctatcactattattgcaaaagcaactgttttaataagtgataaacactctctttaaaaagtacctttagcctgtgttctagtctcagtattgtcactaattggctgtggatttaaggcaagtcacttaacctctctagtttgtttcccagtctgtaaaatgtggagttggccaaagtgactatttaaaaagttccaaatgaatgaatgaatgaataaaaaaagaaagaaagaaagaaagaaaagttacttccagcaataaagactacagctgtacgagttttttttaaggttttatcaaccaaatcactaagtctttgaaggtaattaaattgcataaaatccaaagatgctgtccacaaagaaggcgaggtttgaatagagccaacttcctaacatgtacccatcacctattaggtgcaaaacactgagctagtcaatgtaagtgcaaaaaaatgcctaagactgtccctcagttttccaacctaatgagatagatgaatgagtaaaagagtgactacaataaaaggcagatgacataaggccggagagggacacaagcagcataatttaagacagaaaataaccaggtgtgatggcttcagctagaatatatcttggttgagaatgtatctgatgatcatacacagaggcctggacaggcctcaccccaggccacccatgacactgtaatagagtgatcttttctacttaaaacaaaatctgggcggatcatgaggtcaggagattgagaccacggtgaaaccccatctctactaaaaatacaaaaaaaaattagccgggcgtggtggcgggcgcctgtagtcccagctactgggaaggctgaggcaggagaatggtgtgaacccgagaggcggagcttgcagtgagccgagatcgcgccactgcactccagcctgggcgacagagcgagactccgtctcaaaaaaaaaaaaaaaaacacacacacacacacacatctggaatttcccttatggagttatgatgtctcaatgattacggaactttactacattggtaaagatgttgatggcagcatatttaacactgtgaatagtcttccttagtacttcatatattgaagttgaatctgcatcccatacccttcacaaacccctgcataatgaatactatttaagtcatcagaatataactttcatcatgttaattttatctgaagaatatgcactggctctttattgcctgttatgccacattcaaattcctcagacaaaatcccactgtacctatgtggtaaatggggtaaccatactatgtatgacaagtttctatgacaaagaaacttgagatttctagaaaccaggtctttcagatacctcttcactttgatatagataaactaaagaggaataaacaaataaaatttaaaatttttagctatttaatattttaaaagtaatctactgagtatagaacagtttttaaagttcagctgaggaccacgatttatgagctcgaaggaaagacatacttcgatggagtggtaacatataataaaagaccctttggtaaagctaagaggaataaaagaaagaatggcaatggcaaaaacaagagggatgtgatgacgatcagaagtggtgagagggatcctgaataacagacaaatatgggcaatatggctatgaaccttagataacgacagagaggaaaacagccaatcaagcaatcagtccatcaatgaaacatcaccaccaagaaaacataatttgtaattcgagtagtagtaaaaaggagtggcaactacctatccactgtatccattttatacacaacaaactttgaggaatctataagatgtattggaaggaagagactagagggttagaaaccatcggaacagcatttcagtatccccagaagctatcagccagccatctggaaagtgcttcaagcagaataattccagagcactaagaagcattacttacacacagcgcagtgccgtgccaagctaaatcatggagcaacacagcactgcagcttggacaggatccccatctgggcatgagcactgcaaaggagctttagatcagtggttctcactgggggtactagggaccattttcagtattttcaattgtcacaatggcatgtggtagactgtagccaggcctgctagacaggacagccttagataacaaataattacccagtatcctccaagtctttcagatgttccaccagacttgccggtaggtgagaaaatcctgttacttctttgaatatagagcctaactgtattttacttacagacacaagtgtttcttgcactgtttagtagtcactgaattatcaaggaatgcaacatccttaaatgtaaattgaagaggaattatactttgttttgtttgcaattgtaccaagagttgttcatcattgtgaaaaatcatgtcgacaattcatggcatttcaatcaccaacacaataaccaggcatcaatctacatacacagatgttacatttataggattctatgtatgtttatgtgtatacttatttactccttatttcaaagcttcaaatagaaagaaaagcttttgccaatactcagttgaatgttgttttactcctctttaatccaaatatattcattgcaagtaggtccaaacatctgatgacatcattttatctccaggaatagtcaacaagtaagcatttacataataaaatgcactgaaagctatctttctcttttctttatattaaaattgtaacactattttaatacttaaatttatgtgtagaggcagttatattattaatacatttcatttcagaaatgaaggggatattccaaaacacattacaaagatgcagcactgaatctaatagggttagtaaccactgctttggatgcacagagaaaccgtagagagcggattccaatgtatctacacaggaaggtaaagtgcaaaagtaccaaaaggtgatgctagctctgtaaaggaaaatatcatttgctcatgattagaagagagaaatacagattaatgccatatagaactctgaaagggcagcttttcctgttctttgaggatgcttggttattgtaagcggtcacaaggcaccagttcccatgccaacctgagtcaactgcagcaccaaaccatagactgcataaacacctcaatatttctcattcacagaaaaggtgagaacttttttgtcaataacttcaacaaagatgagcccaagtattttcagaaatactagcattttagtgtgatgatactgcattggaaagttggataaagtagacaaaagatagttgagaaatcctgtagaagaattctgtattttgttttagtattttgtttttaaggagctaatttctagtttgttttcttctatttctgttgtctgtaagcaaaaagaactaatttccttactggtctaatccctaaactcactgcagtggaaatgagtgaaatatgaaaaggaggctgggtgcggtgaatcacgcctgtaatctcagcactttgcggggctgaggcgggtggatcacctgaggtcaggagttcaagagcagcctagccaacataacgaaaccccatctctactaaaaatacaaaaattagccaggcatgatagcgcgtgcctgtaatcccagctactcaggaagctgaggcaggagaatcacttgaacctgggaggcggaggttgcagtgagccacgatcacgcccctgtgctctagcctgggagacagagcaagactctgtctcaaaaagaaaagaaaagaaaagaaaagaaaaatacgaaaaggagaggagattatatagctaaaatgagtgtaaacatagattataatttccagtattactattttaattattagtattaagtatgcatttattattatcatcaacttttacaaaatgcagtaagggtagaaatgtaggcgtaaagcaaagccctgtttggtagaacaaaatcctacttggtagtaacaataacaatcaaatacctccaagtcactgttgaaatgttgtcttctccacgaggcctaatgtgactttctatgtaaaactgcaagttgccccaattcctgcactcctcctccccatctctattacgatgttcagttttatttcatagctcttaccagtttctagcatacaaagtaatttgctcatttattatggttatagttgcctcctacctctagaatatatttctatgaggggaggaactgttcactatacagtccagcatgctgaaaagtgtctggaacagggtaagttaaccagtatgtatttgtggaaagaatgaacaatagcacataccatttactgagtgctttctatgggccaggcacattgataagtgctttacatagaaatcttatttaatttttattataaaagcctgcaaggtaaatattatgaatcctcagttcatagatgaacaaactgggatttagagagagtacaacagctgttctacatggtacagccagtgagcagtggggctggccctcaagcccaggcagtctgacttcaaagttccatactcgccacaacagaaactcagtagagctcagatactctttttctccctttagggggtgaaaggagtatctggattagtcagctccattgtgcgtgtgtgtgtgttgtgtgcttttttggttttgttttgttttgctttgagatggggtctcactctgttgcccaggctggagtgcagtggtgcgatcacagctcactgcagcctcaactttccccagctcaggtgatcctcccacctcagcctcccaagtagctggaactacaagcacacaccaccacaccctgctaatttttttgtatttttcggggttttgccatgttactcaagctagtctcgaactccagggctccagcgatctgcgcacctcggcctccaaacgtgctaggattacaggtgtgtggccctccccactgttgatcccattcttgttcattgcgatccttcaaaaaatatgcaagatggaagacaaggtgcaggcaggggacagatggggaatctttgtgtcttcaaaatctctcaattttgctatgaaactaaaactgctctaaaaaaaattaagcctttaaaaataatgtcttaatgcacttgtatttctgaatagttcaattttggggtcatgaaagctttaataggtaattgttgacttaacacctttacaacaatgaaagatttacacctaaacattacatgaggtaaaaggaaatttattcatcaaatacagtaaaaaaaaaaaaagtagaaattaagaatagagtaaagcatggttgacctcagcttttttgtgagagtttctattttctcatttggtgaaactatctttgagggactgacctttcgacattcagcgccatttcctttgactcctggcatcttctgctgcatgttcactattcaaagtagcccaaagggaaccaagacagtccacagctattgttttgccatttaatcaaacctgaataaagagcttgtacacataaggaaagtaaaaactcactagaggttacatgaaagaggctgccatggagaggactcgtctgttcacgtaacatgaataatttccccatcgagttgagaaagttctgaacacatttctttctctttttttttaaagactgaaaaatggatataagcccatagcacttgttagctagtcaagcaaagagtgtactcactaaatttgtgcatagaaacaatcatgatcccacagcaaaaaatacttccttaccatgcccttcatagcaggcattttgaaaactgaaaattctgccaagtcaaatatataactgtagctatgtctacttctgtttaaaggcagagagaagaggaaactaacaatactaattccataatttcagaatgagttgcaagtacaatattggaaagaatatcctcagaaaacaggttccccagaggcaggtgaccacagcaagtcatcaggagaaaaacttatatgttcaatttttctatcatcatagaattcatcccatcataaatggagggaactcttcaccttgagaggctacaatttaggatgaaagttttaacgtttaatatgtagacaaaattatcactaagatcatttagggttgtccaacttttcatgaagttcccaggcctccatattttcagtgttataaacacttgagctcccatttataagccctgaatccattttatgtctcccaaaaaccaaaatatttaaattaaaatacaggtagctcagattgactgtctctcacaggaagaccatttatgctaaaacatgctgattcttatagagtgactacccttttaaaattaaaaactgcatcagtgaaagaaaattacaacctatatttatcattcaaaaagaagctagaaaccttaagtaaaaacagggcatttttgttttcaaaaatccaatttttattctcgttatataacaaagaattttaatgtctccctaatcacaaaaagaaaatgctgtttggattaaaagcagtagttacatgccactcattgcactccagacagttctgacctttttgtaagagaccaattttgtatttcctttctcctgcctgaactattgcactggcttgagagttgggctccttccttccagtcttgactctctaatctatatttcatgccatgaacaagaattatcgttctaaatcgtcataatcatttcattctcctacttggaaactttaaacagctctttacttaatagagaataacgtccaaacttcatactagagcactgaagcaaccccacaatcaaacctcgtcttaacactcctagtcctgtacactacacacactctatgctccaaggactagaagcagataaagtcctttccatgggctcaggaaccttccttgtgtggcttcctcattccctccacttggctgctgctgaaatttaaaatcagcacatgttctacttttcccatgaagacatttccagttctcacagtcataattacttatgtcttcctttgcattcccaacacacatacattttatcttatcatgattagtattatagggggttgcctccattgccctatttccctctattgtgtgagatcaaaggtcttgtcgtgtttaattccagattattataacaaaacactgtgtacatggtggtggctcaggaaatgtttgctaaatgaaagaatgaatgaatcatgtaaacatccaatcagtcaatcagtaagaaggaataagggtgaaatgttgagtcaaagacaggactttgagtgcctgcactttcacttagaagaaccttaggttcttattcataaggctgaccatgcctgctctaccatgataataacaaggaaagaatatacatttccgttacttcatagtcaacccaaaatgatctgagatgtattatacattcccaacactgtgcggggcacattgagagacagaacataaatttcggctataactcttactgattgtcttttgtctattgaaatattcccctcctgactacacaaattgtttctttaaaaaggtgagtttgaaccacaattttatgatttatgcaatgataaagtctgacataaatttccggagaagtctagaactggttattaaacaatgatgaacacatatgaagacaatgaccaattaaagacagaacattttcattaaaatactttatatgaaactaaatattttcccttttttatatggttataaggctgaaggtcagaaaaagactataatgtttaaatgagaaattcttgatgtccttctgagcacaatgaagaagcacaggggaatgatatcagttatgtttgcaacacacccaaacagtatagactgaaaaatgaatgttgaaattcaatttttagcactatctctaatgggctgttattaagtcctggaattgggacaattctactaaacatgcccatcggcgacttggctgagatcataaaaggcatgcttaccaaatttagagatgacaaaaaattgggagaagtagtgtatatattaaatttatatatttaaaaaagctttacaagaaactcatcagattggaagacgggcctaaacaaacaagattacattcatccagattaaattccaggttctgaatttatgtttttaaaaaattaattgggttatgaaaaaaacaatccatgtacatggattagaaaactatatggtcaaataatctttaacaagagtgctaagaccattcaatggaggaaaggacagtctttttgacaaatgctcttgttaaaactgtttatctacatgcaaaagaatgaagttggatgcttacgttacaccatatacaaaaattaaagcacctaaacaaaagacctaaaactataaaactctcaggagaaacataaaggaagtcttcatggcattggcttgagcaatgattactcaggtatgatacaaaacacaggcaacaaaagtaaaagtagaaaaagtgggctacatcaaaattaaaactgctatgtatcaaagaacacaatcaacattgtgaaaaagcaatccatagaatgggagaaaatacttgcaaatcatttatctggtcagggtataatatccagaatatatggataactccaaaactcaacaacaaaaaaggaaaaacccaatttttaaaatggggaaaggactcaaacagatatttctccaaagaagaattacaaattgccaacaatcacatgaaatgatgttcaccatcattagtcattagggaaatgcatattgaagccataatgaggttgccacttcacattcactaggatggctactatcaaataaacagaaaagaagaaatggcggcaaggatgcagagaaactgaaacccttgggtactgctggtggaaatatgaaaggtgctataataaaaactacaaaaaacagtatggcatttcttaaaaaaacataaaaataattaccatattatccagcaatcccatttatgggtatgcatccaaaagaactgaatagtatctagtatagtatctagaatatataaagaactctcaaaactcaagtttgaacaactgaacatttgattgaataactttcccaaagcttgtcatttaaatgaacccacggcatgactgagggaaaagcagaacatcataagattccactcccaggctcgtgaagttactgaaaacatctattggtccaattcccaccaagttgggaaaggatgagaatgtttcccataacaaatctccacactttactcaatgaaaaacctgaaaaagtaaataaataaatacttctaaagacctgagtgttgttaaacttattatctaatgatagtatctcattgttccttcagtttttaatatagttttccttagttaagaatgtacaggaaaagaagggccaaaggggcctgttgcactgcttacctcaccagcaactatcttcttgatatatgtcatcacgattggctgatactaacggaagcaggggtgtggctttattaaagtgcatcaggagaaacatcttcttaaggaaatgccagcttttatattattttataagaagaaggagaaagagggagaacacatgtgcaagcgagctgaatgcacacacgctcaatgaactcaactactgtcaaaaaaaagcttgaaaacatttcactattttataatagccacagctgagccagcaaatgacactgttgtagctactatttatataattaaaattataccctaacatttcattttagaactccatattaaaccacttccatctttaagctaaaagcacttcaaaagaaatgtattcttgttatggtcaactaattaaaagtgcattgtatctggaccagaagaacctatttccatgcacaggctaaagacagcccggggaaatgactagtgaaccttcagataagatgacattttaattttcctttatatatcacatcgcctacacctagcttcataagcatgtcagctcactttgtcacctgctgtattacattaagaaaatgtttttattttcccaccttttcttctagaagtggcctatgactgacatttcaggaggaatagccttacttggaaatattctcttttataaatagtactcccaaagtctattccaacctaagctccacttcaacataatttaaaatgcagctttctatataaggcattttatatatgtttattaaatgccttataataaacacttatgtattcaattcagctagatcatgtatatgattcataagtaatctagataatttataaattttatacactaaatttaaattatatacccatgattttcatcacataaattaacacatactatttatatgcccctagcagaatatgcttcagaatccatgaatccattgaaataatatgcaaattttatatctgtacatacatgtgcttagctttccacagtttctcaaaagaatctgtgaatcaaaagaagttaagaaccactagtctattcccaaatgtccatcatattatttaaatataagcagcatctctgaacaggagacataagaccctctgacttttagagggttaaataaccatgcagctttccatttgcatctacacctatatgcaactgaaattgattgaccacattttcttcccccccctgccgcttttaatgactcatttttaatttccacttcaatgctaaataatatctatttttaaagtgtgcttgtttgcatatcacaccaaactaaaattacatccccaagaaaatgttcccagtcaagctaaaaaaaaaaaaaaaacttagcatatatgctgaagaggctgctgtttggtaccttggttagtgctgaagtaggcaggaagagctggaaatgcaaaacagcttctctgacttagaattacatcaatattacagttcaggaaaatcacattatttaaaactataacatgctcataaaaattcaaaaactggctctttttctgttacaatatgctgaagagctacagtgattcagtcatctacctgaaagcttttgtttcaaatcctttctaataggtctcactactcctctgtgaatggtttagagtaggacctttggtcccattcatccttctatgtggagcatcagacacagtacctgcgaacacaaagcaattcaaaaagttttttattaattaatattgtatgacctaattaaatcctaaaatttaagcttctggaagctatcccagtgtgcacagcttaagtatgttctaaaatgacagaggggcaaaagtaagccatcttagggacatgcgtcaaattattccaaacaactatcacttccagtaacattcctgagtcatctcaagataagtccatgctggcaaatatagaagtcattaggcaaagaacataaatttgcttaagatgcagaggcaaaagtgatcccaatatcaatcaccttaaagcttcataattaaaatgagtctggcaattgtctcagacacacacacacacacatacgtgtatgtatacaatgtatacatattatatatgcataatgtatacatattatatatgaacagagtagaaatatacagctaaaattgttttaatatacaaaccaaaatgacattttaaataaaagagaagcatatgacatcatccaagtagaaggaactgctaagagtcatctagttcaaactctaatctggtccattacctttcaagcattcaagtaagttttctgtcctgttttttaaaggcctctaggattgtataatgtatatcaagtgtaaggctttccaaaatcatcctttattcacttatgcaaaataagaaagaaaacaatgtgagaaaagatgaatattctcaaatctggcagtgcctgctgataacttctcactgttagatcagagagttattggtactgtttgtcattcatgtcctgaaatcttcaagtacaccaggaactgcacatgttcccaaaccaccatttcaaattagcaccaacagattggagttaatggcacatataacacattctgcagaatttaaagctttcaggccagctctaataggtagctgtgccttgatttgtggttattatcctacaataacataaaaattagctatccaggtaaagagtggctctccattttttagttggctacccacccccaattccaaaagcataggtccatcatgttcagattttaaagttgaaagaaaggtagacaccttagacacctcatggaggagcccggagacagttgtgaataatgctgccccatctgagatagaaccttcttttgttatgtactgggcacttaaagaaaaaaagtacaactctgtaatggcaaaagaaaggtgcaaaaaaatgcaggatagaagcagggccttgagaatatatctgggagttggaggaagaaggtgggaaaaaggctgagacaatgtacagcatgggctctgcagactgggcagggagaacataacaaccagtaggcaagataaggaatacagttaaatgaatcaatgagtgagtaaatgaatgaatgaaccaacataggaaccaatgaacatacaaataaaatgaatgaataagtgaatgagtgggcatataaatgaatgaagttgctgaatggtaggctggaactaagatgcagacagtcctaaatgtcatgtaatgagtctgaattcatccaaaaaagcagaatgagaaagacatttcttagacttctgcagagcacagtctgcccaactgtatgcacagacctaactaaaagcaatgagagttcacggaaagtttttaactctattaaatcagtcactgtggaagatcattcagggaacagtaggcagaggataagaaacagaagtcttacaacaggtccaaggactacgagctaagcaattgggttgttgtttttctgatcatgcatatactagaattttggatttgggtttttttaattgttatataagtcacgtgctgtaatattcatgcttctaaagtatacaattcagttgtttctcatatatttgcaaaactgtacactcatcaccactatgtaattccagaatatttcatcactccataaggaaactctggacctattagtggttactcgccatttctcctcacctgagtccatgggattcacatgttttaatcttaatattaatttctcctttatgtatctccccaaagtgcatacaaggacaatataagggtatctgcacaaagcagactctcagtaaaagatacatgattatctgccaaagaaatattgtcagaatgcaggaagtatcaagacaattttctttgctacccacctgatgcgacatttttactctcacacggtgagtagcaattttcaaggttcattaagttttttaaagtatcacttggtttcccaattgcaaaagtttaagttgtttttctccccactggataccataacaacctaaatatagtggccagatcaaaagacggtaaaagtagatggtgcacaactaataacccaattcagcaaccacagccttagatcatgatcgatttttccctccaccctacagagtgaaacaagttctgagaacgcacaggtgtttctctgcaagtccctgggcggaagtagcgggttataggataagccgatttctttttccattttaaagtcatctaagaaggtatttccattacattttgtatataattctactactgagttttggaatggctctttggtatttgggagcacacatttaaaaaaaaaggaaatctccaaattcctctcagagattattaccctgaattttagaacaaatttcatttaggctttgtatgtcatcccccattacacacacaaacacataattttttttcttatttctgttaaaaatgtaaaatacctttaatgataaaaagatattccttaagataattaaatccagctgaataaaaatatagtatgtatgtcttactcattttcctcattctgtgcatagggccaagggactaaatttacacatagcaccgaggctgtgcacagtcctcctctgtcccatcctcactccgccccgagtgctgcactgtgagaacaagacaccctcttcgtatatattcgctcactacttatgaaagatatttgcattaaaacagttgttttcataatactaagcttctaggatttaaaacaaaataaagcccgaactgaaaacaaaaaacaaaaaacctgactgcattttggtcagttcatctcttcctataaactattttaaaaatttatttatttatttattttttttctgagacggagtctcgctctgtcgcccaggctggagtgcagtggcgcgatctcagctcactgcaagctccgcctcccaggttcacaccattctcctgcctcagcctcccgagtagctgggactgcaggctcccgccaccacgcccggctaattttttgtatttttagtagagacggggtttcaccgtgttagccaggatggtctcgatctcctgacctcgtgatccgcccgcctcggcctcccaaagtgctgggattacaggcatgagtcaccgcgcccagccaaaaatttatttttaaaaaaagtttaaatactttgcacagtacctaaatttctttgtaccgctctctataaacaaatcatgtggaaaatattttctaaatgctcaggtctgtcaagtttgctagacataatctaatcccttttgtatcttctctcagtaactcaagactttgtaaagctgcaggacagttaagacaacagggacccaggggacagagccttcacaatcagtcacagcagccaccaaacccctggcctgagctatacagaggaaggggtttttatcttcttccttcacaatgcctgaatactctcaaggaatcctccataaataattcattagcagcaaaaagaatacagtctaatcaataaggagtaatggcgaaactcacagcaggttcaggggactgattgagtgttacattaatgtctgattaagcttcctgggaaattttaattgttcatagaccaaagacctaaaattaaccttttaaccttctgttataaagggtctttctcaatggaccaaaaaatgtttataaaatatatctaatgaaaatgggaggctaacatgagtatttcaatacatagattttctcaagaccacacagaaaaacagaacttggttgacttcattctacctaaaacattcctaatccaatcatattgtctaatatttaatgattattttccagtgggtgttataagagctttataacacactttcatttctcaactatcaattccctattttccaggaaaggaatttagcaaactctgcactctttttctctttttctagtaattccctttgtcaattcacagcaaaacaaactgcatgccataagcattcaagaagctgagtttgaaacacatttctttaacaaaaatgaaaaattctgattttatagttacacatgtagaattttaaattaaaaattgttgatatgtgctaatattacacagaaaatccaagatggttaacaatggtgggttatagaaggccttaatgacaggctatttctccaattttgttttgttcaagctaatgttaaaagaattgaatatttcatcacactctgagaagacagcaaagaatcctgctggaaaggaaagagcagctgatctaagcttttaaatatgccatggatagtccgcacaaagatatgaatcacctgtgtttcactctacaatgacacagctctccctttcattaagatatgaatcacccatatttcactctgcaatgacacagttctccctttcatcaagatattcttttcatcatgtattggttgatcgaagacaaaacataagaatggacaaatcattctttagttacataagaatattatctaaaccaagatctctttcaaaaggatcatgaagaatgcacatatatacaaatgagaagacttgccagtaatggtcaatgaggtacaagtgccaggtttctgctgaaatgcttggtaaaacaggtaaaaggatgatgggttctggggatcaggacctttcgcttcaaattccagctccaccgctttggatgtgcattattttggcccagacacttttctctaagcctatttcctcctctggaaaattattagtggtattcatcttgtacacgtattctttgggactaagaaaaaatgaaagacttacactttctagcaacaatataaggtcaacaaatgttagctttagtattagtactagcaccagtagtattagtaccgctagcagttactgcagctgtgcaacagagaacggaagtgtccaccatcttcattgaaggaactgctccgtggtggattattttcctattaaagtttatactttaaagcatcaaacctttttatcccgcccatttggaaggaaatgctatttatttatttattattttttagagataggggtctcaatctgtcacccaggctggggtacagtggcacaatcacagcttactgcagcctcaaactcttgtgttaaagtgatcctcctgcctcagcctcccaagtagtagggactataagcacatgccatcatgccccgttagagatggagtctcactatgttgcccaggctgctcttgaactcctggccttaagccatcctcccctctccgcctcctgagttgctgggatcacagaactgagccaccaagcccagctggaaggaaatgcgtttcaaatgcacatcacggtcactggcttagcagagtggagtctatcttccttggcaattcaggaccatctttaggatcaatacttactatcttatataacttatgacagtagaggtattgtcaggggctacccaagtgggcaggcttcattcaggtgacctatccgttcaactgctatgtttttcttgaagctggtgactctgtcaggaaaactcagaacaattctcagaaaggttcataggacactaaatgtcttagggtcacatggagctaatacataagggagcagtcacttgaacccaaaagtatctggcttggaaatcaactctctctaacaacccatactgaactcagctgtcactgtatacacacaacagaactggaaactctgcaaaagatctagcaggatttgaattccacacgatatgagcaaatgttgaacagggcgacaggatacagctaccaaaaagcctaatggtaaaacaaagacaaacaattatttctcaaattttatcatttgtacggatattcaaaggaattttaatgtcttaagcacaccttgacagatggtgcattcctatgattacttactttcattttactgtcctcaattctctccttcacagttatggtagccaacaaaagcaacagcagcataatgtctattaaacatgtacagtgtgctagaaactgtggtaagtcctttacagaaccacagcccccctgaatgtactcaaaattctgcagtaaatgactaacatgccaacgtaaacacatttaaaaaaaatcttcatttaaatttattaaacagtccagaattcataaagcaatgtaaaaacattcaagattccatttagtaaacacatctcctggaatacagcactagttgctgtttaaaccctggtgattgagttctatgttcagtggaagcagagtcgagctggaagcaatgaaagacttattttgaaacaaagttaagtttcctataaagaagtcaaattatgtttgggttcattctctttttcaaagttttcctcttccttactctcacatttaagaaattacctttaagcaaaaagaacttgctcagaagatagcagtcactaagaatcaggcatcaccggccttgaacctcagtataccacattcttttttctttctttagcaccagaaggatacctctcttctcgattcagtagtcccccttacccttaggggatacatttcaagaccctcagtgggtgcctgaaaccacagatagtactgtaccctctatactctatgctttttcttatacatacatacctatgataaagcttaatttataaattaggcacagagattaacaaaaataattactaataaaacaattataataatatactattcacagtctcatggatagattctttcttcctgtagatcttagcaacctcagcgtattttttttttctttccttattaagtcgggaactttcaccttttcactgaaggaagcactttacagcttctttttggcatatccaaattgacagcgctagtcttgcactttgggagcattattaagtcaaataagggttacttgaacacaagcactgtgagactgcaatactccatctgataactgagggtgactgctaggtgactaatgggtaggtcgtgtatacgcatggatacgcttgatgaaagaatgattcatgtcccgggggatacgggattccatcatgcttctcagaacagtgcacgactgtaaacctatgaactgtttatttctggaattttccatgtaatatttttagactgtagttgaccaaaggtaactaaaagcacagaaaatgaaacctcagataaggggggcactgctgtactttcagtagagagttctcgtaagtatattgctcttttctggacacctacaaacacaaattggccagaacatcatgaagcatgtttagtgtgaagacaagtaagaagggcttggtgatcttagttccaacctttggcagcttcttcatggagataaacacgagggtagaaagttctgtgcaagtctggctgtgcaaccagcctctcttaattgtgtaagacccacatggaatggtaagaaataattgccaccacaatggacaacaaaatctcactaatgtgaattaacaggcaaaaaagctaacctggattacattatcttttttaatggaaatacagttgtatatttaatacacacacacacacacacacacacacacacacacacacaaacatgcatcctccaattagactaacagtgtagagggtcttgggacctgcttaaaggatagggactcttagtgaatcatgcattactgcaagaaatacgtcttcccaaaggcttcaaaacaggtgcctttctttgtaagtttaaacagtgtccttgcagtcttgggtatacaataggattctaagtcagttctctccataacacattttgaaagaaaaaaagtcaaagcaggacaggcatggtgctcacacctgtaatcccagcactgtgggaggccaaggcaggtggatagcttgttcaagaccaaccggggcaatgtggcaaaatcccatctccactaaaaatacaaaaaatcagccggctatagaggcatgtggctacggtcccagctacttgggaggctgaggtgggaggatcacttgagcccacgaggtcaaggctgcagtgatccatgattgtgtcactgcatttcagcctgggcaacagagcgagaccctatctcaaatcaatcaatcaatcaatcaaagcagcactatatgaatcatcataaatgtcaaattagtaaggtctaaattctagattctgcttattcatgctttgggatcccagcctctatgcttctggatcctcccatctgttaggtcaacaccatttacctatatgtctagaagaatgctccactacatcacctcacagaagggcacaggatcaagatattgaacatttgatttaatgcagaaaaagtaactttcccaaagccttgtgctttccagccaggcactcgtttcctcacacaacagcagcatggctaaccaacagcttccagaagtacctgtaaagattgataactttagctggaggaaaagctggagattttcttctccattccctgactgtacttataagctacttactgcagcccggcaaggctctcctcacctggacggacagcctccctgtcgagctgacaagagctgacggatacacccgccagaggactactaaagatcgggatgctgctaccgccatgtccctggcactcttcagggcaagcctgggtaccaatgtcttctcttactcatggcaaacactgacgtggaaccagcctaaaaattctaacacagccccttctcaattaaatttattgaatgtgtttttggtattcgaagctcatttttatgtttgcaataatgtcagtacaactgatccattattattaaactacagtttttaataaaactccatttcaccataacatctaaaatactgcagctgaacttgattaattataccctagaagaaagtaataacagatttccctatttcaaatacaaaatgggaagctcctgttttattcttctaattatatgagaatgggcaaagtaatataccctccctgtcaacaaatttcagaaacttgcttttatctttttatttttcctccagtcagagtccttgttaatgacaggagcatatcataatttaattagctgacaccaactggcaatctacccacttctttttaattggaatcatttcatagaactatccataaaggcccattttgcataactaataaccttcataaacaagacctttggaaaactgctgactttaatggaaagagataaaacacttggacacaggcaccatgttcccacttcacagaagactagggacacagaatttactctgcaatgtatataacagagctaattcaggaagcacgaatcgggtttcccggatctggatagcaaaaaacttccagaaagtcaacttccccaccgcctcacgaaagcatcctaatagttttgtatagtggaaagaacacaggcttgaaaatctgaatttgtctttcttctttctttagacaaggtctcactgtgttgctcaggctggagtacagtggctattcacacactcaatcatagtaaactatagccttgacctcctgggctcatgggatccttctgctttagcctcctgagttactgagactacacatgcctggctcagatgcaaattttaatctgagctacaatgtgaccttgatcaagttcagaaacttctctgagcttctggttcttatttgcaaaatgaaagcggtataacatctaactcaaaaggctgtcaggaatattagttataatgtatgtagtgtcagcagcgaatagctcaataaatagcttttattctcccaattattacatattaaatttgactaataatactgaattgttgggatcatattagataattttgtgcaagtgcttagacaattaaaaggcaatataggcatctgagcttcactggattaaagacaagttttaaagtgctgttcttacattttacttgttttgattattgattaactgctatatactcaccaaatgttgctgccttcaatgaacctgagatcttaagagcacaggcttggcaatcaggtgaccgagtgtgaactcagcccactttctagctgtgtaacattcagtaagtagcgtaagcctcttaaattgactttccgacctgagaaaagcagctaattaaaaaaacagcattcatctcacagacatcacgaaggttaaatgaaaccatccatgtagactgctaagcataatgcctggcacaaactaagtggtcaatatatgttagtagctattattgaattagtgacaatccaagatcgaatctgatacaaatgaggaagtgagacttagaaaggtcaaagagtcttaccgatattaaggagtagaggaaggaattttattccaggtctgtctgacttcaaaactcatattcaaccctaatgcttttaaagcactcttaaagcaggctcagtcattattttctaatatacagttattgagtattcacaggctgatcgaagtgccaattgttgaggatataatcgcaagaaggtagagggtatccctgccctcagggagcttacctatctgggagaaatagataaagggcaagacaagaaagcatgccatgttctccgataaggaaaatacaccagcctaaaggtgcaccatgcaggaagaacagggaagtgaataaacatgaactttttagaagaatccaggtactaaaacagcttatgaccttttcttaaaactaaaatttctagggatttccagcaacccaggacatttgtatatcaaagaatcaaactacagaactgtaaatggaccaaaaagaagaaaatgcttatggcctgacctcagtagaacacgtacctgcacatgtgagttaacgacaagggtttgggaaagagacctctgtccaaacaaacctccttctccgccaagtgccaacacccatccttccttcagcagttaaagaggagacagtaaacacaattggctttctcagaatggagggtatgcagacccggtgcagggtaaggcataaaagactaacagaagaccgtcctgggggtgagttttgaggaagacagaataaactagaagtgaagcggagtgtggagaaccagtctgggaagcagagactagaaaggaggcaaactgcccaggaatctaataatggggcctacacacccatgctagccagagccacatactccaattcacctagaattggcacaacagcaccaattctgagaggaggaaggggaaggatggcagaagagaagaaagaaagcagcagctgaaaatttcaagaactctccaaactgttcctcccttggtgaaggttgatggtgtcgtccaatcactgcagcaaactgacacaggggcctgcagacggttgtgtgtggcttttggagttagagacaggccgttttcttgttaatcggcaggcaggcgtgacagtgttcggcagaggacaatctgttcgagaataattagattccccctcgcttcttgcgttggtggcggaagcacccggagtatttacaatacaccattttgcttccatccgagtccatatgttcgctggtcaggttaaaactgaggctgcatggcacatttttcactgtaaacaacgctgccccggcaaaccctaggggaagggaggcgatcttgccctcttaatttcccagtccaaggaaaggctcgccttcaggaacggcagcagcttcgatatttattgctggagaaaggccacacctccggggagtcatgtcaggagccataggtccagccaggggagcagccctcatttgatgtgagacaaagaagctagaaaacagcccccatgaagagtatgcctttataacatgttgaaagtcacgtgaatcaggacgtgctcggtggttgtaattccatctattgatggcagctgctgctgcaacagggaggccggctagggctgcacactccatggaggcggtgggagcctcacccattctgggttggggcaggggctccgtgggtgccactgcagccacccaaatcgtggctgcagaccaggcttcctgctctatggagcaggcaggcgccccgccttcctgggtggggctacagctgcccaaactgatgctggagatcggagcttccctgtgctcttggtgggggccgggagcagacaggatctgccctccagggtagagctgcagcctccctgctgcggctgcagacctgggcttcgcgctcaatcgagcaggcaggagccagggacaagagggagccccacctttactgagttggtggagcgtgaactccgcaggtgcagacctggcatctctgcagcctgcaccctggagggcccgggaagacccgccccccacttcatccctgcaggctcgggggtgtctgctcccgcttcccagcccctctcctctccagatgcctgctctgatctccgaccggggttggggccgagcccggggcagcaggaggcagagagattcctgggtggaaggcggcagtccccgtaaggcccctccttcagaccagggagggcctgaaggctgggggccaggatgccagtccgggaccggagtggggacttgtggtgcctcgtctgggtgcacatggaggaccatgggccaatcggcaggaacttcctcccctctgaggtccataaaagcctcaggctcagccagagcagggcacgtggagacaatgggcgaaccagctacagagaggagctgccctctgctgagagcttcagagacctgcagagatgtctgaacggcctgcttgtgaagaggagccaccatctccagggcctcctctctgctgagagctcaacactccactagatgacctgcctacagagaggaactacccacagtgggcttcctctgagctgttctgacactcaataaagctcctcttcatcttcttcaccttccacttctctgagtacctcattcttcctggacacaggacaaaaacgggcaaaggtgccaccagccacagaggtttccggccagaaaagcgacaccccgaagatcacataacactatgatttggaggcaaagaatggaggaaaatggagggaggaagaaaagatggagaaaaatctcttaggcatacatgcctgctgttcaacaaacactgtgctaggcaaggtatacaggccatctccaagaaaagatgactaagtgacttctggaacgaaaagcacaactgccatcctaaccccctccccaacattttccagggatcagccctttacttgttaataagcaagaagacaatgcatctgttgcaactgtgccatcagaggacaccagggcagagttactgcagcacttaattagcttagtgcacttgaaggctcagcctggagttctcaggtgagtggcaggaaaaccctacaactcagggtgggtcccaggacaaatgcagctgatgtcagaaaactatgtttggcaatgcagttagagacaaggagtagacgcctcatttgagaatcatttctcgaaagaaaattctagaaatgtgacagtagctggaggaggatgtggggtcagtagagatgaaaaatatgcaaggcctgatttttaaaatacctctttttgcatttcaattaaatgattaaaaattagcactaaaaagaaccatggagatctatatcaaaacccttcttttctctacgaagaaactgagatgcagaaatgttgagtgactgcttgtctgagacacctagctaatgaagagcagggctcgacttagaatttaggattcctgtccccatcactgggcctctactccatctaccacaatgccatgccatgtttctcactctgctgtgactgatcctcaattttagttttagttttgtctttattaatatgtttcaaaataccctaaagagaaaggtatcagattaactagcagaagtgataattttttttcctttcaaaaggaaaattttaactaccttcaccaacaaagggattaagtctgctctatgatggaactgcattaaaaataatgaggcagataaaaaaaagcttttattattttaatgaattcaaaagccggaagcattattgagatgagcagtgtgttactgccctaatccaatgttaccatgttttaaaaattattctgggtaggaacttttctgctacatcagacaaaaccccaaaatatgccaagtagacagaatattaaattaacatcaaatcctcatccctttcaaaatagagatcacgattctaaggagcatccttgaaagcaccacctataagacacaaaacttgctcatatgcaaagatcacccctctgtctacaatgtaacccaaagattcctctgtctgccatttaacccatgtcctaagaaatttatgattctacacattctttatctgaaacaaccattaacttctatatgtacaagcaagttaatttaatctctctgttcttttgcatccgcagctatagagaaagaaattctgtttttttaacttaccttacagggattgattctatagaagaaaacatcacagtaacatttggcataaacacaaatttgccactttaatgtgatactctcttaagtctcagaagaaaataacagaatcttctttcccaatttcaatgttcacagaaatgttactcaaagaaagtatactataaactataatattccattcttgtgtactatagactataatattccattctctttcaaaacagatcacatttcttggccattaagttgacaccattctgccacattcttgacacatcaagtttagaaattagtactcgggtaactgtgggaacaaaaatgactctggtaaagtgaagttaattacatttaacttattctgaagggttgtattttctaccacagctcacttatacagaccactcccattctgtaatcaggcctagtattacaaaggtatgctgaagcattttttacatctgttggttaaaatgacttattactatactgctaattctgtacatactgtactaatgtttctgtctgcataaagcacaagaatagcctatatggaaaaactgggacccaaaccaaggatttctcctctgcagctatggaggggatgaagcgagtctatttgtctaagaagggaaatgtctggcccagccgtggaagtccaggggttggggggacatggaaaaaggccacagggaaggagacaaaaccagaaaaccctgtccacattaccacagtgacatcccaatggcttactcacttcccctccagagccctgccaaagagccaagaagtcttaaacatcatgccccagcttaccatcctaaaagagatggaggaaggcttgttcagatggctggctccaggttgaaatgatactctagagaagttattactcataaaatattccttggctgggcgcagtggctcacgcctgtaatcccagcactttgggaggtcgaggcgggtggatcacgaggtcaggagttcaagaccagcctggccaagatggtgaaaccctgtctctactaaaaatccaaaaattagccaggcgcggtggcgggcacctgtaatcccagctactcagaaggctgagtcaggagaattgcttgaattcaggggacagaggttgcagtgagccaagaccgtgccactgcactccagcctgggtaacagagtaagactctgtctcaaaaaaaaaaaaaaaaattccttgaggggaaaaaatagccccacagccccctactttcaatatcattttgtccttctacaagcaggatagatggacttcctgttagataatgaatctaactccctttttttttgatatggtacaaaaagtatggggttcatggccaaggtgtttaaaatcctggctctgctacttagtgcaatgaaccaagtaactttaatttctttgaccttcagttttcccatctgtgaaatgaggataacaaacctatgttgaaagactactggaacaaagaaaaaataaaaaactctttgaaaaggacctagcctatagtgtcacattcagcatctactcaataaatatttgtcgatccttcctccacagtcctcactccaccagcagacagattcaaacatcacttgattagatgagcaaataattttctttaactacccaagtatctttaaggcccgtttcaaccccagaagtagattcaataccatacagaggtattttcagagcctagctgtgcattcccaaggattcaggcgtatgtaggcctgtctggcattctactaggcctgctttccagtgaccttcctgtggcaggagccgagatcttctggagaaagtaatgggaagaagcaaatgcttacagacttggtcaaaagaaaatggagaaatagaagaaggaaatttcaagtggacaactccaacccctgagtcagaggtcagcactgtgggatgtgggggccaaaacaacaataaatgaaaaactacttcactgagaacgctgtttctgggagctcaaggaggaactacttcctctggagtctgtgaaacaaaacaagctccctggaagtgaagggttcagcccagtggctgctggagcagaaaacaaacatgaaagtgcctgggtgacaaaataagagaggctcccggcaggcagcccacatccagaggagagaaaaggcagcctgggacacctggcgtctggagagcagggatgacgatgtagagaagtggagggaagagagtgtttgttaacacatcctggggacaagggtgtagtccacagatcagccacaaggacactcagaactgacttggaggagcttgtcattggctatgtgaagaccgagcatggaagtaccatgttgttgctattttcatcctgagcaattataagttggtaaagcaagagttatgtgccttgaaactaatgccacctcagtctagctgctcactcagagcaagtgcagaggaaggcaagggaaccaatattctccatacacttgctatgttttacgcactgagtgaagatttttctcatttaattgcatgtaatttcattctaaagagcagacaaacaatttcattcgattagatatacttcctcaataaaggcttttgaatgaaagcaaatttcattttgctgatcaggctacactacgtgagtgtgtccttatagaaataaattaacctggaattaacattacgtatttttgttgttgttttcaaagacagagtctcatcctgtcacccagatttaacctttctcagccacatctgcaaaatggggatggtaaaaataggtaatgataggagctatttcacactgttttgaggactgtgttactacacagtaaggtgcctggcacaaagtaagcactcaataaatgttagcaatttttatgttttataacactaggctgctaagctttgatggaggaaatcatgcaacaaattctggggagtgtttcctcaacatatctgatgtccaattttctcttgtagctgcatggggcccagaaccgtatcacatggtgcagaagttctctcaaatttccaactgtctactcaagcaccaagcctctgcgtgtgtgcgtctccctcagatgatcttgcttccaaattcacaaagaaaacagaagccacagccctgctaccaacttcctacccaacccccataaacagcattatccttctcctttaaactctccccacttttgagaggaacagtcctcctacacagaccatccattctcctgtgttccacatcctctctgtctcctacagtcataacctggacttccttatcttcagtctcatttacttcccactcatcacttcccctcagcctaaaaccctgctggagatagggaaggagggagggagggagggagagggggagggagggagggaaatatattttatttatattttgattggccgattgcttttcagggtttcactctgtcacccaggctggagtgcagtggtatgatcatagctcactacagccttgaactcctgggttcaacaaatcctcttgccttagcctccccagaagctgcgccaccatgcctggctaattacttttttgttttgttttgtttgttttttaatacagacagggtatcaatatgtttcccaagctggtctcaaactcctagcctcaagcaatcctcctgccttggcctcccaaagcctgggattacaagtgtgagccaccactcctggcctaagtcttctattttaaacaatcccacctttaacctcattcacctctagctacaacactttatttatcccttaatagccaggttgctagaaaaaaaaccctttatacttgctatcatctccatttccccaaatttccaacctctcataatatgtactgtgacatcattaggcactaaatctacccttgctttgggtgggttctaatgacctcttaaatgcaaagtgcagaagactttaatcctttctgcttactgccccatacatgagtcactccctcttctacattactgtggcctcattacactgcaagtttactaaaggcaatccatcaatcaatctggcatagctttggctatatccactcatgtggtattgcacgcagcctacattcactgaacgaatcaatggaaataataagggccttaaaggctccgatggcttcattgtgccatccgctctgcttctatcgctactaactatggaaaaagttaacatttctcttactaagtgaatgatacctttggcaaagtaagatataaaaggtgtaatgttctagctgatcctgctccatacagctccaggtaagtaatctgccccagtgagagatctgtttataccggcaaagtgcttcagggcttaagtcttcagaatttgacccccgctcacggcacagaaggatgcccaggacacactataaagctattagaaattgaaaccaatagccctcctagtttcttttaatagactttcagatgcagtgttttctgctttcctttaaaaacagtagaatagtaattaacatttagtaattttcaaagcagttgtgcaggaagatttcctgaactatgaaagcccacaaatttggcaacaagaagtatcacaacagagaaacagctcttggtttattgttcattgttccccacacttagttaatgtgttacaatgacaatgtatgaaatacatgaagttaccatcaaaacaaacaatgttttttttttgttttgttttttgttttttgttttttttttgagatggagtctcactctgtcgcccaggctggagtgcactggtgcaattttggctcactctaagctccgcctcccgggttcatgtgattctcctgcctcagcttcataagaagctgggactacaggcgcctaccaccacgcctggctaattttttgtatttttagtagagacagggtttcaccgtgttagccaggatggtctcgagctcctgaccttgtgatctgcccgcctcggcctcccaaagtgctgggattacaggcatgagccaccgtgcctggcccaaaacaaacagtatattaaacaagaaaaatgaatttatgaattagctttcttccctcccaaactcccttactctacacaagtcattcctgatggagagattgaaataaaatgagaaatttaataatgaataatagtaatactattactaataattccagcaattatactggtattactttaaaaagaaaaaaatattgcttaatctttagcttttgctccacagcaaattccaattctttcaggacacagccaagagaaagcagataatgttcgtcccttatttccatacgtttcttgtttcaaaatggcaacccaaaaggaatactccactgattgtttgtagatatgctgattaaagaaaaatataaaatttcaagcccatcaaccagtgctgctctataataatcaaaaactacctttacaataaaaggttatcaaaccaaacagtctgatcatcacataatttctcatgaaagctgaaaaggaaatacaatcattcacttattggttcatctttcaccaaacacttattgtactaaatgctggcaatacagaagtgaagatctgcttcatgccctaaagatgctcatagttagcaccaagaactacacatctcgccaggtacaggggctcgtgcctgtaatcccggcactttgggaggccgaggcaggtggatcacttgaggtcaggagttcgagaccagcctggccaatatgggaaaatcccatctctactaaaaataaaaaataaaaaaaaatagcctagtgtggtggcacgcacctgtagtcctggctactcagaggctgaggcaggagaatcgcttgaatctcagaggctgaggttgcaatgagccaagattgtgccactgtactccagcctgggtgacagagcgagactatgtcttcaaaaaaaaaaaaatatatcgacctctaagaatcacatttatcttgagctacagagttcgaaggacagaatttttttttttcaattaatgttaaggtctggaagtttgactttggctcttaacctttggctcacatacctaatttggttactatgtgtttactacatgcaaaaagacttccttgggcctatgaatcatttctagtaaatggagctaataataactttccatcagaaagctctttgtcccatttttgtatcagaaatgggcaagaaaaaagtgaaacaaaataaaacaacaacgtgaagatttttttaaatcctgcccctgggatgttgatgagggcagagacaagcaatttacctgcacacaaaattaagttttttaaataatttagattctaaagaaaggaacttttagaatgacatctgctaatactctaaagcttataactctgagttattgggaaggtaagaacatattttccccataaaaataagttctatatcatggttatgatccaaggtgaactcacagaaacctactttctttggttccttcaataaacattaaaagcctgttatttgtgaggcactatgccaaccattagggatataaaaccaaataggactcagtctctgcccacaggagcttaagagtctagtggaggaaactaaattaacatttgcaagaaatgctgtgtttcctaaaatatctacaaggtgttttggggagcaaagaaaacgggcaccttaatcagactacgaaagggagagtcacagaatgctttcccttaagaggtcatatttgagctgaatttgaaggctgatgaggaattacctacactaaaaaggaaatcacaggtaaaaaggtcgaacaaaccgtatttagtgatttgctgaatcatggaggtgggtgacacaaaggaccctagaatgactcaggtgtctggtttggataaacaatccaacgtaggcaccattcacaaagaaagggatgctaggaggtacgagggcaaagatgaaaaggtcatacgcagaccgcaaagcttaaaccttcgcctcacatctgtttggaacagcagtagctttttacttagcgcttacatcaccaaagccaatgagtagcgaagtctgggacgaggacaagagctgcccttggcatcactgcctgtcacctgtcccttcggggcgccccctgcctccactgcttggcctctgtttgtagcttgtgttttggccttgccagcaagtgtccttcagggaggtctggctactcacagtttatagatgagaacactgaggcagagcgataattaactcgacaagagaaaacaaccagcaaatggccctcttgtcccagagcccacgttcttcaccagaacactgcctagtttaagaaacagcagcaattctgtttcttataaactcatgagcttcccaaagacaggctctcatccggtcaggcatcatgggtggatcatcaagcaaacagatgccaacagacattccctcccaagttattccttttaatcctgtcctttgtcagatgcaaaaggcctaattcaatactggaattcctctatatccattatcaggtcacctggatagcctgtcctaaaagaatgaagtccctccttgccacaacaataagctttgtcttttttcccccccataggtcagcttccttcttttatattctgctacaatctgttgttgtggttaattacacaagagactagcatgggtgtgtcaatccctagtggaactgcgttgagaatctgcaaaccagaccatatattatggggcttccaaattttcaagtgccacagaatcgcaagcttctgatcactgcattaaggatctagacctgtggttcagatgagagatgagcttcataaagaagtatgttgccagtgagaccccactaggttgaagattgcaggaagctgagatgcttaaattattctaattaatgggcttattccccactggttatgcacagcagattgaatggacagttgcaggtgcaaactgagaggtaaacagacctttaaataagtaaagagccagggagcactagctggggaagcacaggtttcagaatgaattattaaagcctgcactgatccacagtcgagggtatgactgatttctaagtgaagacatcttatcctgaatgctgctactttaaggtaaaaatagactcattcttcccctgactctctttctccatcattggtgcaaaatgaaacagctccgttggtttgtaattgatgtatctgacactaaaatttcattctatgtacttccatcctctgaaatgcacagtaagggaagaagatcatcttgacaggtaaaatagtaggttttgacacaaagtcattgagatatatgtgatggagaattttctactgagacaaaatgcagttctatttgaaagtttactacacatttcaactttcactttgaagaaacactttcagataaataaataaatacgcaatgattaaaagaggaaattggctttgtttttttgagaactaccccgtagagtaaagcatacctttttatatttactcttttttataaaactattgattgaaaaatatgaaaaggtagaaggtgcttagaattcctagcacataatacgtgctcaatttattgatgtgaattatatttacacataaatatacagacaaaccagaatatataaatataaagggatataatcactccaacaccatgaattccaccttaattttcctctccttgacaaactactgattaaatgtaaaaagttgctctttaatctagataacacgttttgtatgcatttaagaaacatttactgagcacctgctttacatcagcatagttctcagtacagatagagcaatgaacaagatacaccaggtccttattccaatggagcttaattctacccagcgtgagatatgcagtaccgagaagtaaataaatgagaagatattttcagataatgttcatgatgtggcgacaataaaacagaatacaccacgagcgtgtggaagaagagctactttagagggaatgaccaaggaaggcatctttgaggcagtcacattcaatggagtcctgaagaatgagagcgccaaccattaaaaaaggtttttctaaagtgctggggggaaagcacgtgtaatagccggagttaaattcactgctttcaacagaataccaaataaaatgatttacccacagaaagggtcccttttctcactggattcccacaatgccattagggagccaagctccttatacctttttctttgcccctcctggtgtgtagctcaccgggggctgctctactactgagcagtaactcagccttccagtgatgaagaatggggaaggctgaagggcagggtgtgtctagccagcctagtcagtcccttcctatccgcaaatagtaccttccccagaagccctgcccataagtgttcacttacatctgctctaaactgtcccacagatacagtaaagctaaggaagtttcttgcttttaactggcatgaatgggccttttgtagccccgaaaaaaaaaaaaattgaaactctgttagcaggaagaaagcaagaatgggcactggcctgtgataagccatgtctgctgaagcatcctaggcagggccatggcaagtgcgaagtcccttgtgggataataggtccagcttgtaaaacagaagaccagggtgtaggagtgcagggaacacgacggaagcacagcccaggaagactgtgagtgaaatgggagccaccggtactgagggctcgccaggtcctggagtggggggagtacttttttttttctccacaccacctcccagatgtggtcttgctatgctgcccaggctggtcttcaactactaggcccaagagatcttcctgcctcagcctcctgaggagctgggattacaggagtgcaccactttacctggtgatattacctttattttacaaataatgaagtaaactcagtaggttaagttgactcagctaaattcacagattaggaatgagaggagacacaattataacccagcttgatctgactcctaaattcatgcctgtaacccctgtactctgctgctgtcttcatatccctgctttaacaatatgcctctgagtatgagctgacagaatccattcttccaaatccattccggttattacctactgtcctattcactcacatttataggaagtgtttatttgttctaatattttcatttatttcaaagttctagatagagagaactctatgtctttctttgcctacctaatatgcatagaagaaaaaaatattaaaactgaaaatgactatcttcatctgatgctgaggtttggggtgaaaattcatattagtgggaaagcagatctctatactgctccttctcactctgagatacctggggagggagaaaagacaacactgaaatgtcaaagctcctgccagttcctcggtgctgaaacattaatgagcttctgaatgtgcaaaggtgggcccagagccgaaggatgtttgagagttaaattgctctgcataatcaaggaaaggtaattgagtttcccgaggaatcagagaatcaagaggtctaggagaagtgagaaaggcagggagctatgaaggtggctgctgtctaaccccacatgacgtctctcatgatttccacattaccagcaacactgttcccaaattcctgacacagagctatagcaagctctcacatgggggacagcagtgagtgaggattctgtgggtgactcctgtgggtaagcattggggaaatactttcagatcacatccaggataaaccattattttcaaatctgggaagattaaatagagatggtgaatgtaaaagaacctgtgggacctggcagagcaactctgatattctccagagcagcagcagacagaagctggggctgtttgcttactcctctcgccctgaacattaccaacatgcaggctgggactgtgagacaacgccatcagacaagcgagacgatgccatcagacaagacaggtgttccagcgattgctctaggtaagcctcattctctttgttcactggcagcaccaccccgctccaccctgcgcctcatttgcagagtcctctacaaatgaacatgcagcctgcctggcacacctggcacagctcacctgcatgccgccaagcatgacagactgtctttgctgtggttgtaaaggcctattttcccaagaggcttcttctccggggccctacagctttcagcgtgcacttcaaactcactgaggactgagtgacttacagttttctctgtgtgctaagctgttagattgtttccatctttacacaggctgttccctccatttcaggcatcctctcttccaggctgaacccgttttcatcagattatcttttaccagttcttcagaaagcaattcaggcctcgtttctccaggaagccttctctggcctccacctttgatttcgatggtctccttcatgttccccagcccccgtctatgcctccaccttggtatatcatgctctattgtaattattaatttacttttctttctccgcgaatagatgtacccacagagcctagcagtaaacctgcaacaaagtggtggtttgatcattcttatcaaatgtatggcttaaaagtattgttcttctaaaatgtaaaaagagaatcaaatacaggtctggccaatgacagtatatttcaaatgacaggcaggaacatgtcttcccaagtcctgatttttctttgaatgcacagctctgacttatctggcctctctccagaccttcatatgactcttctctagttaagccaatagcaggcttcaagccaaaaactcctagaagtaggagtttgccaggcaatagtgcatgtgtgttggttgcaagagggtaaaaaaaatattacaaagataacagcctgggtgcaagcttggagagtttcaggaacagaagaggacagcgtggcagagctgtgggttcagtaagtgaggtcaaagcgtgtggacgtgtacctggccggctaagcaacagtagtttcttggtgaatctatcagagaaggactactatacaacataagtcggtgggagcaatgtatctaaagtgagaatgagtgaagtaatgctatcccgcaatgaccactaattgaaatgccaacaactccaagttggctaagtgaaaagagagtcttacctcaattaccctaaaagaacattctagaactaggttaagctaacaggaataagcatatgtggagggtgtttctgggaaaagaagtctgtcagaggcaggcagaagtatcaattggaatgtgtctcagagacaacctaagttgacaccatataaataaatatttctgaagattgcagccaactgatctgaactctactgccacgtaaggcatattaattatttttaaactaatagaattggtgtgcatgttcttgaatcatttaaaattcttatctcctcaagaatctggaatttttgtttgtgttacccctaaatccaaatttcacaatgctgaggagtccatggttttcaggcatcattacaaaataaccagcacttcctaacagctggtggcagcaaaaatctgaaacttatatttctcagttacaatgcctacttaagaatcacctcaaacctttaagtacaatacaatgtgagggttactcagaggtacagagactagtggtatggtcaggatttcaaccgtaccatataacctgcataatgaacaactcagacttacctcacttgttactaaatatttgctttatgtaagggaaaattatcttcagccaaaatggtagagcacaaccaacttaatatatatcctaagtggcttagaggctaagtacataatcccttcagcagtagcctcaactacatttctcttattgtagctagctcttgcacatttaaccaccttcatctgtattgttaacttgaaattttaaatgtgcatattcccagaacgcatcaactaatttttatcattctttcatttgaaaatatccttggaacattaatggttgaagagataaaggataccatgttcctaagagaatttattgtgactcttacactcagtgactggttgtaactgggaaactcaaaaccacaactatatatgactataaaatgacaatgaaaatagtttattctatacttgtaggctgtttgacattttccagcttgccttgattttataaaaagaaatgaccttgaaaataattaagcatatcaaagggtaaggctgtagctcactgaaacacagcaatatgttcacgtctttataacactgctaagcattcatgaaatagcaagagattgtattgctctttaaccaagttctactttaattttataggcttatacatattcactacgaggccattctaatcttcacctacctgcattcttctgaacttgcaaataaaggcaatcaggactctacctgctagacttggaacagatcagattttgcaagaggcatcagggtctggttgattctttttttttccagcctgtgtttaatgagagtgctctcaataaaaacacaaattcagattaggtttctgtactcaatgtttattaatttagatactctttaaaagagcatgtaagcatcttgagaaataaatttagctactgtcactttataaaaggaacaagtgcaattaaaaaagaaacaggaaatcggcaatgatatggaaggaaagtgcttctgagacctggatgctatcagccccactgcatacaactgagtgtgctccctgcagtgttgcaaagggctcagagaaatcacaactggccaaatgttagaaccttccgcagagaaataatgacagaggaaagtcagaatctccaagaatggaagacctaatgctcggagatctgcagacatcttaataaaaggaatattcaggagggaaggtgccattttgacttagttcaagttctctgctgggtttcctcctctacccccaccctagcaagagtcaactcagaccacaaaatttaaattaaaacacaaaatgtttagctggtttctcccaacttgaaaaggggttgacctgggatcccaggtgagagaaaacgagctatataaaaataaggcttcttgggaggccaaggcaggcagattgcctgaggtcaggagttccagaccagactggccaatatggtgaaaccctgtctctactaaaaatacaaaaaaattagctgggcgtggtggcgggtgcctgtcccagctactcaggaggctgaggcaggagaatcacttgaacccgggaggcggaggttgcagtgagctgcgatcatgccactgcactccagcctgggcgacagagcgagactccgtctcaagaaataaataaataaatagataaataaataaataaataagacttctctcatgaggtgatggaatgccttagagatctgctatttccaaaccaccaggaccagccccagtgagccaaatccttaatgcttacatctttcctcttcctacaacacatggacgggggcatgtgagtaaccaaggaagccaggcccaaagagaaacttcctggtgccaggatcattttgggtgagccacttgttttttgctcatactggatacgtgtgccacgtgccaggcacacagtcctgaacaagactgataacgtctctgctctcatggagtttatgttcttgtgatgggtgacaaatggtaataatgaaagattttgggaagagtatcaatcatggaaaacatctatttatcagtccgttcatttacttaacataggctactgttgtgcaacaggtcccatgttggctgctggaagtatacaaaggtaactaaaacacaagctaactttgggagtcagccacacagagacggtgaatgaagctacaggaatcagtaaggtaacccacagacagtgtgcagagaacaaacaaggtggcgaaagaaccccaccgactgggaagacagtagtgcaggaagaaaactaggagagtatggtgtcaccgaagcccagggaaaagcgttcccgaaagggagcggtccacaggacacatgaagttagagtatccggaggattgagcaacatggagattgctgctcatcgcaactacagcagtttcaattgagttaaggacctgaacgccagactacagcggaggtgacaagaagtaagaaagtgaagactaaaaatgtaaataatttcagttgtaattgtgaaaggagagatgattcaaagataagtagaggaagaggtggagcaaaggcattacttctttttttcccctccctcgctttcttccttcctaagaggaagacaggcacatttaaaggctaaaaaaggtgaaaataattgagactagataactagtagagtgaggtccatcaaataataaaagagtgagctctagaaaacaggaaaagacatccttgcctttggggatttcgggacagaaagagggaggtttgctgatgctttcaggggtgaggagaggtgaagggttaaaagtcgtcgaaacaatcttccaccttatagcctcaggccaggaaaactcccaggcaagattgtgtgcagctgaagaggccaccatgtaccagtcacaggtttttaaggtgagcttagatgcaaatggtaaaagtgaataaaggtcggggagtggagaaggtggcttgtctgattattaaagttacttacagatatatatatctgttatatagatatatgaaatttttacaatgagacaataaagtaatatttgggtaagaaaaattcacacatttttaagtaaaaatgtccacttcccactctacattagggtgagaggaggccctggcaatgcagacaatgctgaatcaataatttcagtaacctaagagggctgtctagaagtaaatggatctacatgtgcacatctgaatgggagagatcaggaatgtaggtcaacaagggtcatcctcggtgacccacacccccattacctacaccagacaaactgctttgctgcactgtggactaggttcccctcccttttttaaaaaaaaaagaagaagaaaagcactatctgttttcttgcaactcctcaaggatttagtgcagtgtatgtgtcatgcttctgggcaacttggaaaataacctgagaacatcaaaggtctatactgaacgtgaaaaaccctctgggcacaggctgcaccaggccacacactgccacgttcccttcacagtcctaaagaaaaaaaggtacatgtttgtatagggttctttcagattctctcaccggaatcatttgctccagcatgcatgactgaaacctaccctgattaggaggaggataagatcatgctgcctgagcacacatgtaagtctggtaacaccctactcactgtgtgaaaaagcattttagctgttggcgtcaccaaaatgtaagccctttatttgctgagtgtctgctaaatcaacatacagccttcatattttgtctgttcccctgttaattcttaaaggctgttggttcctggagtctcggctggagtctgggaaccacgtcagtcattgtgcttgtccacacatgtaaagtgctcaagataatgtttgcctatcacagtgtttgtttaacttgctattggcccaataacatgcaaatatgtgctccataaaagctgcaactgactgtaatacctgagagctaggggccgcgggataacttagtcattattgttttttcttgaggtgaaacataaaattaactattttaagaacaattcagtaacattgagtgcattcacaatgataaacgaccaccaacctatccagctccaaaacatttgtatcactacagaggaaaactcgatacccactgaaggcagctgctctcgggtgccccttcccacaagccctagcgaccatcaatctgcactccgtctctatggattcatctactttgaacatttcatacaaacggaatcacagagcatgtggcgtcttgtgtctggctcccttcattaagcataatgtattccgggttcacccgtgctggagcatgtatgggtacttcattcatttgatggctgaatgatactcgattgtatggatagatcacaattggtgtattcattcaactaacaacgagcattttggctgttgctaccttttcactattgtaaatactaatactatttataatatatgtatgtgaaattaagtatcagttttccattcttttgtgtgtgtatatggcagtggaattcctgggtcatacatcaactttttaaggaagtggattccacagtggctaccacactgtacattcctatcagcaatgtacagggttccagtttcttcacatccttactattttccattttactgatcacggccatcctactacatttcattctattacatttaatagtaaatgtgaagtggcacctcattacggtttttttttctttttttttttttttgaagacggagtctcgctctgtggcccaggctggagtgcagtggcatgatctcagctcacggcaacctctgcctcccgggttcaagcgattctcctgcctcgacctcccgagtagctgggattataggcacaccccaccaggcctggctaatttttgtatttttaggagagacagggtttctccacgttggccaggctggtctcaaactcctgacctcaggtgatcttcccaccttggcctcccaaagtgctgggattacaggcgtgagccaccacgcccagcctcattgtggttttgatttgcatttccttaataactgatgatgaggagcatcttttcacgtgcttgtcggccatttgtatatcttctttggagaaaggtctattcaactcctttgctcttttatatttagggttatctgtcctttggtcatttttaagcaaggtactccaatattcttctctatgcatactcctttaaacagacaaaacgcaaaacagtgcggtggttaggaagctgtgctatgaaaccagactgcttgggtctgtcctgcaacttagtcactatgagaccttgacaaaattatctctctgagccaaaatatcttaagagtaaacctcgtggatatgtagtaaatattaaataatcaatgtaatatacatatcatggcatgtgacacatagaaaagctataaaatgtttcaaaagccaataaaagtatgcacaggtagcacgttcatgtaattacttgtgtacttccataaggatgggaaaaatgcacgaacctctcccagattcagccatgtaagggtagaaggaacttcagggaggaagtcacaggttttttgcctccatgttaagacaaaaatggccccataatgaaaagcactgtgcaaaatattaatttttaaatatctttttaacaacataggaaaggcattcttctacttttgcaaaggaggcagaaccaaaatctgtgaagaacctttggctatacagacactccacagggaccaaatctcctgccccatcacacattcctgggaattaaaaagaatggagaacgtttacaagctgctgtactttataattgttatttctttgaaatgattctttttctttgtgagaggaaaataaaccacagtatattgctgagaagtattaagactcattcctttctgcccacacacaaaaattcgttgcacccggaggaatcatgtcaagcagtccacctgcttgggtctaaaagtcatgtatattgttctgacaagtctaccttgctgccaatatgcttttgccgtctttagaaaggagtgtttagtaaaacaaatgatgcctatacagtgtccatgtacaaaggcccctgtgttccagttctatcccatacttgaaaaacaaaggctctttcagggtagggggttcaatatcacctgctatgtactctggtccaattaaatttcccatttgtaatacacaattttatacctataattctttctgtcattttacattgctttaatatgaaaagaagtctctgcttcacttgaattccttagagagcctggcttttctaaaagcttgtgtgtccgtccctacatccctcccacctacaccaaatttaaaccttgacagactaatacattggatagcaatccaggcagtctgcaaaagacagatgccaaggcccaggagtcacgggtaagctcacgtttatcttccacactgcaacgaatagataggatggaagaggtagtcagaaattagtaagccaagatgaaaaacgccaaagttaatttaacaaatatagagaaggaaaattggtcaaagtcagttacagggcaaaagactttctttcaaaaaaaaaaaaaaaaaaaaaaacctctaacaatatatgtgaaaagggcaaagcttaaaaagctggactatctaagaaacaaaataatgttcctggagtagcaaacagaagtcctgtttgctcttcttgggacaaatgctcttgcttgtcccagatcacaggtgaaaaaagatacttccaggcagaataacaatggatagcactgggagtctcaagtttgagttccagctctaaagatacagcaaggccgggtgcggtggctcgggcctgtaatcccagcattcggccaaggcaggcggatcaccttaggtcaggagtttgagaccagcctggccaacacggtgaaaccccatgtctactaaaactacaaaaattagcagggcattgtggcacaagcctataaccccagctacccgagaagctgaggcaggagaatcgcttgaacccaggaggtgaaggttgcagagagccaagattgtgccactgcactccagcctaggcaacagagcaagactctgccaaaaaaaaaaaaaagatacagcaagaaatcttcagtctaaaatgtacctataaactcatttttcacagattatggaaatatttttgattttcaagttttgataacaaaactagaatgtgttacagtttaattctgagtctgcatcgttcttggtttttgatcattatagaaaatacagaaaacacagaataaggaaaaaagagaatgtgacatagtacaacttaagaaaaaataatttgggtgttatttcctcactatcaaaaacaataattaaataatatatttttcattaacctaaaatgaagaatttaacacaatgattttctccccctcctagaaatatgctcaattaaaaatatcagaatagtgtgatatatattatgtatgaaatataatccaactaatactgcagcatggttagtttccatattactaaatatgcctcatggttgcatgtagcttccctttacatttatttataattcatttaaccactcccacactcattacttttttttttttttgctattaaaaaaaagtataattactgctttcaccaaacaaggattgctatgaataattttttcttaattttaatttttctttttttattggcctacttaggaattctactatgagtaatttttgactcgataaatatttctaaatttgcttgtctcaaaatataaatcaatttacacaaaaacggtagtaatacaagactgcctgtcttaaactctccctaagatttgggcattaacatttcttgttcatttttgtcaaatggcatttcactatttacctttcattcttccaaatgaacactaaaaaattacctggaaaactgctttcaagaaacgtagtcgagaaagactgacacgttataatgctcagtcttatcatctacaaacatactatgtctttccaagtaatcttctacatttcttaaagctcgtagacttcttattttcctgcactgtttgtgaccgctaaatactgtattttgcaaaacctttcagtttttttatatgcaaaattcatgttatttttcaaacaaccctctaattttttttaaaccagaagattattttctatggtttcatagtctacaaattactactttcagattatcaatttctgagtatactttgtttctttcagtacatgttatggttctctattctagttttctaagtggttttgatttctactttggtctaatagagtttctgtgctcccacgcattgggtgaggtagaaccaatgctgtctgtgtacaatcaagaattgattttggtaaacgtttcaaagataactgaaaaaaaggtatatttcttttataaaagatatcaagtttatcctatcaattgttttttatcttaaattatttttatatgacattaatataatccctcctttctttgaatttctctgattcacctttgcatatccttttgctttaaatcataacattttagatcattctttttccagagggatgggggtagggagtgccggtgtcatcactggaaaagagcttacacctgagagtactggagtcatgtcttcttaacagagacacctgccaagaaattcattgttaggtgattttgtccttgtgtcaacatcatagacacactaacgcaaacctagatgagacagtctactacacacctgggctacatgatattgcctattgctcctaggctacaaacctgtacagtatgttcttgtactgaatactataggcagttgtaatacaatggtaggtatttatgtatctacacttatctaaacatagaagaggtacaataaaaatacagtataaggttgggcatggtggctcatgcctatgattccaatgctttgggaggccaaggtgggggaattgcttgaggccgggagtttgagaccagactgggcaacatagcaagacctcaactctagaaaaacttaaaaaattaacccagcatgttggcaaacatctgtaatcatagctactcagcaggctgaggcaagagaattgcttgagcccaggagttcgaggctacagtgagccaagatcacatcactgcattccatcctgggtgacagactatgactttatctcatgaaggaaaagaaagttatgaaagataaaaatggtatacctatgtagagcactgaccatgaatggagcttgcaggactacaagttgctctccgtgaatgagcgagtggcaggtgaatgtgaaggcctagaacactcactgtactctactgtagactatccacactgcacgcttaggctacacaggcctagaacactcactgttctctactgtagactttatcaacaccacacacttaggctacacaggcctagaacactcactgttctctactgcagactatccacactgtacgcttaggctacacaggcctagaacactcactgtactctactgtagactttatcaacactgcacacttaggctacacaggcctagaacactcactgtactgtagactttatcaacactacacacttaggctacacaggcctagaacactcactgttctctactgcagactatccacactgtatgcttaggctacacaggcctagaacactcactgttctctactgtagactttatcaacactgcacacttaggctacacaggcctagaacactcactgtactctactgtagactttatcaacactacacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagactttatcaacactgtacacttaggctacacaggcctagaacactcactgtactctactgtagactttatcaacactacacacttaggctacacaggcctagaacactcactgtactgtactgtagactttatcaacactacacacttatgctacacaggcctagaacactcactgtactctactgtagactttatcaacactgtacgcttaggctacacaggcctagaacactcactgtactctactgtagactttatcaacaccgcacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagacttcatcaacactacacacttaggctacaccggcctagaacactcactgtactctactgtagactttatcaacactacacacttaggctacacaggcctagaacactcactgtattctactctagactttatcaacgctgtacacttaggctacactacatttattaaaaatctttttctttcttcagtaataaattaagcttagcttactgtaactttttactttataaactttttttaaccttttgactcttgtaataatacttaccttaaaacactaacacattgttcagctgtatgaaaacatttccttttttataaccttattctataagctttgaactatttttaaattttttttactttttaaactttttgttaaaaacgacgacacaaacacacacattagtctatgcctacacagggtcggggtcatgaatagcactgtcttccacctccatatcagatctcactggaaagtattcagggtcaataaaggcatggagctgtcagctcttatgataacaatgccttctctggaatacctcctaaaggaactacctgaggctgtttacagttaattttttaatgctttttttttctgagacagggtcttgctttcctgccctggctgaagtgcagtagcgggatcatagctcacataaacctcaaactcctgggctcaagctatcctcccacctcggcctcctgagtacccaggactacaggtgcgtgtcaccacacctgactattttttatttttatttttgcagacacagggtctcattatgctactcagattggtctcaaactccttatgtcaagcaatccttctacctcaggctcccaaagggctgggactacaggcatgagccactgcatctggccaactttattttttttaataagtagaaggagtgtgctctaaggataaaagtataatatagtaaatatataaacgagcaacacagtcatttcttatcactatcaagtattatatatggcacagaattacatgtgctacactttgatagaactggcagtaccgtagggtttttaataccaggttcaccacaaacacgagtaatgtgttgtctgtggagttatgacaggtggtagaaagttccccgctctattataatattatgggaccagcattgtatacacagtccatccttaaccaaaacatcattatgctgccatgacaacatttgtttggttttcttgtttgttgtttgtttttaagaccaggtctggccctgtcgcccaggttggagtgcagtggcacaattaaagcccactgcagcctctgcctcccaggctcaagaaattctcctacctcagcctcttgagtagctgggactacaggcacatgccaccacgcctgactaatttttgtatttttagtagagatggggtttcactatgttggccaggctggtctcaaactcctgagttcaggtgaccctcccgccttggcctcccaaaatgctggaattacaggtacacaccgctgcatgactacatttgtttcttaacagtggatctattccaggagagtggagtctcaacaattactaattattagttataatatatctgcctttcttcttcacactttcatctggtaagcacctgataaactgaaataacgtttgctctgatcaccagtcgatgaatctctgctgcttttagaaatatctaaaatattacaatactttctaaggtcatgaaaatcttttaggtattaatgagagtgtgggttacatgaatatgcatttatctatactcaaatatcatcaaattatatccttaaatatacacattttatcatttatacaatacacctcaaagttcagaaattattgggggaaaaactaagtatagctcaaggagtaactgcgcctgtgccctatgtagaaaacgcactggtgatacagacaaacattcatttatttacaaaatcgtatttgagtagaaaatattgtgtcatcgtattttgtaacatggtaaatatccctttatattgcaccaaaaattagagtcaggcttcaagatgatttttacataccttattataataaacttagtattatccaactgataggagataaaacaaaaagcaccactgggagaggtttacaattcaggtaaaataaatgctttgttctttgagatctggagtaataactgtctgcttattaaacaaaaaggttattttttcctatgcataacctttacagtacagaagtactccagacttgaaaatccctctaccacctgaggattaaaacactttaaatattcaaatctaacttcttaagtttgaactatactttccatcacagatctggaagtagtctgtgaactatcgaggaagacagggccattcacagggtggtcattcactcaatttggggaaacagagtatcttctaatctgttaggattttgctgaatgacatttgctaggggaaagttttaaacatttattgccgacactccaggaaaatagagggtaatttactggcatgtgtgattgtcaagtgggagaatatgtcaatcacctaattatcattattcattaaggagggctttcaaatacattgtaaatgaaacatgtgtaaagtagccatgaattccaagtatattatactgtgcagacacagaataaaaacttttttcaaaatacataatttacttgaaggagtttcctttcttaaatacattctctatgaaaagcaatttgtactgactcaagttaccacatcttccatggtccttttagaagagatatttattcaaaagcagaaagataatggaaaccaagtgttttactctaagctaatgttacacaaaatcactaagataattttttatttcgttccagtactctcctttccattgagtcctccaggcctcaacccaaaccccctcaccagtaaccacaaaataataattcttttttatctgctacttagtctcagaaacaaactgtggagtcccaaaatcaggtcagctgacaaaattagccttcctcaactacacccataagtaccagtggatccaggccattcctacatccattcaccactgtccggctcttaagaaggactatatttagctcttcagagcccttggcagaaagagataaacattaaaaaacaaaacattattttgaactgaattgataccgtaacaaaaaagtaacatttgactctttaaaacattggaaaacacttacatggtctgaccctcagcaacacgaaaacatattcgaagcaatgagattaatgcttatataggcttttgtttgttttgagacaaggtcttgctgtggcccagactggaatgcagtggcgcaagatcacagctcactgcagccttgacctcccgggctcaggcaactctcctaccacagcctcctgagtagctgggcccacaggtgcgtgccaacatgcctggcaaattactgtattttttgcagagacagggttttgccatgttgtccaggctggtctgaaactcctgagctcaagcaacctgctcacctcggcctcccaaagtgttgggattacagatgtgagccaccacaccagcctatactggccgtttgttaatggcactggtaatattggctcttccccttagacggctcatgaggctagccactcttgaactaaaagaatgcacgtataacatacaaacataatgtctgaatccccaaactatagactttaacccaaattggtgaaacacaaaggaaaaggaaaagaaactttaaattgtttttaggcctgctgtttggatattacaggaaccactgtgatttatatttggcctgagggtataaagatctatgattttatttatggcttggttaaatcttttcaaaacacaagagccacctattcataatattaagaaatcaggtgatttaaaccttactacactctgctaatatactgttctcttcagtagaaacatgtaggagtatgttagggacaatctctcaattatgagcaaatttacaacttcaatgctgtcttcttaaattacatgccatcacttacaatccaaacatcatttaagagtttataagtttaaaaggaggacaaaacaaaaacctttaacaactcattattatttaagccagagttgcaccaagttaccccttcaattgtctaaataaattctagacatggcagcctactgaataaataaaagcaattgataatcccactctatagaaaagcaaaaaagcacaaacataaaatcaagagaccacaccgaagtagcatcatggagaagaataaacattttcaggacagaaaatgtttaagaagaacagcaaaaaagaacaaaggtaggtatattaaatgagcaaggaaggagtggaactgttgaaaggtggggtctaaaaaggctgtgacctgctttctaagtaaagcctagtccaaaaatgtcttgtgaccagatcaatttccattccttctcgaaagatggaagacataagcaaaacacatagagctatgaggacagagtggataatgattagtacatagaaaagttgctacttcgaaggattcagatattaagtagagcaattaaagaatttctccaatgacatcaatctcaaccagacggatgttctcaacatttcgcctagcaactcccccaggccatccttacagcaggcttagggaggtgctactctcttggttcctgctttcaaaaagggtgctgcctccatttagtgatgtttataaaaatggcagtggtttcctatttgaatgttaattattgttatgacacacaaggtaatttaacttgctttggtaatttattcacccttctaattagatgtagttactggaaaatcttccagagtgtagcaacagttccaaaggtgaaatggcaggaggagggagctttcccataggatcgcaactgtaaatctgggatggatgttcaattgccagtcacctgaatgaacaatgccagggatcagagacggtccttctggaatcaagcaggtggcacccatcaccttcaagaatttgatgattcaagaggaaggtaaagccccaaaagatggttggagctactctgaaaagattaaagactgaacttgaatgaaccaaggaacaataccacacaacaccattttaaatctcctagaccgggagtcatttacatacagttgagaaatgccgtagacagagtataagccaaaaacaccactgaagtgggagaggctccactcgagttacttgctttgtggaagtattttcacgcttgccacatcatacctgctcgatcaatatttactgaaacaagcaaatgaatgaatggacaagtgcatgcatggctacagcataaaaacaggcacacccactccatctctctcattacggcctcctcagcaagcagaccttttttcttaatttgaaggtccccaaagtgagcgagtttcaatcaacagaaatttctttgtctttaattaaactgagctgccactgcttcttctgtgaggtctaagtgccagcctgtagccatgttctacgctagccagaagggaaagactgaatcatatttgtgaccaaaaaaaaaaacccattagactccaatcaatgcagagcaggtggctgatgactgcagcgatccctatgaggagcacggattgatactgccaaatgaacacattaactgaaactacccaggccttaggggaatggccagaggcccctgtagggaacagtttaagtcaaacttttcctgcttccattgtaggatggaggattcaagggctcagattatataaacaagttcaaggccatgcaagaatgtatacagaaatactcaaacctctaaccccaacaggaagaggaagaggaggaggaggagaagtagccagcagaacaagtggaagaaacagcttccagtgaggtcactgcacccaaagaagaggagcagtcaagctaacgaaagccacatggcactgggctccagtccttccacttcagagtgatatggaccttcgcaaaaggcctttcaattgccctccaagaaagcgtctttccctctgttgtcctcttcactgtaatgcacaaaataatttattttggtgatgaggggtcctgatctcttgacatacagactgaaaaaatgggggttgtatgtgtgtcctacatataaatctgtcagcaaatattgccaccactgaattctattttctcagattgccctcaattttgccactctgaaataatgtgctgaataatctcagcaaccagaaatcatcatccaggaatgtttcttatgagacagctgatttattcggattcactagatcccttttagtagatttaatccccctttgggaaatgtaatagcaagaaaaacatcttttaaaagtgctggagtgaggccacttctcctagaagaagccagatggtcagatatatatttctcaaaacccatcttaaccttgagtatatgaagggatactacatttcattcctgataaattttggtttccatgttggcattgagctccaggctttctatgtgttgatagcggagatttggaccctccatccacagtctctttctaagtgaaggggaagattggtttttgctgttccttgttattccaaaagctctggtctggggcccatgttcaccctggctctcagtctggtcagatgcaatgttcttcaaaggtggggacctacttgttatcagagtagcagccaaaagaggaaaaggtgtgaattaagtactcagttaaaaggaaacatgagaccaggtgtggtggctcatgccaataaccccagcactttgggaggtcaaggcaggaggatcacttgagccacagagttcaagaccaccctgggcaatatagcaagatcccatatctaatatatctaatatagatatattagaaaatatatatctacatatagtagaaaaatatatatacacatatattagaaaatatatatacatatatgtatattagaaaacataatctctctctatatatatgtgtatatataaactacttatatatatataagtatatatataaactacttatatatataagtatatatataaactacttatatatatataagtatatatataaactacctattctatcttataccttccactcaaggtcatgaagatttgattttggagactgatgcaaatgtttgccacctgattttaaaactcaggagggttaggccgggtgtggtggttcatgcctgtaatcccagcactttaggaggccgaggcaggtggatcatgaagtcaggagatcaagaccatcctggttaacatggtgaaactccatctctactaaaaatacaaaaaaagttagctgggagtggtggtggatgcctgtagtcccagctacttgagaggctaacgcaggagaacagcttgaacctgggaggcagtgcttgcagtgagctgagatcgcaccaccacactccaagcctgggcaacagagcaagactctgtctcaaaaaaaaaaaaaaaaaaaaaaaaaaaaaaaaaaaaaacaactcaggagggcagaagagaatgggtaatcactatacctagtttccagcaagagattcctccctttagaaacactccccagaactgacagaaacagagaaagaggcgtaaggagccataaagagatgtgacgtgctttaaaagcaacaaaatatcagggaggaacatactctactctaatatgtccatcataggggttctatttgtttcctacagataaagtgatcatttaactatgaaaattactatcattcatctctccacatgcattcccatccttgagaagtggtaggaaccatgcgcctctgggatgtggaaacaagtgctcttgtgaacagaggtttcattccactgagagaaatggccatgcaaagcagtgtctcaagagagcaaggcaaatcaatgtctcgcctagagtatattttacaaatttctaatacaaatgattgcactgaaggacaaaggttttcctgtactcttcctccatccaaccttcaaacagatacactagtctcagctctagtggaagtaggaggcatccttgacattatactcagctgtgatgtaaggaatctgtgtacttacaaaactaatgcaaagcatttcaggctgtcagctgacatccctgccactccccacagctgagactattcagtaatggcagtacatctgacatcctgtctgacatctagaggactcaggaaattcaaagaaaatactataaattctatcatttcatgattcacacttcatgcaaccaaagatctcctctacacaaaaacacaggaaatgtcagaataccccataggtatgtgatttttcttaacttgtatggttttatttataagaaataaattcagttactgaattatgaaacagacacataggggtcccctttgggatctagtccttaagatgcgttcaagaggatgaaggatgtccatctctgagatatattagtacttctacaacccgtgtgccaagcaccagtgggctaacatatcctccagatacatagacacaacttaaagcagagaagccaggtagagagatttgaaaaatgaattctaacactagcatactaaattcccaaataaattgtttaattacattgtacctacatttccccaatgatcacgtagagataattacctttgcttatttcacagggggcatttgtaataataaaaagaattatttgaaatcttcaaagaaagagcactattttaacctacttatataaggaacagaaagagaaaattgagttaacagtcttaaattctgccaaattaatctaatttttaaaaagagagaccaagtaaaacctcaccactgttgttctcatcgtaactgaaatccagcacattaaagagagagagaaagagatcaacttttaaaacttgtaaaactccatccctggtggccacaaacactcttatcagttccccactgaaaacccctcctcgccatctcccttccttcccctttctcctattacctcagccttcactccacttaatcttcccatctctcgacttctctatcacctcttcctccctgatagttatgacctcactcccactgtcacacatagaactgatccaaaggggacctaagaattattctaaccaatctcccacacagtaaaaaggacaactggagactgaagtgataacgtcacaggctcagggtcaggtagccactttcatgcaaagctgggtcctcacctagatatatgactcccagtacagtactctttccagtaccccacacaacagtctacctggacctgttcaccagccttatccaagagatccatttctgaaacagttaggtgcactttgttgttcttccaccatataaagcactttgagtcacaattagaaaaataaaactgatgacagcaatcagattagaatcctgtatctggaagacacctttacccataatccatcttatccaggaagtaagactcaggaggccatttccacaatgcctctcctccccagacactcattcctatgttcaacatcacttccattgctcaaacctaaatccttcctaatgatgatactgaagcaaaatcacaataccaggttttccagacccggctgagaagacactaactgagcccctaagtacaaatgagcatacttaacatagagaagacacagttagcacattgctaaatttctccacacccttatttttagcagattaaataattgtaacccctttaactttatcttctaagtctatttttggcttttatctaaggcccctttaaattctccatgttgcttttggaaagctagagtccagaaccaaggacaggtagctaaagtgtttcacataagagaaactccatcaacaaaagtattgcgaagtctgtacaagcccagggcaatcaatgaaatctgcatgtaaacgaggcagttttccagacaatacttttcaattagactaacttacaaacttgaggaataacgagaaactacaaagaaaacatcaactgcgtcttcaaagcattttcaagcacaaaccctaatacagtttactggatgccatttaattgggcagctctaagcatgtagctaaatacaagaaggttggcataagagataaaaaagcaaacaatgtccaagctacatcacttaaatactgtcagaacaaggttaagaagaagcaaggtgagaaatcagggaaaatgcaaataagaattccatttcctacaagataaagaaagataaataaaaatcctgactagctaggggagtatgtccagcaccaaaaaaaaaaagtaattatttcatgtgtggtcctgatataaagtcttgaaaataataaggctgctaaattgcaaatatcagggaagtgaagtagtagctcaaaagattatgaaaattgagatttccaaactgaatttgaaaaggaaacaggtaaaatgaggtcaggacattacagatgagaaagaagcttctactatttggctggctgttttaaattaataacctggaacattagcaggtttaaagtcctataaaaatgacacggagggagaagtaaatgcggtagaaacagcagtgtttacaccttcatcatagaaaggtattactaaaaggatttacaaggtggtaacaggatacatatcaaagtcaaagcgctttaataaatgatgagaaaagacattaggcatggaagtaaagccgaagggcttgaaataactccacctatccacgtcccagattattttaaaccaagtaagccactccaagatccacaaaagatcaggttgtatttttccctaagtggcagtattcccatgagcaccaaagcagtaaaggcagtaggtagaaaaaccaggagttaaaagaatataaaacactagtcctttctgggatattgttacacatgctgaaagaatctaaatatatatatcatgacccaaagaggtctcaggcttaaaatccaaaaagaaagaaaagcaagtatattgcccttttttcctattgggaaaaccttgtaaccactgaaaaattagaacagataaataggaatgggtcagtataattagtatcttctaattatagaagcacccagattggcatcaaactcaccaactcttggctgtcttcaacaatgaccaggcctcctctggggagactacttcttgccatcctcaatctgtacctcagatgtgtgacttcttgcttctaacaatatcacagattatggactaaatgtttgtgtcctcccaaaattcttacgttgcagccctaaccctctgattctatttggagaaggggcttctcagacagtaattaaggttaaatgaggtcatacaggtggggacctgacacaataggattagtgtcctcacaggtagagaccagagagctcattgacctgctcccttcctccctgtgtgcttgcatgaggaagggccatgtgaggacttagcaaggaggcaccatctgcaagccaggaagagagacctcaccagaaacctagtgggccagaaccttgtcttaggcttctagtgttgagaactgtgaggaattataaatttctgttttttaagccacccagtctgtggagttttgttacagtaccctgaggtggctcagacatacctaccacattgatgcttaatagtgactacccaaacagcaggaataaaagtttcaatttgtttcttacatttcctaatgcaatgctctgtaaggctagatgttttagaaatgctttttgaacttaataatggttttaaaaagtcacagacttcaataacagccatcattttctataagcactaatggtgttatatgccaagaatttttaaaggcaaataaatttttcttcttatctaaaaagctgcctggagaatgctcacccttcctttactcactactgaaaactgtcaatagcaattcaagtaatataattccttttttttggaggcagagtcttgctctatcccccaggctggagtgcagtggcgcgatctcggctactgcaacctccgcctcccgggttcaagcgattctcctgcctcattctcctgagtagctgggactgcaggtgcccgccaacacgcccggctaatttttgtacttttagtagagacagggttttgccatgttagtgattctttttttttttttttttttttttgagacggagttttgctctgtcgcccaggctggagtgtggagtgcagtggcgcgatctcggctcactgcaagctccgcctcccgggttcaagccattctcctgcctcagcctcacgagtagctgaaactacaggcgcccgccaccacgcccggctaattttttgtatgtttagtagacatggggtttcaccatgttagccaggatggtctcgatctcctgatttcgtgatcacccgcctcggcctcccaaagtgctgggattacaggcatgagccaccgtgcctggctggtaattccttttcaagaattacaaacaccaaagtatcttgtacaatggtaatttatgtgcacacgtatgctaaaaatgccaaaaagaacttacacaatttttacatacataacatactttagttccttgattctatgccaattcacctaaatattaacaaacttaggacagtggaccttgggcttacagaatattaaattgtagaataacagaatcataaaatcatagaatcacagactagaggtttgtctcggtcaaatctcaccattttttttaaatgaggaaaaccagagctcagtaccttgctcaaagtaacataaatagttcccttaattcccagaattgtggttttttactgtattgttaagaaataattttctgtaaagcaaaataatgattctcaaaattaataaaacacatataaaagatttaactcactagaaaatgagtaagatgctaagtctgatttttaaaagaattcaaagaagacacaaatacataagcatcagaaatgccagcaagatgtaaaatgtgcaaaactagtcaatatgcataggaaaataatctattgcattctccaaacacaactgcattttatggacaagaaccaggcgctttactgtctattttctgcagcacacacaattctagtacagctcaaagacagtgaaaggcagagctgacctgatggttgagtagacaaaacatgctcttttttttttaatcatttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacggaacaacttttcgctgtgactgaagagatgaaatgtaaaatgaggaaacacgaaagaagaaatggtctgctacacaaacatacaaagtaggtgtgatgtgctagataacgaggtgatgtgctgatggagctcaactctgaccccagttccacagctccagtcaaaagatctgcgtttaagaaaggagaaacaaggtggctcatgcctgtaatcccagcactttggtgcggtggcgcacgcctatattcccagctactcgggaggctgaggcaggagaatggtgtgaacccggaggcagagcctgcattgagcagagatcgtgccactgcactccagcctaggcaacagagtgagactctgtctcaaaaaaaaaaaaaagaaaagaaaagaaaggagaaacaaataggaatgaagagtggaaaagatatcaaataaggacccaaaagcactctgagaaaacaataaggttcttatgtcctgtgttcaggcaaagaaacacaagacatagacatgaagagaacagaaagcaaggaataatgtttaaaactaatttggcacaattttttttcttttaaaatgctcaagaggatcattgcagaaaacacagtggtaaagcaagctgctgagggatttttcaatagctccactgtgaaaaaacaagcacatcttaaaactacaagctttgaaacttttaaatttcttaattaaaatatttctagattccgttcatttctaagcaagactgcagccctaaagagaccagtaaatttttattcatcttttttgaaacaaacatgattaacaagtcattgtttgaatagaaaactatgaattaaacaaacaagcaaacaaccccacaataatggaacccattccttggagataatgacaatgcaaagtacaagaaacccattttgaagcattagtttcatgtgagcacttgttgacggaaatattacaagaagtccccctaagaacagttctcttcattgtcgtatcaatggtcttggtggctcacattcctcacgtgcactgagggccgtcttgataaaaagtatctagtagacctcttggtgtcaagttgtaaagctcgaacttgttttgggatttttaagaatgtataataaatatcgatttattaatttacaataaaaaaactaatgggtgaaaggactggacactcagcctctgaccttcatgttttctccctgcataggaagtcaaactactatcagaatgttgtcgtgtctggcactacagcaagagcaatgagttgcacaaaccatgaagcaaacagactgttcattcatccagcacgtcctggcctagagctagaaatacagcagcgaacaggagcgatcagagtccagattggactctgaaaagaggatctccttgccccaggagctgtgcagtatggccccagttctagctttctctggcctagacaatgcctaatggagccctgcaaagattcacttcactgacttttttaaaaatatttttatataacataaaattttcactttaaccattttaagtgtacacttcaatggcattaaattcaaaatgttgtgtaaccatgaccactatttccaaaagatttttgtcatcccaaacagaaactctgaacaagtttgctttttaaaagtggcacaagttactaacatttgtggttgacatttttttttttaatatctatgttaagaactcgattataggcctacccataatatgcttctttaagaggtctggggccaggcgtggtggctcatgcctgtaatcccaacactttggggggccaaagtgggtggattgcttgaactcaggagtttgagatcagcctgggcaacatggtgagaccctatcgctactaaaaacacaaaaaagagccaggcatggtggtgcacatttgtggtcccagctactcgggaggctagtgaggaggatcactggagcctgcagggcaaaagctgcaatgagccaagatcgcaccactgcactccagcctgcgtgacagagcaagaccctgtctcaaaaaaaaaaaaaaaggtctgtatgtttcattagccattgtgtgtgtttatgttaaaaatatgaagtgtttcacaaatttgcatgtcacccttgtacaggagccatactaatcttctctgtctcattctaattttttagtatatgtgctgctgaagcacgaactagccattgggttttgattttataactgttttccagaaggcaaacttctaacttcttaaagagaaaggtaccttgttgccatgtcctccctcccaccccactacacagaggcgctttcttctacaatgcacactatttcatccaactcttacaaatatctaaagagatgctatcatcagctttttagacataaggaagctgagactcacaggaatgatatttctcaaagctactcaggaagcaagggaacaacgcaagtgtcggtaacagttattccatattggagcatgactgactggatgaatatatgtttgtttttgctatacagctaacattaactggttctaagactgaatactgtattaaatttgttattaaaatacatactcctataacaagaagggacatataagacaaaataggaaagatgaaaaggttttaaagacacaggagaggctaaagaagtgatttttaatggatatactctgggagaaattctcaactatttccctacaaatgggtgacattagtcacttagggtggctgccttttttctgaaagctatcagacatctccatgggcaaaataaagaaagagaccccctacggtttatttatgtacgtatcatggtagcactccgtggttttaagacatattgaaactccatcatatgctgcttttaaagcccaaataactaaaataaaaactcccaggcacagcaacggcaaaatactgtcatttgtatgtgcttaggagacacgtgtctctaaaagcaacatgtacatttctcttttcaagcaaatgtttaaagaactggcaccgtaacaaacaaggggaaatatggagatcagttttaaaggcaggatttgtttttgtggagtctaatttatttcaagaaatccagattattaaattcacctcctatctgaggaaggatctcaaaggaaaggtaatacaggctagtcgtccttaaatgcccaagtccaaaagactagtatttaagacccaagtttatcacttactaagtgtcagaccttggccatgttacataatcgctctcaatctgtttcctcaaaataatactgcttaacaaaggattaagtaaaatggtgcgtataaagcaccacacacagaccgtagcgtatacttaagagttttatttcagcattagaaagcatgggaggccgggcgcggtggctcacgcctgtaatcccaacactctgggaggccaaggagggtggatcacaaggtcaggagttcgagaccagtctggccaatatggtgaaaccccgtctctactaagaatacaaaaattagccaggcgtggtggcaggcacctgtagtcccagctactcgggaggctgaggcaggagaatcgcttgaacccgggaggcagaggttgcagtgggccaagatcgtgccattgcactccaacctaggtgacagagtaagactctgtctcaaaaaaaaaaaaaaaaaaaaaaaaggaagcatgggaagtaggggagtcgctaaagctcactgatttaaattactactcaattagactaaattttttaaaaatcatgattttctttgtccccctccccaactcacacacaaaaagccaacactatactaaataatagaagatagtcgaggtcaagattttcaccttgttctccagctatcattttttccctcccgacttctattttggattaaggtatttcaggggccccaacatcaaagtagaacagaagaaggaaagcaagagaaaatgagaggtaggaactagaaaagccagtatcagaaaagcatacagcacttcctcactatactagcaaagcttaccatgcaatattcaacaggtaaatcctgatggatggctgacaccgggttcaagacactagtccacatgctccacatactgaataccctaaggtagttcagagagaaactgaggggaagacggagaaaacgcacctcacggtgcattctgtatgtcactgccttacacgcaggagtttcaatgttttggtaccaattaaagaccaactatcagttctccatggaagcagcaaaatataaaagtatccttgaaatcagtacagggcccttctgcgagggtctggtgatgtggttttgagattctttgttttggatcattcctcgtttggtggacccacaaataatggtcctgcctagaaccatcaccgcaagctagagtgaaaaaatgccagaagactaggctggtgggtaaaaaaattcaacgtttttcctcatgattaaccttgggtggccttgacaagttatgtaaggttttgtttcttcagaaagacactgcatttttagaacatctctaggcacaaaaattagtcatgtaactgaaagacaagaaaattttaagcatatattataaataaatgtgaatattaggggtgtgtatccaaacacatgaatagctcttaaaagaataagacaaaaagatcaaacatatttgaaatcagagagatgtcttttgggaactgaactcttgccatgagcaggagaaaaccagaaaggtcttcatgggttctggtacctgttcaaccattaattcatgatgtgtcgctggaaaaagatcacaaatgtcttcaagcttcattttccctatctgtatctgcccaagatctcactggattctcgaagaatcaaatatgataacacagtcattcctgaagtatggccacggaccaacagcatcagtaagtcaggaacttgttcaaatgcagttgagtcccacccagtcctaataaatgagaaacttcagcaatcggttattctgatgcaccttgaagtttgagaaccactgcacaaaaacagatacaatctgaaacatctgaaaacactggagtgttgttattacggaaaaaattaagaatcatacattgaagatcttaagaactttcacttaaaagttggatacagaagaggctatgtgtggcttttgttgttgtttttgttgctgttgttgaaacaaggtgtcactctgtcacccaggctggagtgcagtggtattattatagctcactgtagccttgaatacctgagctcaagcgatcctccttcctcagcctcccaagcagctggaaccacaggcatgtgccatcatgctcagctattttttattttatttacttatttacttttttaatttataagaaaagaggtttaattgaagaaattggcaaaaagaaaggggctacagaactcctgcaactttggaacccagcagggcagttgttaaatgttaaagctccaaaataacctggctcatttttaatttttcttttgtagtgatgaagtcttgctgtgttgcccaggctggtgtcgaactcctgggccgaagcgatcctcctacctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgattacatattctttaaagagtaaatatgagactaaatgtatctcaatccaactattaataaaaaaagagtgaacttgagattagctctctctagggaaaaaggagaacagtaagtcctcctgggatctttacattttcttggcaagagtaatgcattcattgcttttaaaaaggtaaaaggtaaagtcaaaaaaaaaaaagaaatgtagttacaaaagatgcatttcaattgataatgaaggcttttaatgtaatgattataggaaatcttggaggagttctaataagtacagccaaattaagaacaaaatatgctaagaaaacagagaagtcatattgtttttcattctacattctagttaaacccaataaaacatgtgaagacaaaagtattcctcattagaagtatccttaggtcccatttatcgtcatatcttgtttactaccagttaagaaaatatggtactacagcctctgacaaattagggacaacctgagagccacattggtagaaacatacagatctgaaaaaattctgggatgaaagtaaggaagaagagattggaagaataaattaacatttaaaatacaacaagatcacatagaaatagaaatagttcgatgaaaagacttgtccataaaaagcaaaattaccaactatctggagatttaaattagactgtactgatgaatgtattcttcagaatatgtttatttgtatgatcttttacgtacccttcaataaaactctagactaagtccctacgacaaaagaggcagccccagcagtggccttgtggcctgatctacagagacagcaagccgccattcactgacccacccccatcacactggcaccccacgtttctctccaagcttcttccccacagtataaatcagatccaaattagctgctagtcataatcagcagaaaggatggagaggccttacagttaccttagacacagccctagtggtcttctcctacttcctcagggacggcctccgccagcagcacaacagcacacttcctgtagatctacaatcagttcttccgagccgcagacggctgctatcgtcctcgcagctctccgggtactcacgcttctttttctccctctttaattctaggccttcttttctttcttacctttgtgtcccctttcaagctttcccttttattcaaacgtacaccaaaatggcaaaagcagcaaagcattctaaatcatgttcacgcaagccagtgctggggaacaaaatggatacaaattggtcattatgttctctttcatttgggggtggcgcacaattaagagaggtacgctgtttttatgtacttctctataactgcagctctaaaggttcctcataccatcatgaaatttaagaggtacatgagcaatggcactatactgggaaagttaaaacaaaagatttattaacctgtgggttgttgttttaaaaaagtatcaagggggtctacacacttcctaaggggaaaagtaaacatttttttgaacacttcatatactacagttcttgtggggtttttttgtttttttttttttgacatggaggctcgcccagtcacccaggctggagtgcagtagtgcgatctcagctcaccacaacctcccacctcctgggttcaagcggttctcctgcctcagcctcccgagtagctgggactacgggcatgtgccatcatgcccggctaatttttgtatctttagtagagacagggtttcactatatcggccaggctggtctcgaactcccgacctcgtgttccgcctgcttaggcctccgaaagtgctgggattacaggcgtcagccactgcacccggctgcatgccacagtttttcacagacattatctcacgagtagacatgccaaacctagccatctagagctgtgctatccaaaaggtagtcactaaccacatgtagctatttaaatttaaaacatcattaaaattaaatttgaaattcaattcctcagtcacattcaacgcatttcaagtgtttgatacatgaaaacggctactgattgccatattgcacaacaaagagagaacatttccattatcagagaaattctacggcacaacaatgatctaagtctccttcacgaagattttccacaaaaacgtctgaagaattacattgggtccctcgtacaatgaagattaattcgctcacactaaagctgtaactacaatccatatacgtgtgttctcttgtacctgcagccaggttttcaccactgccagtttctacgctatacttggcctactgagagctccagtcttttacaaacacttactacatcctaacctctcttgaatgtctggcaaaggtttggatcaaaaaagacatcacatttttgcacatatgacataatacttgtagttgcctggaaatttattggcccatatgaagtgggatccccggggcagtgacaaaactaagtttatgctactgaggttttgcttgcccaggaaatataaaaaacttgtgactgtgaagtcactaaataaactaatggttttaataatgagggcaaaaaattattttaataggtataatgtcattatcaaaccacagaaaatgctatacctgaaatagagttcaattttggttagatttcctttaaagtctcacaggactcatgtggtacggggcctctgtgacaataggtaacttttcataaatgcttaagcacatctggactctactccagtgacctacaaggtaatacatcattctgtcagtttcagaggtacattcacatcctattctccaaaaccagaaatcgcccagggattcctagaccatatgacatgttgctgaaggaatatacaaatatatacacacaaatgtgcgtgcacgcgcgcacacacacacacacacacgcactgaaagaatattataaccattcacctttcttctaaattttaccttctgtgttaactttccctgtgttgacaaagaatgcctctcactaagtcatgaccctgcaggtcactgtaatacaacatcgcatacctggattattataatgggtgaagggttcttacatatagctcaaccggaggttaggaagccctacgaacactcagatttttgcttcatttttaaccaaaaggggtcagagcctttgtcaataccagctgttgcagtggttggctgcctgtgataataggctgcctttcacctgaaagaatgaaggggtgtttctcagagtaatatcttacgatacagaggatgatactgtctttaaagctagtgaaaatcaattttactgtcacttctttatttaaaaaaaaacctccctttgcagaaatatcactgagatgtcatgtttaaattttttttctacttcacattatttataagccaatattttaaagatttttggcagttctttaggcctgggcaggggtgatatttgcccagaatacatctgatatggtctcctggttgtttctaaatttcctgttttgactgatcaatgcttgtacagtgcttgttattaactactagacaataactcctgggtacagacactgctccttgtcttttttcctttgtgtaattcagatagtaaatgtccagcaaaaagcaagattccaaggggtaaattcaattgctgacgtatttgcatttctaattctaatccaagttaaataaatgaaaaatccactgtaaaagagaagcacaaaaggcaaaatcttcacaatcattacccagggaatcactgctttgtataaaatcattaaaaattatcttgaaaaataataaaagcaagttgactgagacaattatacaattctaagaaatgtttttagaaatgttcttctaagtattgttctttttaaattttatttttggcaattctcaactgtaactacaatacaacattctttccccaatgaaaaacaaattttaaactatttatttaacacttttggccaccaacatttacagaaatagttgcttagtatagcagctcaagcagcttaaaaaatttaaaagttaaaactttcatagggcctagaagcaaagaaaactcattagcaataaacataaatagtgcccaatcttgttttctaaaactattctccaatttctaaattctccaatttctaaaactattctccaataaaagaaaacagggcacattgaagaaatggctgcttctaggatatgagcaggaaacataaaaaataagcctgaagcatcttgtagtgccagaaagtgaggaggtgctaaagaaaaaaaaaaacaactctgcaatgatgaggatatgtcaaacggacacagaaatcaactgaaaaagttccctgcggccaaaagttagaatattttgggcaagaacataaagtagtattggattataactagagatataaaataaattgtgtacgaatacatactgatataaataaaagacaaatctcctgttcagaggaattccaaataatttacatattaaatactcctccttcaaggaggtggaacgtggctcccctctccttaggtctgggtggtgcctagtgacgtccctgtgacgaggacagtgtggaagggaaaaggaggagctctgcagtggcgaaggctgacaaacgcgacctcagctaggtgatcaaggtcaaaatcaacaagtcaagtcaatagagcatattccaggtaggatgtaatgaaaacggcactttatctctgtggtcttcctccccaaaatccgtaactccactctaatcatgaaaaaaaattcagacaggtattaccttctttccacgtaaggtacgttctacaaaatacctgaccaataatattcctccaaactgtcaaggatcatcaaaaacaaagaaagtatgaaaaactgtaccaagagaagcctaaagcaacacaaggaccaaaaataacgtggtatcctgtgtggcatactggtacagacactgggtaaaatccaagggaatctgaataaagtatggactttagttagtaccagtatatcaatattggttcattaattgtaataatgcaccatactaatataaggtgtcaatagggaaaactgggtacagaatatataggggaacactctgtactattcacaattttgctgtatatctacactttctaaaatttaaagtctatttaaaaaatttaaacagtctttccaatactaaatcatactgcatacaattaaaaatatttatttgtttgccattgtaattgtggttaagagtgtgggctaggataaaactgctggatctgaatcccgttcccctgtctaagttgatttttactattaatagttatgtgcttgacctgtacacagtatatagctaacacgggcccattctgacatcagttatgttcagcagtctttgctttcccagtaagagaaaagaagacaaataaggcccaatcagcccaaagcttctcatcacagggtagccatatttagtaaagaaccaggcaacatttgctgagtatcacagggactaaacctggggcaaactggacccccattcacagtcaaggcaggttctctttcccaagaacagatgtaaccagcaatgtgaataatgcctctgggcaaagtgcaggactgattttaagagctgtcagcaatttcacatgatatgaactctgtttatttctaatattcaaatgagctcaactaatgaaatactattttattttcataagcaaaaagagcagtaaaatgaatttgataaaaaatatctgaagacacattcaataagaatgaccggggtacatagtatgttattcatcttttttaaagtctacatgttaaaagatttacaaccaatgaatgcttcttaaatgaatattcatacagcaattgcagtggcttttttactgcctaagagagtcattaaaggcttgtcatcctggcccagcaatgcctctggtgcttctaaatcattagatcttagtctactgctttgaatgttgtaattgcaacataaaaatgagaaataaattaccagtatgaacaatcaaaggtcacgattttcagcaaaagcttagaattttatagtggcacctactttttaatataaacgattaagggtatttttcttgaccagactgagtaaataaacagatgcaattaatgaaacaaatgaaaaggctgagagcaactggctattctttaaacagattataagtaactaatgggcattaaagggttttttaatgtaaatttttgcttataatttcaacttctattttagattcgggggtacatccacaggctcgatacatgggtatgtagtgtggcgctgaggcttggggtagaaatgactccatcacccagggggtgagcctagtacccaatgggtagtttttcagcccttgcccccatcccctcttccccctctagtagtcccagtacctactgttcccatccttatgtccataactgatgtttttagagttagattaactgtcactatacctaatacaaaattcagtctgggattgtgcctcaggctatgctccacgtctgctactactctaagatcacgtgccctctgtgaagtcactgagctgagcacaccccagggacagggaacctgatatttctcttctatgaatgcactcagcacctcacactggatatataaagaataaggaaatcacttaataattcttggattaaacaaatgaatgcatctgcttgtggaattatttccaattcagtgcaccaaacagggaactttggtatacagccaaccaggctattttaagttttgttttgttttgaaaaaagtatttactgtgagggcttagagcagttacagggctctaaacagaaattactggatactccctcccttcaggacaacgtttgacacatttccaatatcttgtcacgtacaaaattcagaagagcacacctgattcgctggcttggtggggtggatgcttaccaggagatcttgattgacaatgacaccaaggctttatccaaggtggaagttaaacaaagtaaacacggagatgctattcctagaagagaacagcatagatgctgagcgagaatgtacacagacagccactgtaacagagaagatggagaacagcgtagatgctgaacaagaatgtacacagacgcccactgtaatagagaagatagagaacagtgtagactctgagcaagaatgtacacagatgtccactgtaatagagaagatagaggagaacagcgtagacgctgaggtagaatgtacacagacgcccactgtaatagagaagatagaagagaacagtgtagactctgagcaagaatgtacacaaacacccactgtgatagagtagaggagaacagcatagacgctgaggtagaatgtacacagacgtccactgtaatagagaagatagagaacagtgtagacgctgagcaagtatgtacacagatgtccactgtgatagagaagacagaggagaacagtgtagacgctgagcaagaatgtacacagatgcccactgtaatagagtagagaacagtgtagacgctgagcgagaatgtacacagacgcccactgtaatagagaagatagaggagaacagcgtagacgctgagcaagaatgtacacaaacgtccactgtgatacagaggatggagaacagcgcagacgctgagcaagaatgtaaacagacgcccactgtgatagagaagatggagaacagcgtagatgctgagcaagaatgtacacagacgcccactgtaatagagaagatagagaatagtgtagacgctgagaaagaatgtacacagacacccactgtaatagagaagatagaggagaacagcgtagacgctgaggtagaatgtacacagacgtcactataatagagaagatagaggagaacagcgtagacactgagcaagaatgtacacagacgcccactgtaatagagaagatgcacgggatgggaacaactaacaattccccaggaactacagtaggcattttgcttttcatatatatgatttgattctccaaacaaccttttgacgtgggtattatcaaccccatctttctagagccgaaaatgaagttcaccaaatttaagttacttagctaaagtcatgatatcaaacctaggtctttctaacctcttctacctcccaaccaaaaaaaaagtttcttatcaaagcatcatgtgaaacattaaatccatgaagtctcagaaatgcaagtcatctttgaaaacaatgtttcttgacaacgaggatttcttgcccccatattaacaaggttttctcacaacatattcagcaaatctttttcattcaatcaaaatatgttatttgcttttatataaacctaagtttccatggctattgacagaaaatggtgataccaacgtgacaagtacaattcttacagacaaattaataatctgctcatccctacaagctcaagattcccctctaagtaagtctatcagtccttatatatggtagcagtaataagagataccagatgagaatatggacacatccacaaaaattgctaatccctaatggcagtcaaccttattaatagggggttaaagcaggagcattttttaaaccagcgcaagcccagcacttttctaccatgcagaaaatgggtgttcatctctctggatcagcttaagcacacgcatgctattttgtttattatttgggtcactatatctgtaacctaagcagatggtaatatgcattttatatgaaatatttaattaggccatcaaaaacatggcagtaccagctgtcacggcctgctgaccttgggaaaggaggaagtatcagcaaaatgaggatgacaatgttcagatgaaacccagaaatgaagtgtttatgaaaatctcagttgctctaacttaccacacttcaaaccaagaaatgtcacggaagcataatgatccggttcacatcaatcacctacaggtccactgggtttattaaaaactattttcaggccaggcgcggtggctcacgccagtaatcccaacactttgggaggccgaggcaagtggatcacttgaagtcaggagtttgagaccagcctgggcaacttggagaaaccctgtctctactaaaagtataaaaattagctgggcgtggtggctcatgcctataatcccagctactcaggaggctgaggcaggagaatcgcttgcacccgggaggtggaggttgcagtgagctgagatcatgccattgcactccagcctgggcaacagagactctgtctcaatttaaaaaaaaaaaacaaaaaaaagccatttttaaatgatttatactgatacatacatagaaaaactggaaatatgtactgcaaaataataattattatttctagatggtgagctaatgggtgatttttatttaatacttttacttaacgatattttctataatgtacttttatgatttgaaatatttttaatttaaaaaaacagtgacatatacatatcagtccttttatttagtactgtagttcctgaaacactgccttaaaaatccatttttctcataaataaatttgaacacatttgatcctttctcatttctacatgaccacctttacatttttcatatctgaccgccctatcattggcctatgaagctttccaatctcttagcccaagttctttttccaaccaagtcagaggactcctgctactgcaaaccccaggctgggccttgactctgcctgcaagaattcagctggaaccgagtcaactccttccccctttcctcagaggcttttccagagacttctccctttcctcagttccccaacccatcaccatctccctcaaatcatcgaaatgtgacgtattaaatccacgcacagtctcagaaatgcaattcctccttgaaaacaacagttcttgacaacaaggacttcctggtatcacgctagctaacaaaatatactccaaatccttttccattcaatacattatgatacctgcttatgcataagcctaaagcctccatggctagtgagagaatatggtgataccacagtaacaaatccaacccaatcactcctccacctcttcgcccagaaaataaagtctggaggctgggtgaggtggctcacgctttaatcccagcactttgggaggccaagatagtggatcacttgaggtcaggagttcgagaccagcctggccaatatgggaaaacccgtctctactaaaaatacaaaatttagctggtcgtggtggtgggcgcctataatcccagctactcaggaggctgagacaggagaatcacttcaacctgggagggtgaggttgcactgagctgagatcgcaccactgcactccagagcaagactccgtctcaaaaaataaaagaaaagaaaaagaaaaagaaaataaaggctggagacttaagaactttctccagtttccttccctggtccacagcaaatccctctgaccccagggctttgtttccctctcactggtccttcagtgaaattaattcaataaatatccacagagctttaatccagatgtgtgcaagatattggggatttgttcagccaccatcagacacaatctctgctccatcaattctctcccgcttctggacgccagcacctccccatggttgttcgctagagctgccataacagaatactacagactggtggctgaaacaacagcaactgattctcacagttctggagtctggaagttcaagatgaaagtatctataggtttggtttcctccgagccctctctggctggaggagccactgtcttgctgcctcctgacacggcagtccctctgcgcacatgtgctgttggtgtctcttcctcttcctacaaggacaccagtcatactggactagggtcaaccctaaaggcctcatgttaaatcacctcttcaaagaccttctctccaaatatggtcacattctgaagtaccggtggttagaacatcaacatatgaatttgcggggacacagttcagcccagaacacactctccttctcctgggtttctcacttgctcctggctcttctacctcagtcaataacatcctcaaatctttttcatatttaatgcaccaacaacccactcctagtccagatcttccccctgtcctatctagctgcttcccatcactgccaagatgtgaaaataccctaaactagaagtctcaaactcaaatatagaggagccaggagaatcctaagtggaccggatggagaacaagagagtaccagtgcctgctaaaggtggagatcactatccattgccagctaacttcagtcaggtgtgaaaacagagcccagggtatctactgtgttttgtaagagaacccagaaatatatttatatgtaatttcccaagttttatatgctgataataaaaacagaaactccccccaaaaactgtaagtgggccaaataaaataggtttataatctatttttcccctattttttccctataatctcttaaatttactttccccatttcctgacctgtcactcatcctcacattaatgaaaacaggcttctttgtaccaattccttttcccagaccccacttaaacagctaatgctgaagcccccatatcttacctgccatgcttcccttctcaagtgtgagctccttgaaagcagatcctgtgtctctatatttccagtgctgagcactgtgtccagcatagaatgtgggctcagtaaatgattactaaataaattggcttaactctttctttagaacaacccaatgaaatggaggaatgataaatcaaagaatcttacctttgtcaaagctcaccacttaatttacctatttgcttcactggtttagcaagattctggaccatcatgtcacatatatactcttacatggcacgacagcttaaaatccccacttttccttcaaatggcacaattgagcttccaaagagacaaatgctgatatcattctgtcatttacccaaaaggtccatttatctgcatgcttaacattttagaacacagtcaatcatcagaaggtaagaaaaaaattctatgaattgtcaaaataggtgattaatgttcattcattaatttcactcataagcaaactcttcaggccttgactcagaatctcctggcttttaatttttaaactattctaacataacttcatttgcaggagaaatacatcaggccagaactatcttttacatctgttagcctgagagccagacttaattcctgagataccagtgtgctgctctgcggagggggttcctttgaacccactccgaactacactgaatttagcctcttctcatctgtcacttcacttatgaactgtcaaaattactccagaagggtggagtctatgaagatgacaataaaagaagttttgtacttaaaaggaggcatggaatttagacgtaagaagacagaaacctagggtggtccttacaaggagatacagttcagctatcacaaattagctcaagaaaatacttaggtgtcatctctttctaacaaagttattttcttgaccaggaagcttccagtgttccaatgaagtgctccaaaccctcttttctttcactataaatgtgggcatggtctccctcctggagtcctttcccatgaaatatccagtacagtcatgcgcagtctagccacaactcgccacaggaaaagcacaatatgagggacagtgttcactctcatacatctctgcttttgttcaatccaggcataacaggaattagacaggactagattaaaagttcccagttccggcccagcgtggtggctcacgcctggaatcccagcactttgggaggccaaggcagacagatcgtgaggtcaggagtttgagaccagtctggccaatatggtgaaaccccgtctctactaaaaatacaaaaattagctgggcatggtggcgagcgcctgtagtcccagctactcgggaagctgaggcaggagaatcgcttgaacccaggaggcgaggttgcattgagctgagatcgtgccactgcactccagcctgggtgacagagagagatgccacctcaaaaaacaacaaagacaacaacaacaagagcaaacttcccagttctgctacactcttaaggcaagttactaaacttttctaaatcttcacttcctcatatgtaaagtggggatcacaatattaaagcctataaaagggtgaacaaatactaaattcactggtgtgatgaattacccatcatgctgtcttcaatttccacgtctcagctgaggctttccctgatgctgcatgtgtggcaaggatcgggctttctatagaaaatattgaataaaataatattcctccactgtttttaggacaacttcaattagatgtggaaatactagggaaaaaagagtagtcttaaaatgtattttataaaaatctagatacaacttaagcctaaaataaatttaaaaaaagaaaaacaaattaatccagatgacatataactaaacatcaaaatggggaaggaaggaaggaagggaaacctacattgaaatctattctaccataaaccaacatgaacacttctgaaaagaatgtaagaggagttctgggctatctcttaagtaaaagcaacaggaatcccatgggtaaagaaacttgtaataaagaggtatttagactcaaagaatctcacagaaatataagaaatagagttagggtcatatggaatgttctagtggtaccaaaagccacacaaaaatgacagagaaaaattatgtacagaacttgtatgcttgaaaaaaaagttacagtattattcttctcttgctaccaatgcaaaacaaaaatcaataaccaattctgttttcagatttttatccactgtgctgcataaaggcaatttggggactgtctgaacagaacttctaactcagcatcttctcagacaagtagatttgtcattctaaccaataaataactagtcatactgtggctaagagagcactttatatttaatgctttaataaagctctgaaaaagttgggaaaactttaaaaccttagccactttagagtaatcatattaaattttaatatagttttataaactgtataacagctcagctgatttaacaactgtaaaaagctaaattcacagaaaaataactcgtattaattattgaattcacttttcagaagcactgattcaccgaaagtgatggcagactcagaagcttctgaaggaacacagttgagttccctaaacatttcattagtgggcattaccagggaacacaattctatgccaaacgtataaggcaggttttaggacttcagattacctaaaatgaacataataatgagtagtcacttctataaagatactggatattggatataaaaattaaatatgtgttatttgacacacctattctctatgaataggctgtaccacacataaaacatcagaaaatctgaattcttgtgtgtaggtcattcatatgtttactcctgtcttttaaattcatctttatcaccatcagatcctcattacttattgtctggatgcaggtttctcttttacttacactgcctctccttccacgttttcatcgttatcagtggcccatgttagtaggttaatcttagtttgtgagcctgaagatctcttagcgctccaagatggaactggtacgtgtcatcttatttccatctaaatacagcataaggagtgaaaaaggtcaatggactgggagttactaaataaaggtgatgtggaaaacaaatcataacataggagtataagctaaaggaaagggccattatggtaatatctatcaaggacacttacaaacagtaaaagacaaaaggacatacaaagaaacgtacaacttaactaaaacagaaaagaaaaaagaaaagctctgaagtctacaaaattataacaacgatgggatatgaatcatgttttttcaattctaagtggaaggaagaaaaataaatcacatgtgcctggtaggggagaatttgcttaagaaagttttctcattttagatttgcttttggggtagatggtactttttcactatattcttcaatctcaagttttcacaggaatcacattaataagagacagggactggacaataacctggggagcagtaaatttgggggttattcttttgcattaattggtctagttaaccaagatgtgcaaactgccagagtagaagtaaatctacattctcaaaatttttttaaaaatgaagagtgacaaggaagaatatgcctcattctagcaaagtcatatctgaagagagagctgggaaaataggtgagatttgaaatttgtgtctatatgatgtaagacaattttagaatgatagttattatctcataggctaaatcaaagcacagctgtctctctgcatgcacattttgattctgcaacagaggtcctgcaagagccatcataatgccagcaaattaaataaggagagtttgaaaggcccagtcattgtgaacaagactgaggctatttcattcacttcacgtggtgaagtgcattacgaggagctgatatgactgtaaaatgtatggagacactattaagctgaaaggaatctagacatgtggatagttccctactcactaacacttcatgataatagagttaaatattctgaatagttcacttctaagggattaatacacttccccagtactcaaaatcatgtctgcctttcaacttatttgaaaggttcagtaataactcctcaaatactcactgcttgtcatattctaaatactgaattcttagatgcaaacacgcagctcctattagggctaacggaagctacatgtttgtaccaagggaaaaacatacgtctagaaaactgttctctgctgctcataggcaatcacgttgcatgtcctctcgtggacggtataaaaatgcgtgactatttacgcagaaccattcaggtgttacaggcacttccatagcatccaagaatgcattagccaaaaccaactaaagtagtttttgggctcatgatcattcaagctgaatcaataatattaaacagcatgtggaatgggggaaaaccaagtgtaaagcaacattaaaacctctttccactcaagcataattcattttgatctttactactggattcagctaaaggtcaaataatatatgatgatttagattcagaaaatatattatttcgctgttgagtatagtctgaaatgagggcaactaatttaaaaatggaatcaattttaaaaatataaatgtaataaaaatgtctccatcacagaatatacaaattaagtcccactattgattactgccaacattttaagcctccctactcatattggtaatgtctttagtgcaacttaattttcttcatattgtgtcatacacattcaatgaacatcattccagtgagggaccaagaacgaggtcagaaatggctgtgatgataaattacagaccttaataacttctgaacaatttgaaatgtaaaagccatctataagtcattcagcttgatagatgaatggttaatgaattatacaaactaataaaaaccattaattatttatctgtactacaaaatggcataaggccaagatcttaaacatggtctgcattaagaccaaaactgggattcagggtatatataacaagagggggaaaaaaagagttatctattagaagactgtataagcaaaaatcacttaagctttataagcatagaagattttattaaaggactggtcagattcataactgacagaccactgaaatattatcagcattggggtaaaaaaaaaaaaaggtaactggttgatttagatgtttccttgttcttttgctttttgttttcagtgaaaggcagtttgaaatttccgtcttagtggtttgtactgcagaacactgagatcaagacttgggtacttttgtatacttgcatttcttgctcttgcatgagtcccaagcagtgatggggggctacccctccccactaaggaataatcacattccagtttctggaaagaactcaaattagtctgactctagtgaatcaagagcaagtccaagatggaaacacaggagaggcaacctgggagggaacagactgaacaggtaaaactacagttagtagcctccccgttcatgaattacaactgacaaatgacatcttatctggtaactctgtcaaatcttcactaattcttcgacttcagtatttctcaagaatggctcttctactaccaatatcagaatcacctagagagcctgtttaaaatgcatattcctaagttactttccagacctcaggtaacaggacatattccagaggtctggaaataggtaacagacctcaccaagtgtggggctgagaaagcttttaatgatctgcccaggatattccaatgtgccctaaagtttgagagtcacagtcctaagaggatgctctccattacaccaccctgcagcaatggtgcctaccatcacacgcatagtgcacatgtcagcaacgtaagagatgccaagctcttaagtgtaacagggtgccttgaatattccctaaatatgtgagaacataggcatgactggatggataaatgcatgaaggagaaaactaacagtacttctgatataaaataggaattctgattcctttagaattggctctacagcactttgggaggccgaggtgggtggttcacctgaggtcaggagttcaagaccagcctcaccaacatggcgaaaccccgtctctactaaaaatgcaaaaattagctgggcgtggttgcgggcacctgtaatctcagctactcaggaggctgaggcaggagaatcacttgaacccgggaagcggaggttgcagtgagccgacattgtgccactgcactccagcctgggcaacaagggcgaaactaaaaaaaaaaaaacaaaaacaaaaaaaacagaattggctctacaaatccattcgcagctctccaaaaatccccaaggtgctccaaatttctcacagtctatatatttgaccgtacgatcttaacttctcaggtattgatcagagaaagtcgagaggaaggaggaaatgcagggcttcaattctgatttcgcagaaacatgagtgctgcactgctttcggccccgcatggtgtgctggcagacaccaccactgtcccaggcgcgtctgctgtgaaagccgttgcttagcaacagcaatcaatgctgtatttcctcttcaccattttcctgaagattgagacactgctccaaggtatcattttcaaataccttctgtttcactgaccaaacatgtttgttaatttttctattataggaaaaaaaaatcatgaaccaaattggtctaagaatccaggaaagaggagtgagggaaggtcagtataacaccagtgctttgggatttgtttgatgaagaaaaattctttgacagctcattgactttatttgctataccgtttcattctgccattttagcattgatttctgctacctcatgggatatgaaagtcgttagcatgaattatcattctaaatgcagatccacaaggtactgccataaaacacaaaaagcaaatgattttcagagactggttgaatacacatctcacatctctgttaaagctcttgtcttggtcatgttcttattaaccaataacaacaaaatgttaaaaaaaaataaacatctctccactgataccacaatatataattctttcagatgggcaatgtttctactaaattaattgtacctgtgatgaaagcatatagacaataccaatatttaccttaggaaaaaggcagagaaagtacacaagagggagacaaataaaagggggaagaggtagtaatttttatcaatatgtcctaccaatgaatagattcttcatataaaaccaaaaatgagacttgggaactttacatgacatcttccaataaagaaacttgatacttgcttgaagtatatacgtgcagatatgttagtaagtggtggaatccaacaaggtggatattgtgtgatatttatttttcatgtttattgaatatctactgtgtaaaaattctatgggtagcataaagatgagtaaaatgtaatccctgtacaagattgtggtaaaaaaaaaaaaagtcacataaataaatacagaagaatacatattacctcagataatcactcaagtatttagtaacaacaaatattccacttaaggtggattatatctacaacagacaaaatgagtaaatcggaatcaaaagcttttatttttttaaaacactcaatactggtaaggatgtagcgacataaaaatgcatcatgtgccagaaaagacacagggctggtaaactaaatcaactttttcaaagatagttagcaatatgcaacaaaacttttaaatatgcaaatttaaaatgctgacacagtaattgtatatctagtcaattatttcaaggaaataaagatgccaacaaaagatatttatttctgctacatttaaaataataaatactaaaatgttcaatattagaagaatgattaaatgcataatggtaataattatatgataaatgagtaccattagggtattcaagaatattttatgaaaggaaataattcctataatgttaacaggaaaaacataaaagcagccaatacataaatgcatagataaaatagtggaacaaatgaaaatgctaatgatttttggtgatttttattttcctctctttattttttctatgcgtttctaggttttttgtattgactgtctactgcatatttggtcaccgaaaaatgtcccaacaaataaaatctatcagtctcatttgacttcctattaaccgatctgttttatttcaacttagaacttcaaccctcactggtatcaagtactgccaagttgaatgatagtactcttaagtttcccaagcatttttagaccagcagtttttcatttccataaagatctaataaatttggttaatattttccacagagaatagctgtaatgaaagcataaaatttaagttaatctaaacaacaaatatgtaccaagcacaaggcatacaaatgtagacaggacgttcttgggttatgagaaatggatttcagtaacttgctctcccttcagtgtccttccagaagatatggggccttcaggtacagcatttctctggtgtcagaatatatagtctgtctacaaaaggagctctagtatcatccagggcaggtgatgacactgtctacaactgctaaccctctaccatcagataaactaaagagtgaaggatgcagagaaatgaataaaattaaaagaattctgtcaagggaaattagtattctttcaaccttcctcaatctcatatgatgtcgacacagatacacaggatatcacatgctctttttgtcagttacctgtgactatggatgctgacaaaagcacttttctaaacccaaacaccaagggccagactttccaatgcttacacagcagcatgtatgttaatacctgcattatcaaaggaggaaactgaagatttggaatggtgaagtacattggctagggtccagctcatccgcaagaagacaaaactccagtgagttttgagtcaggttatctcctaagtccgtgtttccaccattatagcacatatgatctttgagaaaatggataggagaaaggcacccattgcaaaggaataacatgagcaaaacagagcagcagaagtcaacagaacattctcaggccctgcacacccaagtttgctagaacaagggcaggggaacactcagctacctggtttgttcacccaacctgccctgtctactgcacttccacgccaggacagtggccctgttcaaaggtcaaaaccagtcccactctgatgctcccctccctggctccattctcacttcagcatgatgatcttctcatggtccctgagaatatcttagcatctgtaatggccatcggccattgagtaaatcccagttttaaacttgcctataaagaacgaacttagtgtgcttttctgctgctttctctcattgaacacagttctttctcttccttcaagaagaacctttctgaagcaccttgaatttcctagtttataatctctgtgaactcctgctatcaagagctctgcagagctagcttccataacctgtcctctttggtgactctctcgtaacaccaaaagctcccttctaacaccaacaggcaaaagatggtcatggtttaatattttaggtactgttccagaattagccagactgtggttcttaatgtttgcatctgtttgtttacagaaatggtggtattgatctaatggaacactggaacttggtctttacaatggcaagttgtggatgataaggttgaaaaagacaagagaggagtctagaaatccagtcagagattagatttcacatcccaggtcacaaaatggtagggagataatacatttgtgaaagctttatttggtaaaagaatgcaagataaccaaagaggagacaaatgtcatagcaatccagctatgagttgtgtactctgtgctggaatggtaaaccaagcatggcaagatatctcaaaggaaaaatgaacagaactgtcaattaactgtatatgaggtaaaacaaaggaaaaaagacaaagagatgagttttgaaaccaatatgttgaagctcatagtatcagctcatttatttaagtgaaatatatgaaggaattgtttaaaataaaaaccaaggaatttttaaaatagcatgccaaagtaagtaaatacataataagtatgcctccaagaagtaaggctaagagagaaaccaatttagatcagtggcctctttcaggaagagagaaggttctgccctatccagcattttctataaggacaagagaaaatattttttcagtcttccaaagacagctaccggaatatttaggaacagtcctaaaaatcaagaaacagaatcttctgaatatggaggaatgatcattaaaacaaagaggaatggagaatagcaaagccattttgcagctaaacttgctgagccccaaaattatccactcatgtttatgttagcagtactataaaacttatatatatgctctattatcaaatacatttttccactttctagtaggtaaaattcatggaaacacttaattttctttatttatgcagatttttacctctctaaaaaatgctgctgctgagctttctatttttgttcattccagttgaaatgcgatgattcatcggtcatcaccacaatggccacacgcatgtggaagagaagctcatgattctaatctgcacagttgctggcggctagatatgcctaaagaggatgtgaaacagcagcttcacttccaatggagatccggacagtaataaaacagtttcgcaatctcttcactaaatacatctttgtttgcatggtctatgtatattgtcatggggcaggtgcaggaaaatataaaatatacatatttaaaatcctactgagctgctgtgaagtcagtgacaaagaaaaacacacacacgctggggcttcatgcatgtagttaaataaataactttgagatcatcaaaaagagtcagcacacccatatttcttacttggcgctcattactgttcaaagacaccatttttttttaatgctgagccatcttaaaactttgtcaggcaacattaaattcttcaagtcttaagccctaaagaaagttaccagtaatgggcagtaacattaagttagctttgcatttaagaaaaaatatttatccatctgccttctcccacagagtactttggatcactctcagtggccatcgttctctgtcctgtcttcatgcagctgggctgagcagcagcatgccacagaaaggggccagcggaactcaactgtccaaagaaatgtccaaactgcttctgttacgtaaagccaatgtcactttccttttttaaaggaagccctggggtgtaatcctgcctgagatgagtccactgacacgacaaaaatctaaaatgtgtaactatttggaggaaagtcagtgtgtatcttccacttgaaaggtataattccttaaaagggacataaaaatattttttctattgtatactctaacagtcaataactcacaaggaaaccgaatagagagcgaaagatggagcactctggactaatgtgaaaaacaaactcaaggccgggcacggtggctcacacttgtaatcccagcactttgggaggccaacaggggcaggtcatgaggtcagcagttcaagaccagcctggccaacatggtgaaaccccgtctctactaaaaatacaaaattagccaagcgtgatggtgcacacctgcaatcccagctactcaggaggctgaggcaggagaatcgcttgaacccgggaggcagaggttgcagtgagccgagatagcgccatggcactcctgcctgggcagtagagtaagactccatttcaaaaaaaaaaaaaaactcataagcagacttcaggaaaatgccaaacaataaaatacatctccatattggacaatatggtgaccccaacaacccagatagacgcactgacaaatatcttctaaatgcatcagtacattgtttgtaccctcatttggggaaaaatatgcaaaaaagatacctaggaacaagtgggaaaatctgatatggattaggtattacagaaaatattagagaattgttactaattgtctaagacgtgctatggcattgttataaaagagaacgtctttgtttttagaatgctaacaattgatgaatctaggtgctaaatttctggttgtattccttcaccttttctgcattattgaaaatataataaaaaatgaagaaaaataaaggcataaaagaagttgtatttaaaaagagaacattaaaataaaattcatgatttaagtgataagaaagaaatatccttagagtattacagtcaagtaaagataccaggccagtaagtaaactctgaagctagctttctcactagaaacatttagctaacctgaggatcctgaactttccccttgacggagacgtgggcacaaagcactggaggctgtgtgtgggcctcatccagactggaaagtctaaaaccaaactcctgaacagacctaggattttccaaggactatatgctgtgagttagaatcactgtaaattacaaaaaatctattccacacaagggagagcaaagaagttctcaatctagaccctaaatactggacagagggggataatttttttctagactcataagcagaagttggcatctaaccaagcttgtagcctaaatttatattatctttgtgggagaagaaacctcaagcccagaaattaacctgagcaggatccaaggttgttaatgccttagttatccatcaaaacaaaaggcaaattcactcagggtgaatacaccttcaatccaggcctcaaagaatttctaaagagtgtgaacttacagcttaaaaaacaaaatcacaagccagggtaacgtagggagaccctgtctctacgaaaaattaactgggcgtggtgatgtgtgcctatggtcccagctacttggaaggctgggatgggaggatcgctcgagcccgggaggcagaggttgcactgagccgagattgtacaactgcactccagcctgggtaatagaccaagaccctgtctcaaaatataaataaactaaaaattctcacaaagaaaacaaagaaacaaagatcagtgaacaagactcagcagaagtattatattgctgaatcaactcacaaagagtttctaatttggtattatcagaatttaaagtaaatatgtttaagatgtttaaaggaataagagattgaaaatatgaggaaggataaagaaaattttttaatgtctagctaggaaaaaaaataccatctagaaatgataaatataattgtaattaaagtgctaatgtaaaaattggcaacagtttttaaatcccacaatgtcaaatgctggtgaagatggttcagtacgaatgaagtcaactttcagaaacaatttgacattatctagtgaagttgcaataagcatactcatggcccaacaattccattacaagttatatatccaagaaaaactcctgtacatgttcaatggaagataaatacatgaatgttcatggcaatgatatgtgtaacagttaaaaacagaaaataaataaactatggtacattcatagaaaacaatacagcgataaaactgaatgagttgcagttacatgaccatcacgaataaatctcagaatactaggtcaaaaaaagaaagtagacaagaatacgtacactctgacatgagtaaagttaaaaacataccaaattataacacataaaaaactgatttcaatacatacaagaaaacctgttaaaaaaaaagccagtgaaaggaacataagattcaagatagtgattatttcgtggggtggagagggagataagagagagaagcagttgtgcagctttaaaagtagtggcaacaggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccagggggtggcgggcggctgtagtcccagctactctggaggctgaggcaggagaatggcctgaacccaggagacggagcttgcagtaaaccgagatggcgccactgcactccagcctgggtgacagagcgagactccgtctcaaaaaaaaaaaaaagtagtggcaacactgtatttcttaagactggctgactgctatgcaagttgtttgtttactgttatttgtaccttatatttaaggtattttgtgtgtgttcaataaaaattatttaacaaaacaaaaaagcaataatactcacgggtatcttagccaaaagcctgaagctatactagttctgcacacaacaaacatgctttagaaaaagaggaaaccagtaacattcaggaatatcatagcaagacaatcacatgcttctggaaaatacaggatactgtggtaaggaaatgaccaacgttgtcaattctgtcccctttccagggatgtagatctccatttcacagagcaccaatagctttatctgtatgcctgggagttgtcaagcctctcttttatataggttgggcttaatttaactaaaactcctgattttcccctccaactattgatagggacagggggcagagaaattctaggcagaaaatggtggtccccaacaaaaccccaccttcaagcctcaaaccatggcccaaagtagaacttacatccctgtttccctgcttgaatgctgccttttccaaaaccacctgtggccctatcccaccccaccctgtgcctataaaaaccccagatccagccagcagagagaagagaagcagctggacatcaaagactgcagctggatgtcggagagaagcagcttgacttcagagggacagcctgacggggtaactctggagaagaatctggccagagatgaccgcatttcacaggaagattaccttcctgccccatccccttttcagctcaccttgccactgagagccacttccattggcaataaaactccctgcatttatcatccttcaattcattcgtgtgacttcatttctcccagatgccagacaagattctggagccatgagtgtgaagacaaaaaggttgtcacactgaccctttgccctcgttagcagaaggcagctgcctcatgcgaaaaggcagagggcccattgagctgttaacgcataagccgtctgcagagagcagagctaaaaggtcactgtaacactccctctggggctttcgtggtcacaggcactcccagcccccagatgcagctgcaggcaagcacagagttggctcctgccagcaaccaaaaaacactcacccaggctcctgcactcacacacctgcatgcctcctttcatgaggggtggaacgcagcagatccgactgagtggggttcactgctggtgccgtagtggctggctgactccagcgaccatgtactccacctcccaccttgttgactcatgcactccctcctgtgaggagctgagagctgcaggtgagtaaacagaacacccctgttgcaagtcccacgagggtgtcagggaaatatactgcttcattattgctgttcatttgatttcaaatataatgatatctaaacgcaattttttggcatttacgttcctctaagcccagccttaaatttagatgatgaaaatcttaaattgtcccaaatggacactacctccttccacatctgttgactaggatattgatggtagtggccattccagacgacccactgctaccatcacaccagctgcagtgaggaggaatggccgggcctgcacactccacagagcagggagaagaccccacccgccccacccgccatgctctccccaacccaccatgcagctgcagacccaggcacctgcagcctcccaaaccatggctgcagacctgggactcctgctccacgaagcaggtgggagccccacctgcctgggcacagctgcagctgaccaaaccacagctgtggatccagacatccctgcactttggggggcccaggaaggcccctgactgcactcacagtctcagaaatgcctgcttcagctgcctggcttctctctgctatcgatgcccactccgacctgggagcaaagtcagggctgagtccgggcaccatgaacagcagcaggaggcaggcaggttcctgggcggatggggcctggtcaccagtgaggccccattgtcaagccaggaagggcctgaaggctgggggctgggctgccagttccggggcatggagtggaaacttgtggtgccttttccggcccacccatggccacctatggaccaatcagtgcaaacttcctcccctctgaggcctgtaaatgccccaggctcagtcagagctgagcagactgggacaaccagctgcagagaggagctacccactccagggtctcctctctagactgagagctgcagagatggtactaccagctgcagaggggagcaacccactctggggcctcctctctgctgagagaacagacagatgatgggacgaccagctgcagagaggagctaccctctctgcctagagctgcagatgatgggacgacctgcctgcagagaacagtctcttactctagggcctcctctctgccaagagctggagacaacggaacaactagccaaacagagaagctaccctctctgctgagaactgaacactcgttgggatgacctaccagcagaggggagcaagtctctctgctaaggagctgaacgctcattgggacatcctggctacggagaggacctgcccactgtgggttttctctgagttgttctattgctcagtaaagctcctcttcatcctgctcaccctccacattgcatacctcattcttcctggtcacaggacaagaactcaggacccaccgaatggtgaggctaaaagagctactgtaacacaaacagggctaaaacatgccccttgctcgccacgttgtgggcaaagagaaggagaaaggagctgcaacccttcgggtagcccagacctgggagctccctgagccagggctgtgagcccttctttggggccctgtggttcctggcatctccaagtttccgggatgtcaccacattccccggtgccagacgggaaagccgcttgcagtgaacccggtccagccacagcctcacagagagctggtgctcacgccagcacctggagctgcccacaccatagcagcagctggtgtgtctgaccgcacagtgggcggaccccacgtttgctgacacacacccctcaccactccatgcctgactccagactccctttgaagcacgggatccaggctggtagcatgagctgagcgcagcctgccagggcgagtgggtggaacaagcccagcaggtccaagcaaaactcaggcaagggcaccaccagtcacatgtttccggccagaaaagtgacaccccaaagaccccatgacagtatgacttatatcctgttatattgtctcatcacaattcacatagggttgaatctgctattttgactgtttgtgatgttttggctagcatctgaacagatgggcagtttttcttcagtatgactatttgccaacaattggaagggtgtaaaactcattctcagagcaacccaaacataactacaaggagtctaacagataaaatatccactgttgtattcagaaatcctgtataaagtgccagtgaattaaaagaacactttggtaatgtggttaaatgaatgctactaataatcataatagaactggaaatttgtataggtattgtgttcacattcatctgattatcatagctctaagaaatagatattacaggtattattacggactttattatcgacaaggaacaaagcacagagagatccatattacagaaaatggactgaactcagaaataagaacaggatttgagccgatctgtgcctcattagctgtgtaaacttaaacaagtaacttaatttctcacagcctccattgcctcatttgaacacgcaagcacagtgagacctaactcacaaggtcctcctgagaattatataaaatatataaaagttatcagcaagagctcctgtcatagagtagattcttcatgaatatatccttccttaatttatgaaatcctccttgataagaagaagtcaaaacttttatcattactcttttcacaaaggagtcaaaggtgatttcaatttagggaaaaagaaaagtttagacctaaaacattaatataaactgaaggatgcaaagaactcaatgttctacaatcatacttcagtggcctctcattgtctcctgaagaaatatacagaatataatgagtgggtcaccatgcggtttagaaggggcagagttgtcctacagtaataatcacggtacatttgatgctaaatcgtatgtgctctaatattgtaatttcacatctaatacatgaaaatctttccaatgaagttagtttattccctatagcatgaagatagatgaagttaaatagtttatttcctatagcataaagatagcccttgacattcattgtcacacatttcctgtttctgagatcagtaatttgtagattccttcctgaaggttccagcaaagagcttttacccatctgcccaactcctttgattcaagacagggaggggaacagaggtctcctcaggaaagagagtctcctgtacccagggtgaggagaaaagtggtcataaggaagccgtggggccacagatgtatgaccactcacaactgattcagtgagccaagaagacagcagtgttgccagagatggaaggtgttctcagaatgctaacaggacttgctgatgaaggggatggtggtaggggatgacagaaagaattaatcaagagcgatgccttgattttggtcctgagcacctgactgggagtaactactgaactggaaaagatagaggcagcctgagtctcctgtaaaattcagacaccttccaatctccataattctagtttcttgttcctggacctcttgctttagggaggcatatagcactttacaaagtatttgctcattttgtcatcttatgtatatactgaaaatggagtcagtgtcaccagaaaggacacctaatactccttgcttttcttatggacctacgactatactataggtgctgaaggtacctatacctatactattggtattgaagggacacaaagatttgacctaaccttagagtcactttgtaggactactaccccttctctgttttcctccttcttcattaactcttcccttacctgacaagcacagctgactggaattgtgtacactaaatggtcctttacaatacggaatacttcagtaattacaatatgctggaattgctaaattctataatttcatttggatgaacttaatcacatcatagcattcaatttggcttattttcaaaatcagcttcgtttataaactaaaaagaactgaaggattcttttcattttcaagacttctcatctgtaagaggatttagattcttctatttacaagcattcttctgagaatctttcattctacacacaggtttctttgggggttctgttttatcttttttcatacactgcctaccagagagaacaagactggcaaaaggactctgtcctcataaagctcagagacgatgaacagataaacaagtaagtgaacaaaaatacttcagataatgctaaatcctccaaggagaatatgatacagtagatgtaatgggaagctcctttagactgagtggtcagagaggacctttctggggtggggtgtggcatttgaactgtgccctgaagaccgaagcagtacaagcacaggaattagcaactgcaagggctctgtttgataatgaacttggtaggttaaagggacagaaagaaagccagtgtggctgaggtgtggtcaaggggatgtatccaaagtatagcaatacatcagagaggaaacccaggggcagatatattagtactgaaatagcataagggattcacactgtattctaggtgtaatggaagtcgatggaaggttttaagggaaggtgcagggattacctaattcatattttaaaaggtcattgtgggcgccactgagaaagaatatagaggagcaggaaaggaaggaggaggaggaaggacagaaggaagactactatgattgctcaggcaagatatgatgttacgttagactatactggtggcaaagaaagcaggggaaacagactttagacatattttaaagaaaatgttaataggacttgctaatgaattcagtggtgatgggggtaagtgacagaaaaaaaattaagagtaatgactagatttttgtactgagcacttgactgggggtaattattgaggtgggaaaaacagaagcagaaaaaggaaggtggcagagggagccgaggaatcaagagttctgctctggctatgttgagtttgagatgcttttcaaatatccaagtgaggatgaaaccagtagatggctggacatacgaacgggagctcagtatagcaatcaaggctggagatacaattttttttttagtatattggcatcaaagagggtatttaaagtcatagaaataaattagaatcctttaaggagagggtttatttaacgagaaagaaaggagaagaaagctcaggactcagcctttcataattccagtatttaaaggttaaacagagcatcaacagccgtcaaaagatgttgaaaagaaatggctaaacagagggaaaaacaagaagagtgttgagtactaggagccaagataggggtcagttatgtggaagactgctgaaaagtcaaaaaaaaaaaaaaaaaaaaaaaaaaaaaaaaaaaacagaaaagacaccagatttggcaagactaaaggtctttggtaaccttattagaacaactgtaatgaagtgtcagaaaagaaagtcccattagaatgggctgaaaagagaatggaaggtgaggaacaggggagaaggaagagacaataactacatagcagtcttttcagaagttgtgcacaagtgtgtgagagagctagagcacaggagagcgagcccgcaccagcacacacttaacacaggtgacaacagaagttacggaaagacagtgtctctggagcatctgtaatcatctccttctttgttttcctcttcgagtcattctgctgaagttcctgaataaaccatacggatctacaacatacatacatctcagacctagtatctcttttgttcaatctctccatatttttctgccaaatctaatcagaggttttgcggagggattcgtaacaactatattcttcatttttaaaaatgtgtgcaaaatagtagcattcggtaaatattacaagattgcaaggctagatgtatctcaaagaacacaatacaaaagatgtaagatgctcttctaactggaaatggtggaaacttcattatgaatccaatttccaaattatttccaataatgaaggccaatgtatgatctagtcacctttgacaagatcggtttccataatatgtttacttgctttttttcacactgtctcccaatctgttctttgaagtttcttcttgcctaaaataaacttccacacacctgctctataaacccgaactcaaagtgtagcatttttacctccataaatgttttggacactatgctgacagaagaagaagaggaactaaatgacctgtgaaagcccctgttagttgcttcatactgataccgaatttctaaatgtattataaatgcatttcacagcattccattaacatgtcagaggactttcttttccactaagcacactttgcatgagttaaatatcattcttttaaatttacataaagacaagttaaagatgaggccatgtactacagatttatttaatctacatgagacctaagatatattttcatcaatggctgtgctagaataattataaattacagaaaataaaacattcagttagtggtatagtttgcctagaattgattttttgatgctgattatataacccattaactgactaaaacttcttcactcgagtcactgcagcgtctgccaccatttgtgttagtgtttacacataaagatcacacacatttgatgcgtccactttccttcaaatatgggttagagtggaactgggaaacagaaccatttctagtctttttacagctttgttattttgatttttaaatttacatttggaataaagagaaactctgctataagaatctcatactaacctctgaataaagtggagatatgcaagtactccaagaaggcaacagaattaaatatattttctatgaaagatattaaaaccaaaagtgtttaataatcttcattaatgaactttaaagctcaagaagaccttataaatcatctagttcatcttccttggtttcaaaatctactcttgaatttatttagcattatgagattattagatgaggttatttattctccctaattttaatattgataattaatctttaataaatgcttgtgatttttgacatattaaattctaaacctcaacatttcaaacagtcttagatcatgaagaatattaaccaagtccaacgtcccatatactttgtagtaaaatggtagaccctgaggtgaagtggggcaataatttcatgagaacacatcacagtacatggttagatgtactttccactttttcttctactagaaaactaagtttctgttttgggaagtgctggctttgtgttctgcccgtttatgctttaatttcagctcatgcactggggcgccctcaggaggattaaagaagacaactttggccgggtgcggcggctcacgcctgtaatcccagcactttgggaggccaaggcaggtgaatcaagaggtcaagagatcgagaccatcctggctaacatggtgaaaccctgtctctattaaaaatacaaaaaattaaccgggtgtggtggcgggcgcctgaagtcccaactactcaggaggctgaggcaggagaatcacttgaacgtgggaggcggaggttgcagtgagctgagattgcacaactgcactccagcctgggtgacagagtgagactccatctcaaaaaaaaagaagagaagaaagaagaagaaggaagaaggaagaagaagacaactttgagtggtggatgaaactccgtcctaaagattccaggctggagaactgggtccttttagccatcttattaacagtttgaacttgaagagatcacttaacctctccagccactctacctttatgcataaaatgaaaataatattagtttacacataagtattcaaataatttcctaaggtctcaccgatctctaaaaatctgtgataaatattttcataaaatagatttggcatcatatgctatgttatttatatttacctaacaccacatttccttatttttattccttttttttttttttttttttttggagacaaagtctcactccatcacccaaactccaaactacagagtgcagtggcagatctccactgactgcaacctccgcctcccgggttcaggcaattctcctgcctcagtctcccgagtagttgggattacaggcgcatgctaccatgaccggctaatttttgtatttttagtagagatgggttttcaccatgttggccaggctggtctgaaactcctgaccttgagtgatccacctgcctcagcctcccaaagtactgggattgcagacgtgagccactgcgcccggcctcacatttccttatttcaatgtttacttcagaaggccctaaagcagggcaattcaactggcttccatgtttacttatcattaaaagttatcttacaggactcttgggattgtgtcctttttaagacaacacaaagttcatagagtaatggactgtgtggtactcctacccgaggctccaacattttgaggcataagaaaatcaagtatctggttctgatttccactctactttgttgccatttttagcaacagttgatggcacttgacctgatctctttcctggtccattgcctataggtcaagctgacagcagcataaaaccctaaacagccataactttttagtatctattaatagatacattttatggtggctgaagtgacaatctaggttcctttggttaagaagttcaaaatctttattctactgctattcctttctgtataagtttctcagagaaaacaaggtgtttccagcagcaccatcactttatgaaaaaaattaaacctccatcatctaaatataatgttttttctaaaagaagccttcttttttttagtatgtatattatttttagatacttccattgctttaagaagttcccatgatctttgagacaaaaatcaaaacatctttgggatgacaaaactaaaaatgaataaatagataaagtggaatttttgagccaactttttttacattttcatacaaatttcgaagctacaattaacttcatttagaccatgaatagcaacctaatggggctgtaacaatttccacaaataaagctacactatttgtttcacattcactaaggatgactattactctaaatgttcaattagttcttcatttattttaaaattaaattcattataaaaataatgttagaatattatccaataaattttctttgctcaccttcaaaaattctacattaccgttctcttgagaaattctacatttggtttttgttcctcatcttatcatcctgcaataattctttgaaatccatttatcttactaattttaaaaaaaagggattagtgtctatttaaatcaaataattagtaataacctattgaataagtttgtgatagaaggtgttacattgtttcagtctacctgccattgaacaaaataatgccaataatttacttaatcctattgaaatttaaattttgcaactctctttatagaaggataaagtttacaattgccctttatccatcttatagagatgatgcaaagttaaattatgcactaccatagtctgttttcgcagttataatgaaatacctcagactgggtaatttaggataaacagttcacagttctggaggctgggaaggtgctaatatccagcaaaggacctctgactgcgtcatctcgtgacagaaggcaaggggcgagatacagcaagagggggccgaattcaccttttatattgacaccaatcccacccatgagggtggaactctcatagcctcatcacttcttaaagtttccacctgttaatactgatatagtggcaattaaatttcaacacgcattttggagggacaaacattcaaatcatagcacgtgcctttcaagcgttttgaggtattcagaaaatggcaagatactagaagtattttaatgtgttcctaaaacattaaacctaaaacagacttatatctaccttcagctctaaaaatctgggccttcaagatttttccaagtgttaagcaggtggaccccaaaagtgaggcacaaacttcacattatccaaacacatgacaacgtttaatatcacagtatttaaatgctactctaatgaatgtgtgaagattttctaatctggtaattcaccgaacttttaggaaccatgacttttcctaaagccatgacctggttttcttctgaactacatgctattctgtatataatgctccacatgtttacaattgctccaagtgatcaattcattaattctcaaacaaatgacatcaatctttttttcacatgtaaagaaacaaaggcagaaagagaaagaataggccatttccctttaatctgcaatcgctcaccagaaagatttagtttgcataaacacattcaagaaaataagcgaaaataaattttaaaagaagtacataggaaatgacaacgtaaggaaaatgggaaagggaagagagaaccaggagttaggctagaatgctgtcctatcttgtgcattgccaactctggagagatccaataatcagtccaaggtaccacacaggctagacctgaactcctgggctcaagctatcctcctgcctaagcctccaagtaactaggactacagtcgcacacagtcagaactagcttgttggacttatttttgtcaaagaatagtatcataatctttgtgcctctcttgattgagaagaaattctcccagagcagaactgtcctatagaactttctgcaatgatacaatcttttctatcagcaccatttaatatggtagccactggccacacgtggctgttgagcagttgaaatgtgtttagtgcaagagaaagacttaatttttaatttgattttaattacttaagtagtcaaatgtggctactggttaccatatttcatagtgcagttctgatacatatgtacagcaaatcacagcaaatcaatttctctcacagtagtatctctctcagttactcagtttcctaactttgacagaactatttatcatatgatgtatattttcacctgaatacttccatatgagtctctattttattccagagaatttttccgattacagacttagtgtacttttggccagtgagttgtgtgggttattgctaagcatggcattggacgtgctcggatgcttgtcttcattcattcctgaaagcagtcttattctctaaaactatccatcattcttactcttctctctcatcccagctgacatgccactttcaaataggtatattttctctggtttcctgcttttctgatatagctgtggatacatggagagtgtaataaacgggttgtccagaaaggagcttctgtagtcactgggcagtagatatcagcatcagcaatagatctatttaataaaataagtaaatatatatccccactatatggaagagtataatacataaaagcatgtaatataacaaattttatgcaccaataattttttacagtattcagaaaagtttctacatagtaactataaactacatattaaaaattgttttctggtcattgctataatgtacacacacattccaattgacacacagaaaaaagaagttactttctttaaactgcaagggaaatatcaaaataacatcacgaaacatttcataatatcctagagatagtatctcttacatttcaaaactgctttaactcatatggggctccagttcatcagaaacaggacttgatacaaaaaggcatggcatgaatgataattactgctttgggtacaaatctgcacacattacatgcaagatccaatataagtcaacttctcacagcaatcaatttttcaaaaggaagggtacaaccaatgtttattttatgttaaggagaggaaatcaaacaaaaggggaaaaagtgagatgaaaattcttatgctccagttgagtttttccttgggagcactgaacagattttaggaaatttagcctaattttgctatggcaacagttataacacttgagaccacagtccaggagaagcgcagcatttattctcttattgcagcactttgatcctttccgagtctaacttaaaagccatagtttttaatgcaaatgagaatacatacattgagattcgggaataattagaatatttatatttgtaataaatccaatggaagctcttttgtgacatgaagcttactcagtggttagggggttaatgaatgaaatggatcactggactgaaaataaaaatcactatttaaaacgaaggcgacaccaggagaattaggcactacataatactgtaaccacggagaattctcaacagtaaaataaagccctgtagtcccagcattttcattacttttccagtagtgctggatgcagtgtgaatttcaatgaggtgggaaacagtggctgctccctttaaagaacatataccacacagaggaaagaacatataccatataccacagagaggagaagcactccttcaattcacacagtgatgaacatattccacagagaggagaagcactccttcaatccacactgtgatgaacatataccacacagaggagaagcgctcctcaattcacactgtgatgaacatataccacacagaggagaagcactccttcaattcacacagtgatgaacatattccacacagaggagaagcactccttcaatccacactgtgatgaacatataccacacagaggagaagcactccttcaattcacacagtgatgaacatattccacacagaggagaagcactccttcaatccacactgtgatgaatatataccacacagagaagaagcgctccttcaattcacactgtgatgaacatataccacacaggggagaagcgctcctcaattcacactgtgatgaacatataccacacagaggagaagcactcctcaattcacactgtgatgaacatataccacacagaggagaagcactcctcaattcacactgtgatgaacatataccacgcagaggagaagcgctccttcaattcacactgtgatgaacatataccacacaggggagaagcactccttcaattcacactgtgatgaacatataccacacagaggagaagcactccttcaatccacactgtgatgaacatattccacacagaggagaaacgctccttcaattcacactgtgatgaacatataccacacagaggagaagcactccttcaattcacactgtgatgaacatataccacacagaggagaagcactccttcaatccacactgtgatgaatatataccacacagaggagaagcgctcctcaattcacactgtgatgaacatataccacacagaggagaagcgctccccaattcacactgtgatgaacatataccacacagaggagaagcactccccaattcacactgtgatgaacatataccacacagaggagaagcactccttcaatccacactgtgatgaacatataccacacagaggagaagcactcctcaattcacactgtgatgaacatataccacacagaggagaagcactccttcaatccacacagtgatgaacatataccacacagaggagaagcactcctcaattcacactgtgatgaacatataccacacagaggagaagcactcctcaattcacactgtgatgaacatataccacacagaggagaagcactccttcaattcacactgtgatgaacatataccacacagaggagaagcactcctcaattcacactgtgatgaacatataccacgcagaggagaaacgctccttcaattcacactgtgatgaacatataccacacagaggagaagcactccttcaatccacacagtgatgaacatataccacacagaggagaagcactcctcaattcacactgtgatgaacatataccacgcagaggagaaacgctccttcaattcacactgtgatgaacatataccacacagaggagaagcactccttcaattcacactgtgatgaacatataccacacagaggagaagcactccttcaatccacactgtgatgaacatataccacacagaggagaagcactccttcaattcacactgtgatgaacatataccacacagaggagaagcactccttcaatccacactgtgatgaatatataccacacagaggagaagcactcctcaattcacactgtgatgaacatataccacacagaggagaagcgctccttcaattcacactgtgatgaacatataccacacagaggagaagcactcctcaattcacactgtgatgaacatacaccagaggagaagtgctccttccactcacactgtgatgaacatgtaccacatggaggagaagcactccttcagttcatactgtgatgaacatataccacacagaggagaagcacttcttccattcacactgtgatgaacatataccatgcagagaagtactccttccgttaacaccatgatgactatatactgtacagagaagcactccttcagttcacactgtgatgaatatacaccgtatagaggagaagcactccttcaattcacactgtgatgaatatataccgtataggggagaagcactccttcaattcacactgtgatggctattggcctatccatgccactatgtagtttacattttagtatcttaaaatatttcatataatagaatattgcatttaacttgcaagaaaggctaaacacctagcataacaaaccatggtgcactgtaaatgttaatttaaaaataatatatacaaatcagttacagcttagacaagaaacctctttgactacacaatttggaactagaattatatattatatttaaatgtatctctttaaaccaattcaaaagcaacatagagagactaaaacctgtactgaagaaggaaaatcaggtcattacccatgagattgcttcagttcaaaaagagaaagcaggagtaggtgtgaaaatgcacagattactgaaaagtggaatgtggcgttaaatcaaatcttacaacatggaatcacgttttactttgcattaggttcctatgctcctagtatcaaaactaggaggtcctttgagctactaacttagtaaaaactaaaagtcaaacatttcactaatagacctgcctctaagtataaggttgaggcagaagatatacaatcatagaagaaaagacaggagttaataccgctttccccactgtaactggaaagtgtcataaatcctacattagtttctcacctaacctccctatatttagtcattccagtgccccaaaattgaagaattagtctcaatttctactggaatataaataacacatcagcttctagccagataattacgtccttcctgaatatgttgcaaaagtgttattcattgtggagaatgcagaattataaaatacaacccgactctcaaattacttataatctggttaggaatacctaactataaaaataaacacagttgtgggtctcagctgggcaacagtcaggctctgcaggatgtctagatagacaggtaggtagacagacaaaaagacatgtatggtgagccacctccagctcacaggcagtatcagactcacagtagtaccaactcaaaacagaccttcccctccgcagcattccgcatgccccacattatgctagaacctctatttgaatttttcttctagagcaaattcctagcctctcctctaggaaggggagggctggggaaagagcccttggggtcttttcaaggggttcactgaccctacaagctctaagctctctctacagctgtgctgtccaatatggaaatcatgagccactgagtggctactgggcacttgaaatatggctagtgcaactgagaaactgaattttttatttaatttaatgaacttaaacagccacatatggctaatgactacaatactagaaacaagatataaaacatttccatcatcacagaaagcactactctacagagtaaagacttattataattggatatatacattcctgaaaaatgtggtatataaaatattataacttgagggctcataaggcagaacactcaaactctatacagtattataaccaaatccctaaaaagtaagaatcccaacttttaaaactagcgtgatttttaaaagacatttaattcttaataaagaaatattatgataaataagtatacatttaattatttatttatggataaatgaatgaatgaaatgaatgacagggtctcacaatgttgccgaggctggcatgccgtggcgcaataatagctcactgcagcctcaacctcctgggctcaggcaatcctcccgcctcagcctcccagtagctgggattatagacacatcccaccacacctggctaactttttttatttaattaattaatttatttattttttgagatggagtctcactctgtcgcccaggctggagtgcagtggtgcgatctcggctcactgcaagctctgcctcctgggttcacgccattctcctgcctcagcctcctgagcagctgggactacagaggcctgccaccacgcctggttaattttttgtatttttagtagagacagggtttcactgtgttagccaggatggtctcgatctcctgacctcgtgatccacccacctcggcctcccaaagtttttttatttttctgcagaggcggcatctccctatgttgcccaggcttgtctcaaactctggggctaaagtgatctacccacctcagcctcccaaagtgctgggactacaggtgtgagccaccatgcccagccaaccatacatttaaaggttaaagtagcttgaaagaaggctgtaagaaaggtatctaaattctgaaaatgcacaaagactgggaatactatggccaaaccaagcgagagacaagaggtctcgggctcactgtttctccattcctccaccttgctgggctgtgctggcgtttactgcactttgggtttagctgctaccacttgatgaagaaaaccattaatacatcaagaaaaaccacttaataaaccaaagagacgaccacattaactcaatagcatccccccacttgtcaattctatgtgaattaattcttgtcatagaaacatgagtaggcgcagaaaggacttcatttggcagacaggttctctgtgtgtgttccctcatactccccgatataactggtcgcagctccattcccatctcagtctatcaaaaaaactatgcctgctgctcaaggcttttctcaactgataccttccctttattaagcctttcctgaccatcgcctccaaccaagatatgaggaacacagacttttttctcctaaagatatttttactcacacttcacattaaatttaacacatacttatggttgttgttctattactgttattactagaggtagcttaggagggctgctggaaattcaagggggaaagctaaaacttcccagggctttgtaacatctcttcagactggattttagtcctaattctgccaccagcttcctggttaatctcagtaagtcactccctccccgtttctgggctttaaacaaactcatttttcaaaatatctttattattgtaacttttgaatgacattttaaaagtccctgtaaacctctagtatgcacagaactttaaaaagctgaagtgagaatagccttctagactttttgccacatgaatatatacaaacataaaagcattttacactgaattagaccatgccatccgtatcgtactgtgacttagtttactgtattcacttaaaacttgatttcagtacacaaagaaatctcctgcagttgttttacctgctgcattattagaaaaaaatataatttaacaatcccccattgattaaattaccctttaaatgtttaagcttttcttaaaactaggaaagtaatacatgcatttttttaagtattgaaaattttcctttccctaatacactctatcttgggtgataaaattttctaaagagtatcttctgttttttcatttttctcatagataccactggggtttctttctctttttttaagacaaggtctggctctgttgaccaggatgaagtgcagtggcacgatctcggctcactgcagcctcaacctcccgggctcaagcaatcctcacacctcagcctcctgagtagttgttttttgttgatgttcttgagatgggtatcattgtgttacccaggctgcactcgaactcctgagctcaagcaatctgcccgcctgagcttccgaaagtgctgtgattacaggagtgtgccaccacacctggccaggtttcaacgatgcattcctatatttacttcttgacttttgttacagcattattttacactgtcagtgattatttttaattcattaaattctattccataaatagatcccagtcctctgtgctttctcagttgatttttggagacagatagtcaacaggcagcattcacaatattataattatatatctattactcactgtagaactaagtattgtggaacagctccacaggggaggaaatgcaatcttatgccattcaacttctcctgtttgaaacaaaatatcccaagagtcaagcagatttcattttcgtttttttgcttttctttactttacctgcaattctttcttacatctcagattatcttctttcttggattcttctaccatttcattgcagaaactccttacatatattatttcatataagaagcctagataattagataaaaaatagcttatatccatgcatatttgagtatctttctatcactgccttcttacttaacaaatagttttggctacatgagatttttggttcaaagttattttctttgtttggtttttttttttttttttgagggaaattactttttacttcagtgcaatttactggagagacgaactgtgcaagtagagatgcctgatgagcgtcacacaacgttttcggtggatagtcacgacacttgagcccaccacgaaagcaacgggaggcagctgcaatattccagcaggacagtgtgtactacagtgagttttaagcagttatgattttttaaattatactttaagttctaaggtacatgtgcacaacgtgcaggtttgttacatatgtatacatgtgccatgttggtgtgctgcacccattaactcatcatttacattaggtatatgtcctaatgctatccctcccctctacccccaccccatgacaggccctggtgtgtgatgttccccaccctgtgtccaagtgttctcattgttcaattcccacctatgagtgagaacatgtggtgtttgattttctgtccttgcggtagtttgctaagaatgatggtttccagcttcatccatgtccctacaaaggacatgaactcatcattttttatggctgcatagtattccatggcgtatatgtgccacattttcttaatccagtctatggacacttgggttgattccaagtctttgctattgtgaatactgccgcaataaacatacgtgtgcatgtgtctttatagcagcatgatttatactcctttgggtatatacccagtaatgggatggctgggtcaaatagtatttctagttctagatccttgaggaatagtcacactgtcttccacaatggttgaactagtttacagtcccaccaacagtgtaaaagtgttcgtatttctccacatcttctccagcacctgttgtttcctgactttttaatgatcgccattctaactggtgtgagatggtatctcattgtggttttgatttgcatttctctgatggccagtgatgatgagcactttttatgtgtctgttggctgcataaatgtcttcttttgagaagcgtctgttcatatcctttgccaactttttgatgaggttgtttgatttttttttgtaaatttgtttaagttctttatagtttctggatatcagccctttgtcagatgagtagattgtaaaaattttctcccattctgtaggttgcctgttcactctgatagtaggttcttttgctatgcagaagctctttagtttaattcgaacccatttgtctactttggcttttgtttccattgcttttgctgttttagtcatgaagtccttgcccctccctaggtcctgaatggtattgcctaggttttcttctagggtttttgtggttttaggtctaacatttaagtctttaatccatcttgaattaatttttgtataaggtgtaaggaaaggatccagttttagctttctacatgtggctagtcacttttgccagcaacatttattaaatagggaatctttcccccatttcttgtttttgtcaggtgtgtcaaagatcagatggttgtagatgtgtggtattctttctgagggctctgttctgttccattgatctatatctctgttttggtaccaggaccatgctgttttggttactgtagccttgtagtatagtttgaagtcaggtagcatgatgcctccagctttgttcttttggcttaggattgtcttggcaataagggctcttttttggttccatatgaactttaaagtagttttttccaattctgtgaagaaagtcattggtagcttgatggcaatagcattgaatctacaaattaccttgggctgtatggccattttcatgatattgattcttcctatccatgagcatggaatgttcttccacttgtttgtgtcctcttttatttcattgagcagtggtttgtggttcgccttgaacaggtccttcacattccttgtaagttggattcctaggtattttattctctttgaagcaattttgaatgggagatcactcatgatttggctctctgtttgtctgttattggagtataagaatgcttgtgatttttgcacatcgattttgtatcctgagactttgctgaagttgcttatgagcttaaggagattttggactgagacaatggggttttctaaatatacactcatgtcatctgctaacagggacaatttgacttcctcttttcctaactgaataccctttctttctttctcctgcctgattgccctggccagaatttccaacactatgttgaacaggagtggtgagagagggcatccctgtcttgtgccagttttcaaagggaatgcttccagtttttgcccattcagtatgatactggctgtgggtttgtcataaacagttcttattatttagagatacgtcacatcaatgcctagtttattgagaatttttagcatgaagggctgatgaattttgtcgaaggccttttctgcatctattgagataatcatatggcttttgcctttggttctgtttatatgatggattatgtttattgatttgcgtatgttgaaccagccttgcatcccagggatgaagccaacttgatcgtagtggataagctttttgatgtgctgctggattcggtttgccagtattttattgaggatttctgcatcaatattcatcatggatattggtctaaaattatcttttttttgttgtgtctctgccaggctttggtatcaggatgatgatggcctcataaaatgagttagggaggattccctctttttctattgattggaatagtttcagaaggaatggtaacagctcctctttgtacctctggtagaattcagctgtgaatccatctggtcctgaacttttttggttggtaagctattaattattgcctcaatttcagagcctgttattggtctattcagagattcaacttcttcctggtttagtcttgggagagtgtatctgtcgaggaatttatccattttttctagattttctagtttatttgcatagaggtgtttatagtattctctgatggtagtttgcatttctgtggggtcagtggtgataccccctttatcattttttattgcatctatttgattcttctctctattcttcattagtcttgctagcggtctatcaattttgttgatctttccaaaaaaccggctcctggattcattgatttttgaagggttttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttgtgggcacttaatgctctaaatttccctctacacactgctttaaatgtgtcccagagattctggcatgttgtgtcttcgttctcatcagtttcaaagaacatctttatttctgccttcatttcgttatgtacccagtagtcattcaggaacaggttgttcagtttccatgtagttgagcggttttgagtgagtttcttaatcctgagttctaatttgattgcactatggtctgagagacagtttgttataatttatgttcttttatatttgctgaggagtgctttactgagaccatcgatgctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtatttaggagacctatctcatgtacagagagacatacataggctcaaaataaagatatggaggaagatctaccaagcaaatggaaaacaaaaaaaaagcaggggttgcaatcctagtctctgataaaacagactttaaagcaacaaagatcaaaagagacaaagaaggccattacataatggtaaagggatcagttcaacaagaagagctaactatcctaaatatatatatgcacccaatacagaagcacccagattaataaagtaagtccttagagacctacaaagagacttagactcccacacaataataatgggagacattaacgccccactgtcaacattagacagatcaatgagacagaaagttaacaaacatatccaggacttgaactcagctctgcaccaagtggacctaatagacatctacagaactctgcaccccaaatcaacagaatatacattcttctcagcaccacatcgcacttattcaaagttatttatctttcagaactttgaaagtactgttccgtgatcttctagaattaaatgctgcatatgagaaatgtgattttagtccagttcctgcatgttttgtcacttattttttccctctaggggaatatgttggtatatatatattttctatggagttctaaaattttactaggaataattgagtttttgacttttttaaatcatgtgattcaacacatagtgagccctttctatctgaagaattataaggcttttttcagctttgtgaataatgtttttatcatttcattgactatttccacccctctatcttaactatcacctgcctctggaaatcctattagaaagacgttggtcttcacagatcttaacccccaagtttctaatttcccaaattatccattaatcagttatactgtacattatatatatgaatattctgggaggtttcctgaactttcctttcaaaaatcagtctttggctaaatctattctatttgttggcccatatatcaaatgttttgttatgaaatcattctaattcttggaaagagttttaactatttcaagattattttgaatcttactttgaaagtttggtgtagaaagaattcttacttgatggactaagaacacaagagattgagagttaagattagaaagaaataacattctacacgttttgtaaaaggtggggattttttccttatttttaaaaaatgaataaaagccaaccaatctttgttgggcatggtggcaaatgtctatagtcccagctacttgggagacatatatgtgtatatacatatatatacacgtatatatgtacatatatgtgtatatatatattttaacatgggactcatatatatatatgagttaaaaaaacattttatttcattaatatctcttgtacatgggaaactgtcacaaagcagtttcttctctttttactatactctaaacatagactatatataaaagaggttagctatagttcctgagtcagctactcatcactcatttcccacacctaaaagaggccaaggacacttaaatgtaaattcattgtacttttcacctttttgagtgaccccattttataggtatcttggggctagctatttgcacatcagacttttccattctgaaatgctgactcaattcactagagagaaggattctacttgtgagtgtggaaaaaaaaaatcctgactttctagatcattttccctattcactttggataataccactttataaataggatttgatgcatgcaaagcagcaatctgaaaggaccggcagtatatactataagcacttattatagtatttgtaaatgccttattaatggcaaaatagctttgaaaccatccatgatatgtaccacagctaactcaatttgacagtgaaagatgctatgtcagtctgttatggcagatataaaacatgtaccatatgagtagatccttggcatatgttataaaaattacttttgctttatattttctagttgtgtaaaaagggacaagaagcactcctaacactgttttcattggactcttccacactgccttctgttgcctactataaacagttaaatatatcttcttttactatctggctacagcagttttctgtatataaaaatttttccactctactatgaattgggtttatatggactccatctaaacattattcatgaactattctgaatacataccaaatgataccccagtgatcttcaaaacgctgaagtttcaattttctttaattctgctatcaggccaggcaaagcattcatctcagtgaggcagcctgcctcttaggcatcattaatgttttagattttcataaattccactacggctaaatagaccaagaacctgaactccatagagttcctaaaagaattcagcagctactgcctttttttttttttttttttttagttttatttccaagatgaagtttaaaaataagaataaaaactggcaacaggccagacatggtggctgaggcgagcggatcacttgagcccaggagttgcagaccagcctggacaacatggcaagaccctgtctctagtaaaaacacaaacattagctaagtgtggtggcacatgcctgtaatcccagctattcaggaggctgaggcacgagaatctcttgaacctgggaagcagaggctgcagtcagccaagatcgtgccactgtactctagcctgggtgacagaacgagactctgtctccaaaaacaaacaaacaaaaaacagaaatactgggaataaaagtatttttgaaacatgtagatcctcttttattaagaaagaggcagacatctcacacttaggaaaatctcaacccttaaagagagaaatgaaatagaaattttacaaatcaaaacaaaagtaaaaaaaaatcaaaaataacagatttttatctaagaaattaaaatttcagatttaacgtggaaaatatctgaaaaatgttgtgattatgaataagccttatgacatttctgcatcacttcctgacttatagacctatttctctaaattgatattcattctacaccaatgaaccactaaaggccttgttcatcaagattccagaggtgatttctattcatattttgctatgaatacaccaaactgtatgaaaagttagtttttttccatttctgtaaatataagtttaataaaatacaaccacagataacacaccaggccaatgtctcagtcaattaccaacttagccatgttttcctatccaaaaaattcatttgtttttggtgacagtggtgatgaaatcatttatttacttatttttcatttggttttcatgaaatacttgttccagtttgttccatgtaggttttgagaaagattacagtattttgttgttctaataaactgagacattcagttctatcagacaacgatcttacttttattctagctgccagaaaagtcacagctaaagttgacattcaattatggtggctttctttagttaaaaaaattaataaaacgttcttctcttcccctttactacctaacttttgcctttgttcttacggtatgatccttgatcttactgtatctgtagttttattttaagtaagaagtgaggactctggacattgctctagttgttcaaatgagattctatgtggattgtaaaaatatatttttctactggaaagtaagtctatttgagtagctagggctcctgttgtaatagaaagggtaccaatcccaagtaatatgatttctaaaatgaagtcattatcataagtggagtatattatttcaagtgagtaaaacttttgaagagtgaattgttcatattctgggttatgtatgcatttgttacggtcaaggaagcttgaagcttcaaattcataaataaattacatcaaatgcaataagaataccacctactggacactttataatatgcattaatagtatatttatgactttatttaatttctaaaatggccctatgaagttatttttagaattttcattttacctatgtggaaactgagccacatagaagatgcccaaataacagtatttctgcagaaatcaaaacccaatttgcctgactctaacatttacactatatatattttatacatatatactatatatatatgtaacacatatattacactgtttaatataattacagtctcacatagggatgaattcgattattcagataattaaaatgttttttaaaagaaaataatattcagcatatttcttcgttagttatatgttaaaatacgaagatacacatcaaactactaaatcaactaagactaaatgctcttttgtatataactcccttattagacctgaatgttacagaattgtaaacttaatttggcagctgatctgaatccaggtcgctactctgtagtcagctgtgttgtatgactctgcactgagacccagaggaaccacaatgaaaaattagctgctcagtataacgaattgccagatgctggactcaagtaggtaatgacatttgaaagcatgtgtgcaagtacagaagaaaattctgaggtcccagatctcaaattttatgtgttataagcaaaatgctaaaatctcaagttccatttttaaaaattaattaaataattatttataacgtgtgtctaggcaaccacacattcaacagactaccaggacagattttgcctctagcactgtggtttaagaaagagaaggataactctctctctctctctctctctatatatatatatatatatattttttaacatgggactcatatatatatatatacacacgagttaaaaacattttatttcattaatatctcttgtgcgtgggaaactgtcacaaagcagtttcttctcttttttccgcactctgaacatagactatatataagagaggctagctgcggctcctgagtcagctactcatcactcatttcccacacctaaaagaggcctttttgtttggcaaaatgcttcccaaagtaaatagaaacgacagttaacactttttattttctagctaagagtcacctattgccttcaaaaaaataaattcttctagtagattacagaatttgctttgaaaaattttggtagacttttatccttaaaaaatccaggtagcaagagaacctggataagtactgcctggattagcgagcggttatgagcaaacgctatctgagaagtaagttttcatgagtgatgagaacataccctttcctgcttcgctgtccctcaccatcaaaatccctctcaccaccttgctgaaaccaaccgttgcagagattcattctattgatgtaaggttgggtctcaactgaaatagttaacaggcagagagcatatctcttttgaaactgtatttggagtaaaaggttcggatactgagccactgataaggtgtttggaggaaattgtttcataaaactgaaaagcaaccgtaagaaaataaggttggagccaatatgacaagaactgatgatgtaacgattctgcccagaatgttctgaccatgtcatcaaatcatgccctctaagcaatacaagacacacaagagaagtcttcacaaaacacacgctgggctctcacacactcattttcggattttgaagggatttcacaagatttcaaatctgcccagatcatctcaaaattgttcatttctaaacttgaaatgtctcccaacagagactttttggaaagtaatttgggcaggtcgtttgttcccattatcaattaccggtcagtatgtaagtagctctcttcccatgtcaaagctgcccctggccttcctcttgctcatgctctaattgtgttattagtcaggctccaaagtctgagtgtagctccatctaccacaccctctgggccagttatgcaaaagctctctgactttcctttttttttttttttttttttttgagatggagtctcgctctgtcgcccaggctggagtgcagtggtgcaatcttggctcactgcaagctctgtctcccgggttcacgccattgtcctgcctcagcctcccgagtagctgggaccacaggcgcccgccaccatgcccggctaatttttttttttttttttttttgtatttttactagagatggggtttcatcgtgttagccaggatggtctcaatctcctgacctcgtgacccgcgcgcctcagcctcccaaagtgctgggattacaggcatgagccaccgtgcccagccgctctctgacttcttttacctaattcacagtatttctctgagggtcaaataagatcaagaacaagatgcgaaaactacaaagtgcattttaaaataggtgattactgggatttttttttagtatttgatttttttatagtatgatcattgctttttgtttcttcatttgtttttgagacacagtctcactctgtcacccaggctggagcaaagtggtgcgatctctggctcattgcctcccaggtttaagtgattctcccgcctcagccttccaagtagctgggagtacaggcgcctgccaccacacctggctaatttttgtatttttagtagagacagggtttcaccatgttggccaggctggtcttgaactcctgaccttaagtgatccgcccacctcagcctcccaaagtgctgggattacaggcatgagccaccgtacctggcctgattattgatactccacacaaaacacagaaaatacaacacaaatatggaaactattaaacaattatttcaggttttaattcacaaaaatgcacccagtatggatcctagttttttgttttttttgtatttttttttgtaatttcctaaatgtactgggataaaatatttctgaaaaaataagctctataaaaattttcaattaaggttatatttgatcatcatagtagtacagcccaacaaaacagttttacctaaagtaacatgaaaaatataatttctgtttcacccttaaaaaatgtgtgtttgtatttatgtacttccaaaactttttcttatcaactaataagatcaggtcacgttaagtctattgatctcacctttcactgtaatatctgctttggcaactgttccttagatacaatgttctccaaactcaaaagttatttccccactggataggtgattttgtactgtttatattaaactttatctcttttcttctaagagcagctcccccaggtagtcaagtctgttccatgttagcttactttcaaattaagtcaccttctggcatgacacaattatagagcacattaataactgcaggcacctgcagaataaattcaaacgcattcctttccctccccctctcttgatatatacctgcaaaactgtctaaaaattctataaaatctaaaactcaaaaatggtcttctctatattcctgtgttcctccttactgatactaggttctaatactctgtcttctaaaacctggcaacactatctaatctattctcaccctgtgatgactgtgactgctgaaacctcattttcatagtccaacattcaaatcttcaattgttgcttgacaaactcagttatcatggaatagctacctgaagaaaacagctgaattcagtacactattttcagtgactgcaaaactataatacacaatacagatatttttcacataaactaggtgtaaaaatacaatgttcacacttcatatgagaatattttatttctagaaataaatcttcaccagtccaaacacgtaagtttacagaaagtcagtaagaaatcattatatttatatagcaccttgaccactacaaaagctgctcactgataatatcagaaataatcaataggcttataacactgccaaaatggtagcagagtatcgtgtgtctattgagtctgaaattaaattgcaatttaaggtccatctcttaaagctatattcatgtatttagaactctatcaaacaaaacaagaaaaaaattactttgacgtacatcttttaaagatgaatatgaaactttggacaataaatactactctcccgaatcaacttttaaagtgcaaccatcttttaatgatagttaactgctttaagaaagcaataaactaaaatgtaaacctgaaagcccactatcttaagctcttttaaaaattaaatacaccagcaacattttgagactcaaaattaatttacttcactcaatcctatgcataagtttggcaatttgtttcagatgctattttttctgtaatttttgtgggtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtataaaaaggcttcacaggggaacattcttttctgataaaggaaagcagctgggttggcttcaaatagcagtgactttacttggaatattcacaggtaagctgcaaatataaaacaccttccacagagtgttattttgtaatcggggcttatctcaagtgcaagaacctccagcctacagctttagtaggtgcctcagacactgtgcccggctttagtaggtgcctcggacactgtgcccggctttagtaggtgcctcggacactgtgcccggctttagtaggtgccgcggacactgcgcccggctttagtaggtgccgcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtaggtgccgcggacactgtgcccggctttagtaggtgcctcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtacgtgcctcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgccgcggacactgcgcccggctttagtaggtgcctcggacactgtgcccggctttagtaggtgcctcaaacactgtgcccacgtactctgaatggcgtatacacaatgataataaaagataacacagtgtttgctaagtgccaggtacaactacaggtaccgtaccagatagaaactgttattataaccatttgacagataaaaacactaaagcacacggagatgagtgaatttgcccaaggtcacatagacagtaagcagtatgaagaaacatatgtataactgcactgactctaaaatattataaatttattctgttaaaggtttctgtttaaaaaaaaatccatgtatttattaaaagtagcttttttctcagattcacttatagcaagactttattacatattaacttatcactgggtacaaaccacctggttctaaagacgtctgtcctgattactgtagggactgttatatatgaggcagaggcatcttttcattattattatttcccaaaacctatagaatttgtgtatagcagttatagactatgtctgaaatagttatattcacataacacttaataatcacatttaagtattcactaacagaacaaagcctgttactatggtaaataaatacacacagttctatcacagagcacagaagtcatcaaacagataatattttcttcattacacactgaaacttgtgacccgctaacagcataaaataatgtttaatatttaataccatgtgatggcaatactcaaccaaacatgtatttcaaatgatatgttatttgacatttcaatttcagctcaaaagtacttctaaaaaggatgaaaatatgtgcctgaaactgatagtttgaatttaataaatttttctgggattgttgtgttttgaactttaattttagaaccaagggggtacatgcgcaggtttgttaccagggtatattacatgatgctgaggtttggggtacaaatgagcccatcacccaggtagtgaacacagtttccaccagttaggttttcaacccttgctccctccctccaacctcgagcagtcctcagtttctgctgttgccatctttatgtccatgagtacccaatgtttagctcccacttctaagtgagaacatgcggtattggttttttgttcccgtattaattcacttagaataatgacctccagctgcatccaggttgctgcaaaggacatgattttgttctttcttaaggccacattgtattctgtggtgtatatgtaccacattttcttcatccagtctactgttgctaggcacctaggatgataccacatctctgctattgtgaatagtgcagcaatgattcttccaatccatgagcatggaatgtctttctacttgtttgcgtcatttctgatttctttcagcagtgttttctagttcttgtaaaaatgttttacttccttggttggatgtattcctaggtgttgtaggtgtgtatatctactgcaaatgagactggattcattatttggctctcagcttgaacgttattggtgcatagaaacgctattgatttctgcacacagcgatgaacatgcaactatatgtctttttggtagaattatttgttctcttttggatatgtatccattaatgggactgctggatcgaatggtagttctgctttaagctccttgagaaacctccaatggcgttccacagtggctgaactaggtttatattcccatccacataagtactcccttttctctttttctctgctgcctcaccaaaatctgttgttttttacttcttaataataggcattctattaaaaaaactttgtcagatgtgtagtttgccaacattttctctcattctgtagactgtacactctgttgatagtttcttttgatgtgcagaagttctttggtttaattaggtcccaccagtcaatttttacttttgttgcaactgcttttaaggacttagccataaattatttgccaaagtctatgtccagaatggtgtttcctagcttcttatagtttcagatcttaaacttaaatcttttccccatcttgagttaatttttatataagatgaaaggtaagggtccagttccattcttctgcctatggctggcaagttgccccagcaccatttattgacagggagtcctttcctcattgcttatttttgtctactttatcaaagatcagatggctgtaggtgtatggctttattttggggttctccactctgttccactggtctatgtgtctgtttttgtaccaggaccatgctgttttggttattgtacccttatagtatagtttgaagtcaggtaatgtgatgcctctggctttgggctttttgcttaggattgctttggctacttggactcttttttggttctatgttaattttagcatacttccaattctgtgaaaaatgacactggtagtttcataggaatagtgttgaatctgtagactgctatgggcagaatggccattttagtgatattgattcttccaatccatgagcatggaatgtctttccacttgtttgtgtcatttctgatttctttcagcagtgttttctaatccttgtaaaaatgttttacttccttggttagatgtattcctaggtgttgtgcatgtgtatctctactgcaaatgagactggattcattatttggctctcagtttgaacgttattggtgtataaaaacgttactgatttctgcacacttattttgcatctgaaactttactgaagtcattgatcagtttcaggagccttttggtggagtctttgggactttacaggtatataatcatatcacttgcaaagagaaatagtttcacttcttcttttcctaattggatgccttttctttttttcacttgactgactgctccagctagcacttccaggactatgttgaataggagtggtaagagtgggcttccttgtcttgttccagttctcagggagaatgctcccagtttttgtccattcaggataatgttggctatgggtttgtcatagatggatcttattattttgatggatcttattatttgatggatcttattataataataattattattattattattttccttcaatgcctggtttcttgagggtttttatcatgaggggatttggggttttgtgaaaagctttctctgcatccattggggatgatcatatggtctttatttttaatactgtttatgtggtgaatcacacgttttgatttgcatatattgaatcaactttcatcccaggaatcaagcctacttgatcatggtaataaagtttttgatgtgctgttttatttggtttactagcatgttgttgtagatttttgggtttatactcatgagggatattggcttgtcattttcttttttgttattgtgtcttcaccaggttttggtatggaggtaacactggcttggtatagtttcaaaattggtagcagctcctatttgtacaatacatctggcagaatctggcagcgaatccatttgtctggggcattttttttttttttttctagttggtaggttttaaattactgattcaatgtcagaactcaatactgttctcttcagggtttcaatttcttcctgactcaatcttaagagattgtgtgtgtattagtcagggttctcttagagggacataactaataagatagatagatagatagatagatagatagatagatagatagatagatagatagatagatacacacacacatacatacatacatagatacatagatagatacatagatataaacgggagtttgttaagtattaacttacatgattacaaggtcccacaataggctgcaagctgaggagcaaggagagccagttcaagttccaaaattgaagaatttggagtctgatggtcgagggcaggaagcatccagcatgggagaaagatgtgggctgggaggctaggcctgtctccctttttcatgattttctgcctgttttatattccctgagagctgattagatggtgcccaccagataagggtggatctgccttccccagcccactgactcaaatgttaatctcttttggcaacaccctcacagacacacccaggattaatgctttgtatccttcaatccaatcaagttcacacttagtattaaccatcacagtgtgtttccaggaattcatccatttcctctagattttctagtttgtgtgcatagaggtgttcataatagtctctgaggatcttttgtgtttctgtgggatcggttgtaatgtcacttttgtcacttctaattgtgcttatttgaacttcttttttgttaatctagctaatggtctatcaatcttgtgtatcctttcaaataaccaatttttagttttgttgattatattaatttctgggtctcaatttcattcagctctgctcttattttagttatttctctttttctgctagctttgaaatgtttgttcttgtttttctagttcctttaggtgtagtattaaatcattaaattgggatctttctaacttcctgcggtaggtatttagcactataaaatttcctcttaacactacttttgctgcatcccagaggttttggtacctgtgcctctgttttcatttatttaaattttttttatttctgccttaatttcattgtttacacaaaagtcattcaggagcaagttgtataatttccatgtaactgtggttttgagtcctttaaggtactgatttctatttttattccactgtggtcttagaatatggttgctatgatttagattttttcaaatttattgaaacttgctttatggctgaacatgtggtcaatcctggagtatgttccaggtgcagatgagaagaatgtatgttctgtggttgatgagtgaagtgttctgtagatgcctattaagtccaattggtcaagtgtttactttaagtccagaatttctttgttcgttttctgcctcagtgatctaatagtgacagtggggtgttgaatttccccactattattgtgtggttgtctaagtcttttcctaggtcttgttttatcaatgtggctactccaatattgggtacatatatatttaggacaattaaatcctcttgttgaattgaatcctctatcattatgtaatgcctttctttgtccttttttactgttgttggtttaaagtttgttttatctgatgtaagaatagcaagccctgctcttttttgttattcattactttgagcctgtaggtgttgttacctgtgagatgggtcacttgaagacagcagatgactgggtcttgttgttttatcaaacttgctactctgtgccctttaagtagactgtttagaccatttacaatcaaggttaatattcacatttgaggttttgaccctatcatgaaattgttagctggtggctttgtagtttctattatgcggttgctttatagggtctgtgggctatgtgcttaaggtgcttttgtggcagcagctgtttccatatttagaacttgatatggtttggatctgtgtccccaaaaactctcatgttaaattgtaatctccagtgttggaagtgggactgggtgggagggaggtgtcacaccacccttccctctcctgcttctgccttgtaagacggctgcccctcctttacctactggcatgagtaaaagttccttgaggcctctccaaaagtagatgctgccatgcttcctgtatagcttgcagaaccataagtcaattgaacttttcttataaattacccagtctcaggtatttcttttcttttttcgagacagagtctcactttgtcacccaggctagagtgcagtggtgcgatcttggctcactgcaacctctgcctcctgggttcaagcaattctcctgcctcagcctcccgagtagctgggattacaggtgtgcaccaccacgcctggctaatttttgtatttttagtagagatggggttttaccatgttggtcaggctggtctcaaactcctgacctcgtgatccgcccacctcggcctcccaaagtgctgggattacaggagtgagccaccatgcctggcctcacgtatttctttacagcaatgcaagagcacactaatacagaacacctttaaggaactcttgtgaggctggtctagtggtaacaaattcccttagtgcttgcttgtctggaaaaaaattttatttcttcttcatttatgaagcttcatttgacaggacatgaaactcttggttgcaatttcttttctttaaaaatgctgaaaatagcccccccaactcactttgcttgtaaagtttctgctgataagtctgctgttggcctgatagggctcctgttgtacaaaatctgacctttttctctagctgcctttaagatatttttctttagcaccgaccttgaacagtttggtgactatatgacttagtgatgttcattttgtatagtatctcacaggtgttctcaggatttcttgtaactggatgtctacctctctagcaagcttagggaaattttctttaattcctcaaatttgttttccaggttgcttatttttttccttctctctcagtaatgccaataatttgtagttttggtcactttacataatcccatatttctcaaagactgtttattttattaaattattttttcttcctttttgtctgactgggttaattcaaaagactgatcttcaagttctgaaattctttcttctacttggtccaaaccattaataaaactttgaattgtatttttaaatttcttaagtgagtttttcaattccagaactggttgatttctttttaagatatttatctcttccttcattccctggatagctttagaagcttctttgtgctgattttcagtcttgtcttggatctcattgagcttccttgcaattcatgctttgaattacttatctgtcatatctgagtttccattttggttaggaaccatttctggaaagcttgtgcaatcctttggtggtgttactacattcagatttttaatggtgccagtaatcttgtgctgattctttctcagctgaagatgctagcacttctaatttttgtaattattttcatgtaggtaggatgtttctttctcttttcttcctctataatgttactgggttttttttccttctctttccctttcccctgcttcctatgggtatgactacagattattttgggtaagatctatttgttttgcttctatctttgctctgcctttggttttgtttctaccagttcttctggtaggttttgtatcaggctgtgcagttcaatctacatgccagtagatgatgcttataggtaagagccagttgcagccaatgtagctggatacttgatccttgtttactggcagaagttctctgttgcctcagacaatgggctgatacatagaatgcatagtggtctgagctccctgctcagccccaagggcatggggccagactggtcaggtccacctaaaggtcccctgatacaggcacaagcaccagcactgacagagaatccaatgggtggctaccaagcacccagaggtatgcctaggcatggagctcctcagtatcaagttctctgcacaggaatgggaaacctcttcagcatcaacttctctacacaggaatgggggatgccctaaactccaaatccagaagagctctgcctaggtgtgtagtatagtgggctccccctgaaccaagatctctgcataaaaggggtagggtgactcgaactgctgaaccaggcaagcaggtgttctgaatacctggagatctgtctgggcatggagcagagagagtccccctatatgaggatctctgcacgggaaggatggagcagctcgggctactgacccaagtaagcttgtgctccaaatgcctgcagacctgcctgggcttagagcagagagggtcccactgtcccacaggaagagttgcgtggctcaggctgctgaaccagataagcaggtgctccaaatgcctggagatctgcctaggtgtaaagcagaaagggcctccctacaccaggatcttttttatccaccagacactgtcgcagaggttgtttgccagtgttctgctcaccaggatctgggtgtccctcacgattccagtggattcccattttccttttgttgttgttgttgttgttgttttttgtttgtttgtttcttttttgagacagagtcttgttctatcaccaggctggagtgcaatggcccgaccttggctcactgcaacctctgcctcccaagttcaagcgattctcctgcctcagcctcctgagtagctgggcctacagagctaatttttctatttttagtagagatggggtttcaccatgttggccaggatggtctcgatctcttgacctcgtgatccacccgcctcagcctcccaaagtgctagattaccaggcgtgagccactgcgcccagccccattttccttcttgaaaaaaagctcatacagtttatcttcatgcactatctagccatttccaagtggctgaggcatgctacaagcctcttatctgccatcttagagaaacaatctgcactttataaatggacaggtaaatctttgttgagagagaaaaaataaaggaaacagcttgtagagtgacccaagtacagtcctgaagctgctctcaaggaaagtaagaaaaatagcagcccaaaccctccccttagaaggaaggcttttcccacagagtctcgccttctggctggaagtcatctctttctgggttttgttgttgttgttgttgttgttgttgtttatttgagacggcgtctcactctgtcacccaggctggagtgcagtggcaccatctcagctcactgcaagctccgcctcctgggttcacaccattctccggcctcagcctcccaagtagctgggactacaggcgcccgccaccacgcctggctaattttttgtatttttagtagagctgggtttcaccgtgttagccaggatggtctcgatctcctgacctcaggatccaccctcctcagcctcccaaagtgctgggattacaagcatgagccaccgcacccagctctctttgttttttttttttaatgttaccttatagtcacagcattttatgctttaatgataattcacatttaattttagaaaacttttattttcttaaagatataatcgtttattatatttacatattgaatgttttcaatgacaataaatataggaaggtcatcaacaagacccatagaatttaaacaatcacacataaaataattggtgtagaagtcaaaattttttaaatggttagctcagaaaatacagaaagctcaagacacattactaaaacatgaactgaccttaacaaagaaaaacactgctttgtttctattatacttcaaaaaaaaacagtaataagaatttaaaaaaaaaatcagttctctgttgcatagaaggagaaatataccattttctctttctgtgaggaaaaagaggaaaatcatatttaaaacgaatgacattctgtacagatgggcataaacagcgccctctgtctcatgtacacacatccttttcttgtcactcagctttatttctggcaattcttaaatcggagaaaaaagttacaataaatctgtaagatccatattgtgtatagaagtaagtgaaaaataagctgttcaaattccaatacctactgatctccttctgtggccaaagtttctctgacatcattctgctgcttgtttattcttccatgctctcctattgttacagagggcaactaattttaaaaagtatttgacagtattaagcaataactttgtgccgattttctttttcacagaacagaattaaatttgagtgcagatgtgagtagatatagaagagtgtatgatatttttgtgtgtgtgttttctttgtagagtccaaaagccctgtggattgttagtgaagctcaggcagaataaagcaaatagaagaacaaggcaactgaagtctaacgatatggtggataagaatccgattttaaatcttgacattgcttgagaatgggaataatgtgttacttatttttcgcactatgactaacaattattaaacatctaatatgtaccaaacacagttctggacatattcccatatcttaactcgtttaatcttgacaacaatccttctgaggtaggttttattacccttcatttcagatgaggaaataaactcacagacattactaatttgggtgactcagacagacacagtttccattttgttcttcctttcagttaacatatatttcttatggactttctgcttgttccaggcactatgcttggcacagcgtctaccatttctctttctactaaaccatatagccggtctctgacacctagcacagtacctaggtcatattaggttctcaatgaagattcactgaattatttggttaatttacttgtctctataaaataaacatttacatagaaatttgggtccaggtttatattatcttaaaacatcttgtaattcaacactgttaaaacatgtattttaaaaatagtttttcaaaagagaaaatatttcattgattatagacatctaggaaacccaagtcaggtggcaaatacctgcactgaaaactaacagaatcatggaaaggaagcctgacacagcatgatgcacattctctcaactttgtatgtaaataaatcctacattctttaattgtctcaagaatgcgtgatttgaatacctaattctattacaaatatcacatgggaatggtcttccaatgttggtacatgtactcaaggcacaatgcatagtgttgaccaaaaagcaaaagcttaccatgaaaaaaggtaagtaatggatggattactttgtagtcagacatggataaggttgaatgttagctctgccatttactagctaccttattttgagggaagttatttcacttttctgaggctgtttctgtactataaaatacagataattctaacagcatctactgtgcactcagagattatggtgaggactaaatgacaggatgtatgtgacctgggcacatacccaggtcagagttagggctcattaacagttagctgtatattgaagtagaaaagttagggaggctgggaaataaattttctggtaggcatgaggtggagcagactacataatgatcaccttctttttactgtctaacctttaaagctccttagtatgcaggaaaatgcctgctcctgaatgagctgatcttcataccagcgtatttatctttcctaattcaaaaacagcctccttaaaacacaaacatactttttcatactgtcattcaaaatagctgcttatgatataacttaatagtaaaaatgggaaaattactgatttctttttgtacaattctatgtaccttcaacaaattatgccttttcattttcaaaggataataccaattccttccaaaggcatgatcaaacctaaatagtggttaatttgaacatttcttttaagtcccagaagaagaaattacgttaaccacttcttcatatcttaagtgaaaaatgtgtaagacagtaactgtcttaaataattacatttctgcttattaggtgtaattaatattttatccccaaattaagccaaaataattccttagatataagatgcctacacaaccaacaaatcaagcttttaatttctgagttctagccaaaaggccatattgcctaagaagagcagaaataaatgtttttttttttgttgcctttttaaaaactttgtaacctacatataaatagaaggaaactcagatttcgaatacagacttctgagggaaatcaaatgaatacaaaatttattgtatactaagcagtaactcttgtttattctatcacttgggactgtatattctttttaaattagtatatcaattgttctgaatataataattcaatacagtcatcttcctaagggtccattttaagcatcattcaaagcaagtagtagtaaaaaggaacaaagcataagccacagcagtgctaaaaatatggtaattgattaaaacaaaaacaattagctgggtgcaatggctcatacctataatcccagcattttgggaagccaaggtaggaggatggcttcagcccagaagttcacgaccagcctgggcaagatggtgagaccctgcatcttagaactgatgaaagacggtaacttttctatattttttcaatatgattttattctcacacatcaacaacattctaagatgtcttacaaagaatagcttttgtaatcccatggcctctaatgcaatacagtgctttatacacattctatgggaattgcaggtaccatctccatagcctaagagtatgcaatctgaaccaaatccttttctgtccacatcttgaagtgcttcttaaattcctaagatctaactagttacttctctattacctgttagtggctctgctatagaagaaaaggtgaaagtaaatatctacaaagaaagacagtggggatagtgacaacaataataaccactatttactaagtgctatgttctaaacactttacatggactttgttacttaatgtttgcaattctatgatgcatacagaatcagtcttattacgagatgaacaaatttagtttccaactgataattgtgaagaaataaaaaactacaggagagtgatttttaaatcaaaggtgcatatgaagagaagcatgctaatgaaataatcctgctagcttttcttttttgattttgtaaaatattaattgctcttgcactgttctttattgacaatggatcagactgaagcttctggtcagtgtatctttattatttttcgagacagggtctttctctgttgaccaggctggagtaccagggtgtgagcatagctcactgtaacctcaaacacctgggctcaagtgatcccacctcagcctcccaagtagctaggatgtgggagtatgccaacatacccagctaatttttgtattttttttttttgtaatagacagggtctcactttcttgtccatgcttgtcttgaactcctgacctcaagcaaacctccctccttggcctctcaaagtgctaggattataggcatgagccactatatccagttctgcttcgttttttttgttgttgttgtttgtttgtcttaagaaaaaattctcattttgtgaagtgtgagccaggagaaagagacaagaggctgactccagaaaaactgcagtcttcattcttaaaaagcacatctttcagggatgatagctattgggatattcacatgtcagcagctctcagtataaacaaaacaacaataaaaagtcagaaaatcagcaagaggaataaacatgtcagaaatattgtgggatccagtgaccatcacatgtcttaataatgagctcatcatccagcctgtatgagccttctcctgtgagagcatctttttgaaccaacggatcaacagaaaatactcccgcagtgcttgctttttaaagtaggattatatgaaagtaactgagaattactcccatctccttatattgacaatcttccagttaatgagaagatggattttctcctcaagctattgggtttgagaatcttctgttctgtgttagctaatctctcatgaatgtttttaacactgaaggtccttgtatttgctattacaaaaaagcaggtgcaactgagttccttccttagaattttgagctcgcaatcatttgttcaagatcccactaatctttttagttcttgtttgctgaacacctgattttaaaagggaaccccacaaatcccctttaaccactcttccatttgagtccatccttcatagtcatctactaaacattttgtttacaatgtatcaaaggttatgattcctaggaagtttggctttctttttttgtaaaaaacagggaaagaactctattgggaatgtcatgccctgtccatccatcccatctttttttaatcgggcaactttatattcatcctaccaggaccaactctaatgtccaaactgcgtgacagaattaacagttccttcctctgtattcctaaagtattttgttcacattattattattagagtattaatatattgagtatagaatgttttggtatgccgatagtgaagtcttattcatctttatatgttccaacggtacctggtacagagtagttactcagtaaaagtatgttgaataattttattaacgtgattccaaatccctaagtgataatcttatttaaggaaaatactataacactgaatactctctgaatagtctctgaaacagtaatgagaaatacaaaaatcagctgggcatggtggtgcacacctgtaatcccagctgctagggaggctgaggcaggagaattgcttaactgggacccgggaggtggaggttgcagtgagccgagattgcaccagtgcactccagccgaaagaaagacagaaagaaagagagaaagagagagagagaagagaaagatagagagagaaagaaagtaatgacagagaaaatactttttcgagtaaaacctcagaaaagaatatgatcccaagtaaaaaaaaaagtaaactgcgaaaataatatttttttccttttcttattcattttccacagcttcttaattctcttccattaaatcttattgaggcaattttatttatggatagttatatctagttttataagcctggcaaatatcttgccccaaagttacagaatatgtatctagtactggataatgcaaaattcactttgaaactttttattagaatatttgcttgcctaattaaagatggaatagagcaatattataataaatgtgcatagcctgaatacaaaggagctaagagataacggaatacatacatacttggccaaagaagacagaccacaattataaatatagcctagatatatacaaagcaaatggtcatgcattaacatattaattgaaggtgatgaactgaagttttatcaattaagaaaacactgcaagctatattctgggcccaattttaaaagtagaaaaaaaatggtattattttatggtttatgttatttatgtttattttatgttatttgattattcccagtccataggcacatccttaaaatttcatatgaacactttggggaaacattttaaagttttcatttgaacttactcctcgtcctcaaatgccagcaaactgttcctggtatatagaaaacagatcttatctaagaattcaccgtttacatgtgaaagcctttgcttagaattcctcctcctctcctgtctgcctgttgaaatcctgtcattctttaagggtcagacattgtgcttatatattgtcagaccacatcttctgagtctctcttgcagccccttcctggattacaactctaaggcagagactgcaccttaggtacgggagcatactgttgcatgctcaacaatatttgatgaattgaaagtaggcttttatcaattcataaacaaaatcaattattttaccaattccagctcatttcaacagatttctattcccaaagtctagggtcctttgtctttgttctgtcaatccctaaagaagcaagatcatttctgtcttttcctatgagcctgagagaggacaggcctcacacattcaccattcccaggtgtgcagtagtgtaaaaataattcacactgattccaaggtatcacttatcaattgggaattgtattgtcagaggcgtgtgaaccagaacaactccatcttgaacaggagctgggtaaaatgaagctgaggcctactgggctgcattcccagacaattaacgcattctaagtcacagcatgagatgggaggtcggcacaagataaaggtcataaagaccttgctgataaaacaggttgtaaagaagccggacaaatcagaccaaaagcaagatgtccatgagagtgacctctggtcgtcctcactgctacactcccaccagccccatgacagtttacaaatgccatggcaacatcaggaagttaccctatatgatctaaaaaggggaggcatgaataatccaccccttgtttagcatatcattaggaaataaccggccaggcgcagtggctcacgcctgtaaacccagcactttgggaggccaaggcaggcagatcacaaggtcaggagatccagaccatcctgaccaatatggtgaccccgtctctactaaaatacacaaaaaaaagacattagccgggcatggtggcacacacctgtagtcccagctacccgggaggctgaggcaggggaatagcttgaacctgggaggcggaggttgcagtcagccaagatctcgccactgcacaccagcctgagtgacagaacgagacaccatcaaaaaaagaaagaaaagagaagaggaaagaaaagaaaagaaaagaaagaaatgggcaaccagcagcccctagggctgctctgtctatggagtagccgttcttttattcctttactttcttaataaacttgctttcactgtgcaccatggactcgccctgaattctttctcgcgccagatccaagagccctcccttggggtcctgcaacactatcactgttaataaaatgatccaaacttcatcaccgttaacccaattaaccctaaagtagctgaagagtaaaaagttacaggttcccattactaaattagaatcagtaaagaataataagcacgtaactgaatctaattaataaataaaatctctcccttttccatcccactaaatgccagtaatcccactgtaatcccaccataccatctaaaatgtatgcttcaaggcccagggttaaggcccaactacatgaagcctcccagtttcctttgttttctctgaaactggctgataccaccctttccagatctcacactttagttagtagatcgactaacaacacagcaagagcctgtgttagtaactcaataaatactgaattgaacggcttctaagttatcactttataagaatgaatataatcttcttaacattatgacactgatattatgttctcatttttgacgttaggaaatggagggtcagaagattagctggtggtgatagaaccacgattagaatccttatctgtccaattcatactttcatactcttcccccatattccagtatgaccctggaatttattctgtcaaatattattgttttctttctgtttctttttttttcttttttttttttgtttttgttgttttgttttgttttgttttttgaggcaggctcttgttctgttgcccaggctacagtgcagtggtgcaatcacagctcaccgcaacctcaacctcccgagcccaagcaatcctcccacctcagccgtaagcagccgggactacaggcacatgccatcttgcctggctcattttaaaaaaaatcttttttgtagagaagctgtcttcctacgttgcccaggctggtctcaaactcttggactcaagtgatattcctgcctcagcctcccaaagtgctgggattccgggcgtgtaccaccacacccagcggtcaagtattattcctgagtgactttgtacatgaggtttaccttcccaagaaccatgttggttcctgaagaatgacctccaacaccagagacagagttttcaaattgaaatggtactcaagttggttaatttgaacagattgtctcttttgctaggtcattctcaattaagtcttggttgaataaattaataacattacgacaaacaaggattaacttcagaccctaccctcttaatccctgaaagaactggacattatagccctacccataggaagacagtgatagaattttctttaaaactatatataacatattatatgaattaacataattatttattcttgctaccatgcatttacatcaaaccattcatttctcaaggcatagatgcatccaaaatcctcctagattgaaactgttttcattttttattgcaataaaatatgcataaaaaatttactatcttaaccatagttaagtatacactttagtgttactaaatccattcataatgttgtgcaccatcaccaccatccatctctgtaactcttttcatcttgcagaactgaaactctaaattcattaaacagtaactccagttccctccttctttctagcctctggcaatcaccattctactttctggctctaagattttgactcctctaagtatctcataaaagtggagtcatatagtatttgtctttaatgtggctggcttatttcacttagcataatgtcctcaaggttcaaccatgttgtagcatgtgtcttcatttccctcctttttaatgctgaatgacattttatgatatgtatgtatgtaccacattttgttttcagataaatgacatgagggttgcttctacattttagtcattgtgaatagtgctgctatgaacactggcatacaaacatctctttgagatcctgctttcaattcttttgggtacatacacataaatggaattgctggatcatacagtaattctatttttaaatttttgagttgccgccatactgtttgccacagtggctatacagttttacacgtccacgcagtgcacaaggcttccaatttccccacatcctccccaacacttattttctggggttttttaaatagcagtcatcctaatttgtgtgaagtggtatctcactgtagttttgatttgcatttccgtcatgattagtgatgctaagcatcttttcatgtgcttattggcgtatcttctttggaaaaatgtctacttaagtcctttgcccattttaaaatcatgttgcttttctattgttgagttcttaattatatattttgatattgatccattatcagatataaggtttgcaaatatcttctcccatactctgggttaccttttaactgttgatactgtcttttgatgcaccaaattttttaaattttcataaagaacaatttgtttattttttttctttagctgcctgttcctttggtgtcattcccaagataccactgacaaatccaatgtcatgaagcttctgccctatgttttctaggagttttatagtttggggtcttacatttaggtctttgatccattttgagttgatttttgtatacaaacttagataaaggtccaacttcattcttttgcatatggatacccagttgtcctggcaccatttgttgaattgactgtgctttctccattgaagggtcttggcacccccatcgaaaatcatttgaccatataggtgaggttttacttctggactttcccgttgattccattggtctatatgtctgtctttatgccagtaacacactgttttggtcacagtagcttcttagcaaattttgaaatcagcacattgagtcatccagctatgttatttttcaagataactttagctatttggagtccctcaagattccatataaattttagatttttttttccttttctgcaaaaaaacatcattgcgattttgatagggaacgcattgaatctgtagaggcctttgggtaggtaatgacatcttaacaatattaaatcttccagttcacaaacatgggatatgtttccacttatttatgttgcctttaatttctttcagcaatgtttttctgcttttcattgttaagtttttaacctccttgttaattcctaagtattttattcttttggatggaattgtttttgtaatttccttttcagattgttcactgtttgtttgtgtataaaaatgcaacggatttttgtgtattcacgttgtgccccaatactttgtttaattcagttattagcattgatagttttttgtgggatctttaggattttctatctacaaggtcatatcatctatgaacagagataattttacctcttcctttccaatttgtgtgccttttatttctttttcttgcctaaatggtctagctagaacttcagtagtatgttgaatagaagtggtgaaaagcaggcatccttatctcatcctcaatcttaaaggaaaagcttttggtctttcaccagtaagatgttagctatgggtttttcatatatggcttttactatgttgaagtagtttctttttattccttatgtgttcagtgatttttgtcatgaaagggtattgaattttgtcaaaatgatttttctgcttcgattcagatgatcacgtggggtttttttccccctacaatctgtttatatgatatattacactgattgattttcacattttgaaccattcttgcagtctgggaataaatgccatttggtcatggtgtataatccttttaatatgctgctaaatttggtttgctagtattctgttgaaaatttttacatcagtgttcataagggatactggtttgtagttttcttttctcataatatctttgtctggctttggtaacagggtaatgttggcctcataataaaagcattaggaagtatttcttcctcttcaatactttggaaaagtttgagaaagattagtatcagcttctctataaatgtttggtagaattcacctgtgaagccctccaagtcagcttttctctgttgagagattattgattactgattcaatctcctaactaggtataggtccattcagattttcataatttttgtctttcacagttttttatatttccagaagtttgtccctttcatctagggtattcaatttgttgtcatacaactcttcctaatgccctcctataatcctttttcattctgtatgattcataataatgtccctgttttctttttttttttttttttcttttttttgggggggggacagagtcttgctctgtttcccaggctggagtgcagaggcacaacctcggctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctgacctcaagtgacccacccacctcggcctcccaaagtgctgggattacaggcatgagccaccacgcccggcccagtaatgtccccattgtcattttttattttagcaattggaatcttcttttttcttagtccatctatctacaagtttgacaattttgttaatcttttcaagaacgcagcttttggtttcactaatctttttttttttttttttttttttttaaagacagagtgttggtcttgtcgcccaggtgggagtgcagtggcacgatctcggctcactgcaacctctgcctcccaggttcaagcgattctcctgcctcagcctcctgagtagctggaattactggtgcccactatcacaccctgctaatttttgtatttttagtagagacagggtttcaccatgttggccaggctggtctcgaactcctggcctcgtggtccaccggcctccttaagtgctgggattacaggcgtgaaccactgcgcccggccactaatctctcctattgctttcctattctctatttcagttaacactgttctaatctttattatttccttccttctgctagctttgcatttagttcttctttatctagttatttcactttaaagttaggaaactcactaattttggtattaacttctttatcagatattttagaattagacctatcgatcatgtcatactttcctcagattcataactgcatgatataataatcctgtgtattcgagtcaaaagacacagggactctaaagcaagttcttcatgctctgaaagcatattattctttccttttgtctttatgtgtcctagaagtcattagacacaaaacatggagtttcaaggttactgttagagaacatatcgtgagtctaatggttaattacttccatattatctaagttttacaaacctctgatgtattcttcctttggttttattgttccaagcttcacatctgggcttctcacaatgcctgatttttatagaaagaacacagtcatataataaaaaacactgatgtcagcacactgacattcaacccagtgttttatctggggctctgcttcaggccactgttgctgaatgctgtggactccattctccaagtgcacgtatttgttttgtgctttaaaatagctaaattattatatataactacaacatagaacttttaaaaattctgtaactcaggattttcacaattcaggttgagtccctctatccagtccaaattcatccaaattttactgactagccctcaaacctgagaaatagaaatgcctcctaacagacacaggccgtccgaaggtcaatcaaatcccatgggaatatgacaaaaagcacctttctctgacaagagagagccagtaattaaggtctcagccttgttcccctcatctctgcttggatcagaattcagtttttcaaataatgccctataaatgttaagccaaaaacataggcaacactctaccggggtcagtaccaggacaaagaacatcacattttatggaatctatctttacaatcgtatttttatgcaaaaaaactcaatgactactgtagctgggacacctcacagttgttcctgctacattcattttcatccttttgacttttataggcagattttttttgagaatttttaaaaattatatataaagacatttttaggaaatctgagctggtgtcctcctttcattccttagaaccagacaagaaggcaggaacagtgaagacaaaatacaatgcgcaagagcaggggcaggcaactgttttctgtaaagggcagccttcacaggccaaaccatctctaccgaaactactcagctctgctgctgtaacaatagacaagacatgatacatacaagaacggcatggctcattctggcacccaggcttatagtttgcctgctcctggccaacaacaaagatatggagtctgatgcccaagtttgaatactaactctgttttttactagctgtattaacactggcaagttatttaatgtttctagtggagtctgatgcccatgtttgaatactaactccgttttttactagctgtattaacactggcaggttatttaatgtctctagtggagtctgatgcccatgtttgaatactaactctgtttttcactagccgtgttaacactggcaagttatttaatgtttctagtggagtctgatgcccatgtttgaatactaactgttttttcactagccgtattaacactggcaagttatttaatgcctctagtggagtctgatgcccatgtttgaatactaactctgttttttactagctgtattaacactggcaagttatttaatgtctctagtggagtctgatgcccatgtttgaatactaactctgttttttcactagccgtattaacactggcaagttatttaatgcctctagtggagtctgatgcccatgtttgaatactaactctgttttttactagccgtattaacactggcaagttatttaatgtttctagtggagtctgatgcccatgtttgaatactaactctgtttttcactagtcgtattaacactggcaggttatttaatgtctgtagtggagtctgatgcccatgtttgaatactaactctgtttttcactagtcgtattaacactggcaggttatttaatgtctgtagtggagtctgatgcccaagtttgaatactaactctgtttttcactagtcgtattaacactggcaggttatttaatgtctgtagtggagtctgatgcccatgtttgaatactaactctgttttttactaaccgtattaacactggcaagttatttaatgtttctagtggagtctgatgcccatgtttgaatactaactctgttttttcactagccgtattaacactggcaagttatttaatgcctctagtggagtctgatgcccatgtttgaatactaactccattttttcactacccgtattaacactggcaggttatttaatgtttctagtggagtctgatgcccatgtttgaatactaactctgttttttcactagctgtattaacactggcaggttatttaatgtctgtagtggagtctgatgcccatgtttgaatactaactctgttttttactagccgtattaacactggcaagttatttaatgtttctagtggagtctgatgcccatgtttgaacactaactccattttttcactacccgtattaacactggcaggttatttaatgtttctagtggagtctgatgcccacgtttgaatactaactctgtttttcactagccgtattaacactggcaggttatttaatgtctgtagtggagtctgatgcccatgtttgaatactaactctgttttttcactagccgtattaacactggcaagttacttaatgtttctagtggagtctgatgcccatgtttgaatactaactccgttttttcactagccgtattaacactggcaggttatttaatgtttctagtggagtctgatgcccatgtttgaatactaactccgttttttcactagccgtattaacactggcaggttatttaatgtctctaggtctcagtttcccatctgcaaaatgggggtaatgaaagtactaatctcatatgtctaatatggagatgtacatataagccagtatgtgtaaagtgattagcacatggtaaataatatgtttactacattaatatgtgagcaaatatacattaaaaaggtgttattttgtgaacttgtaaatagttgaaataatgcattcagcttaggcaaccttgtttcaaaaaaaaaaagtgcaaggtttcagaaaagaagatgtacaaatgaccaataagcctatatataaaacgctcaacatcatttatcaaggaaatgccaactaaaaccacaatataacgtccttgcacactgttacaatggctaaaattaaaaagagactacatcaaatgctggtgaaggtgcggagcaactgctgactggaatgcatcatcactttggaaaatagtttggctgtatcttattttaacatgtaaaaacaagcaaacaccaccaccaccaccaccaacaacaacaacaaaaatgctcttatatgacccagcaatctcactactggtatttatccaagggaaataaaccacatgtccacccaaagactcatacatgaatattcacagcagctttattcacaatacctaatcaggggagacaacacagatgttcatcagcaggtgaatggataaacaaattgtgttatcccaatacagaccaccgctcagtaataaagaggaacaaactactgacacaaacgacatggatgaacctcagaatcattatgctaagtgaaaagagtcagaccacagtctataacgtacagttccatttcttcaaaattcaaaacagacaaaagtcatctatagatacaaagcagatcagtggttgctgcagccagacgtgtaggaggattgataccaaagggacatatggcaacttttggggtcacggaaagttctgtatcttcattgccatgataatcatcgtatattatattcatggcatacatatttgttaatacccaaagtatatacttaaagtttatttaaataaaaaggtacaaagaaaacagaaatgaggaagggagtacaactgcaaacagccaactttaaaaggtgagtaaggagctcagcacagaccaaaccaacaactgggattttcaatgcctcaggtcggcctggaggcccacaagtgctgtgaatgtgaaacccaggaacaaatctcctgggttactctcatgtatgtcgatgtccctttccgtctcccctctgtttaagaaaaaaaaaaaagctgagaagacaaactttaagttggcccctcccctaagacacctagctacctccttggggtgtgcaggcctttgtacaatcccctcgccttgccccttatgtatgggcatgatctgtgacttgcttctaacagaatatggcaaaggtatatgtcactcctgccaattacatttcataaaactccatcttgccatcagatcttcactagaagctcttcttgctgacttaataaagtacatggtcatgtggggaaagccctacctgagaaggaactgtgggtggtctccaggaactgtgggtagacttcagccaagagccggcaagaagccagggccctgagtcctactgatgcaaggagataaattctttcagtggcccaagcgagctgggaagtggcttcttccccggatttccatacgagaacacagcccagctgacaccttgacgagagctttatgagaccctacatggaggatccaggtgtgtgtggacacctgacccacagaaaccatacgattaaaaaatatatgctgctttaggccacaaagtatgtgataattcattatacaaaataaaaaatataaacagaggagaagatacctaaatggttaaaaagaaaaaacaatacacccaataaagtcggcattttcagaacacaagcgctaggcagagctgcctgactgttgtcaggatcatgcagcaacttctttaacaagtcatgctgccctgtgttccttcctgacaccatgacaggagcaaccactcaagtccagcatcctctaggccctaaagtgctactacatgtgactcacagacttcacaacagttctaagagcactggagaacagtacctactgtcctttaaagccagggccttactcccttctgtggagacacacaccccttggctctaagtggccccagtggacatgacacaacaatcccaaagagccacttaagctacaatgtaagattgttgagaccagccgggcgcggtggctcacacctgtaatcccagcactctgggaggctgaggcgggtggatcacctgaggtcaggagttccagaccagcctggccaacatggcgaaaccccatctctactaaaaacacaaaaattagctgggcatggtggcgcgtgcctgtaatcccagctacttgggaggctgaggcaggagaatcacttgaacccgggaggcggaggttgcaatgagccaagatcatgtcattgcactccagcctggcgacagagtaagactccttctcaaaacaaaaacaaaaacaaaaaaaaagattgttgagaccaatggttatgtgcatggggttctactctacagctaaagaggaagtgggatgcaagacaaaggcagttatttaacctctataacatatttagcaggaagctcaaatatgcagactattgaacagggaagaatagagtagggagagaaaagacgatagtgtagtaccatggggaagaacagtccaagaagtgtgaattgctctgccagggacagccctgcctgtgacgcatcacacaacttctctataaaacaaggctttatgatccttaaggcgtcttccaggtctaagagtctatcattctacattatataaaaatctttagttgaacaattatagtatcttggggggaaagtgtactaaggcatcaagaaaacaattttatctgctaagagtacttactcgtagtaagtaagattagtatgcagaattctgagtttagcacacacgatgttcttaggatttgggagcctagtcttataaatgtgaatgccatacattaggttgcaaagaaaaggccattcatatccacgaagataacaaaggaatatatatagtagcatgaggtgattttatttaaagtttaatgtcctcaagtaatcattccatgctcagtttcttataactgtaacttggaaatattgacatttcatatgcaagctataactaaaactaacttttctttataaccagctaggaaaaaaataggcacaaagtattattttataaagtctaccaagtaacgaacatcaaagaaatgcacatgatatagtcaggctttttctagcacttgtcagtacaagccagttagtggagtaaatcggtttggctgaaagtcctatgctgccatgcgacagaaaagagagctaaactatccacattccatagtttaccttctgtcactaataatctccatcatctacttaaaaatcttagagaagctgggcacagtagctacttgggaggctgaggcaggaggattgcttgagcccaggcgttcgagtccagccagtgcaacacagtgaaatctccatttctctctttaaaagaatgttaaagacatctacctcaatttttggcaatctcctactgtagcttgaaatgttaaagcttacatttagactgtgcatgtcagtttctattatcattccactttacagagaattaaaaaaacactgtgcttgcaacttaaactggtattaaactgacccctgctggcctcatcttttctgtttctgcatttatcagatgcttcaagagctaactgcattctatagttcaacctatatttgatcaggctgccacctcaaaaacaaaacgtgggacaaagatggctagttgtaccaaattccaaatggaaggatgccttcctcagacctttgtctattttatttgcaaaaacctagcaattaaaatcacactaatattccaaagaagtatctcctatagcctatgaatttattctaaaacctaatgcactcaatagacatttacagatttctcaaagactgccgggaaataaagatttttctaatcacagcacctgccctccaggtacttacaggcatttatgagtcattgaaaagatacatctgagaattcaattctagcatatcattggacaccacacaggtgagaaggaagtggggtccccattcagcccgtggtagagcctgcctcactggtgccaggtcacttgagattcgttactgaaatggcccaggacaatgtgttctcttccttctttgtgaactcactgtgctttatgaattataatggctgccattgattggcaacctactatgtgccagagactactacagttaggtgctttccacacactatcacatttaccctactcagtaactctgtgagataggtgattttatgctcaagcttgtatcatgggtgagtaaagctctgtgagaatactgatcatatcataccgcaatgtttttcctttaaagagatgtttctcctctaaacaacagcaaacaccttaagcacaggaaattacgttattgtcatctctgtatcctcagaacctcatatacctcagtaaaggcacatagtaggcactctaaaaacatctgcaaaacatacaaatgaaaatattattgaaagaatgtagctactaaatacatactatgggcataacctatgcttaggcactgagaaaacagtggaggaaaagaaagaagaggcaaaggctttgattcctgagcacagacacccatacgtgactatggaaagaaaaggagaagttccaagacataagtaaacagaatgctatgtcaatacagctcatactaccagtcagctcaaaatcaaacagaaaaaggactcctaaatcagaggacaatgacacactggtgctgggctattggaaatgaaacctattaaagaggaaaaaagagagaggaggtagaatgtcattaaattcctttctgtttttgtaacatatctacaagaccaaatgatgtgaaaaatagttctgcaagacggggactatgtgaatccagttttaaaggtccaaatatgtatactttacttatatagatcatggcatagtaggaaagacagaagatcataaaaacaaatataatgtagaggtctaaaaattgtttcctggtcaggtgcagtggttcatgcccgtaatcctagcactttgggaggccaagccaggaggactgcttgagcccaggagtttgagaccagcctgggcaacatggcaagaccctcatctctacaaaaaaaaaaaaaaaaaaaaaaaaaaaaaaaaaaagcaaaaaaattagctgggggtggtgttgcccacctgtaggcccagctactcaaaaggctgagatggaaggatcgcttgatcccaggaggtcggggctgcagtgagctgtgggccaaggtggcgtcactgtgctgcagcctaggcaacagggcaagaccctgtctcaaaaaaattaataataattttaaaaaataaaattatttgttccaaaaaaaaaaagctgcatgtatttttcttttcttttgcttacctatcattatttttccacatctcttttcttggtacttcagacagatgaagataaatgaagcacagtagttaacttctttgtttggatacaaaaaatcttctgtatcaacaatattgttatgcaagcactttaaatgttgcttctagcagatgagacttctgcttcaacatatgttatggggaaaaatgataaaaatttattcatgactagaataactgaacagtcaacaaaatctaactagaaaatgtaataaatcaacctggtttgttgcagttgttaattatctaaagtaaactgaagatccagtctctcactccaaacaagaataaataatcccagattctcagcactgtcaatactttctatatcatcctaccactgctgcaaacttcttccttcagagtgatcggaatttaacttcctctgcctgcaccttccctgagacaggaaaagccacaaaagaaataaggagctctaaaggttcttctgctcaacaatggcaccttaaaaatctaaaacttactgagggagcatgtaaccccccatagaaaataaaacagtggtcaagcttttgggatctggactcagggtggcttgggttcacaccacagttctacaaatgtaatcttgggcatgtcatctactttcctaagccagagataataacattgccaagagtgtaacagtgagtgatcatatgcacagagcttagcattttacctggaacctatgtgtttcatgagcatgagctattgccattattacatcccctttgctacatccctcccaaagtcctaccatcgactcgcaatctgaacaaagagaaaggacctcaaaatccttactctggctaaactgggctttaaatgtgtcagatgtgtccatcttgctttccttcctcaccacccctgcctgccaataatcagagccatggaaaagcttcccttgctcatgcataaataacgtcctcattcatatatacctgtgtatgtttaattacagtaactagaggtctcaaaataactcatatggttctaatttcaaatatttaaagctcttaatgacacttgcttctgtgagaccagaagaaatataattgccacagcgataacatctaaagcccaagatcatttctcccagaacttatagcactcacagaaatcgaccaggatctgcttgcagtatcttttagaatttctgtctcccactgacacaaccgagtcataaacaaaaactgcagcacttgccagctttcacagcccatgacaactgtgagttacacacaaccttcaggtacaccattcaccctaataactgatttcaaaataacaaaaggaagtcaagcatttaaatgtagcacattaatatttgactaaaatagcatatcaaccagtagaaaaatcaaacaaggtaaattactcatgaaagaagaactacatgaatttctcagaaacgaagtcttgctggagaggtacatgccatgtcacttgcaaccaaaagtacttcctcagagccaatatcaaaagcaccggtgagtatgctgcaaaacggcatagcaggctgtcagatgctgcatatcagctacttgagcagttagattaagctttcccaacaggcaagtgctgcagtacttctgcatctagcatctggtaatgtgttgcaaacgcagaacaaagaaagcagcaggctccgaaatctttcagctttcctttgaccatctgcagcacttaaacacttcagggttaccaggtcagcaacgtgaattctctcaataccatgaaacatgagcaaaatttccattctctgaggtttctaattcttttctttttcttttttttttttttgagacggagtctcactctttcgcccagaccagactgcagtggcttgatctcggctcactgcaagctccgcctcctgggttcacgccattctcctgcctcagcctcctgagtagctgggactacaggcacccgccaccacacccggctaattttttgtatttttagtagagacggggtttcaccatgttagccaagatggtctcgatctcctgacctcgtgatccgcccacctcagcctcccaaagtgctgggattacaggcatgagccaccgcgcccagcctctaattcttttatttttctttactttttctgattgtattgagataatcaaatgatttttctccttaagggagtatggtaaattgtattaataggtttctaatgtgaaaccagccttacattattggaagaaaacacaatctggtcatgttgcttttaaattatttgctggattcaggttgctaatattttatttaggattttaaaaactcatgtttactagtgatattgactagtaactgcctttccttttttttttttatttccataggtttttggggaacaggtggtatttggttacatgagtaagttctttagcggtgatttgcgagattttgatgcacccatcacccgagcaatatacactgaaccgaatttgtggtcttttatccctcacctccctccaccctgtcccccaggtccccaaagtccattgtattattcttatgcctttgcaccctcatagcttagctctcacttatgagtgagaacacacaatgtttggttttccattcctcagttacttcacttagaacaacagtctccagttgcatccaggttgctgcaaatgccattaattcattcctttctatggctgagtaatattccatcatgtatatataccacaatttctttatccactcattgactgatgggcatttgggctggttccatatttttgcaattgtgaactctgctggtacaaacatgcgagtgcaagccacatgcaggagaataactggatcctcacctctcaccttatacaaaaatcaactcaagatggattaaggacttaaatctaagacctgaaactataaaaatgctacaaaaaaaaaaattggaaaaacccttctagacactggcttaggcaaagacttcatgaccaagaacccaaaagcaaatgcaacaaaaacaaagataaatagatgggacttaattaaattaaagagttttggcatggcaaaaggaacagtcagcagagtaaacagacaacccacagaatgggagaaaatcttcacaatctatacatccaacaaaggactaatatccagaatctacaagaaactcaaacaaattagcaagaaaaaaacaatctcaccaaaaagtgggctaaggatacgaatagacaattctcaaaagaagatataaatggccagcaaacatatgaaaaaatgcacaacctcactaatgatcagggaaacaaaaatcaaaatcacaatgcaataccacctttctcccgcaagaatggccataaccaaaaaaatttaaaaaaaatagaagttggcatggatgctgtgaaaagggaacacttctacactgctggtgggaatgtaaaccagtacaaccactatggaaaacagtgtggagattccttaaagaactaaagtagaactaccatccagcaatcccactactcggtatctacccagaggaaaagaagtcattatatgagaaagacacttgaggtttctgattctaaagtaaaacctccatcccacaaaaagcttaataaaggataataacaaaaccttgctttgccagcacttttgtttaaatttttgtttttaagttccaggatacatgcgcaggatgtgcagatttgttacataggtaaacacagcactttttttttaatctgacaaatcacaaatcaccacacagctcccatcaatgcctcttaaaaacaaatattttccactgtcttagggaagtcccaatttctttaaaattcatcatacaaattatttcctcaagttttcactcaatgaaaattcctgagtataacacaagactgacattagttctgtactcaaactctcagaaaattagtgctagttttctacagactccctgaaggtctttttaaaaatttttagaaatttgtatgtagtaatgacttgccaatataaatgtaatacagagacactgtttttgttcatctttgtatatccacctagtatagggcatggcacataccagacactcaatatttattaactaaagagtacgtaggtctgctgcctctcaaatatttgataatcagacttttgaattctaaatttcaagtggagaaattttctccattgaccatcattataaaactgtagtggtatatctttggaaaatatatgacctcaagatataataaaaaaatctttttttttgtttttttttttgagacagtcttgctctatcatccatgttggagtgcagtgacggaatctcggctattgcaacctccgccccctaggttcaagcagttctcatgtctcagcctcccgagtagctgggattacagttgtgcgccaccaggaccggctaattttttgtatttttagtaaagacagggtttcaccatgttggccaggctggtcttgatcccctggcatcaaatgatccacttgcctcggcctcccaaagtgcaaggattataggcgtgagccacagtgcccagcctaaaataacattttaaaaaacaacaatcattttagaatttcatgaatatcaattgatcagaaaacattagtgaaagtccagagttgttttaaacttagaaaatattttctaatatatatagttttcggaataataattaggtcaatgagctaaagatttccttttacagtttcattacaaatttaaaaagcttttgtagtaaaaacccatgaatgtaatcactatttaatagtttatgttttctaaaaatgtgtttggcattccatctgttaagttaggactccagaagaacttaccgctatgtccaaactgggttggagggggacaagctgggtttaaattgcgtttctttcacttgctaggtgaccttgggcaagtcatactaaacctcactttgcctattaccacatctctaagatggacatagaaataccaagttttgggaatactattcttgaagtatagtaattagatttgggggggttttgtgtggttccttacacctgaccctgtctctgttttggccaggggcatccatctgcctacgggatattcaggtttatggaaacaggaatacaaagagaaagactcagtgttcaattatgacacctataaatcaatattttcagtcaacaagcaaaattcttgacagccaagctttgtcaagagaaaatgtgctttctaaattcctaaaacactaatttttaaaatgagggctgaaaacggaatgagaagctcaccttgcttccatgagcacagctgcagggtagaaccacctaggaaggccttggaacgttacacggcctggggcccccacccccagacacttagattggtctgggctcaggaactcaagcattggcaagtttttgaaatgccatcaggtaattctttttttttttttttttttttttttttttgagatggagtttcactctgtcacccaggctggagtacagtggtgcaatctcagctcactgcaacctccacctcccaagttcaagcgattcttctgcctcagcctcctaagtagctggaattacaggtgtgtaccaccacgcctggctaattgttgtattttcagtagagacggggtttcaccatgttggtcaggctggtcttgaactccgccatcaggtaattcaaatgtgcagcctggatttagaaccgtagctccacagagaagcttctggtttggttcaaaactacgatccacacacaacaggagggaaaacccagaagtggcctcctggtcccctacagccccatgcgtatgttatgcagtggatcctgagctttcctgtgacccagtgggggtaatgcagagactaagactccccagagtggagagatggcaagaataaaagctaaggctagtccaggcacaagactagataaaccaaccacctggggcagaagagaatcaggaccagtctgcagtcttgctcccattgccatggaaggacaaggaggggaaaatgcaaagaattgagcatttatctgaaaaaaagacaagctacccaaggactttaaactacaagaaacagaagcaccattaaggggtaagtttgtccaatcatgtacattccttacttaactgcttccccagatgggctgaggtaagaaaatgtagttcaattataaaatatttaaaagcctggccaggcacggtgactcacgcctgtaatcccagcactttgggagactgagttgtgtggatcacctgaaggtcaggaacttgagaccagcttggccaacatggtgaaaccctgtctctactaaaaatacaaaaaattagctgggtgtggtggcgggcacctgtaatcccagctacttgggagggtgaggcaggagaatcgcttgaacccaggaggcggaggttgcagtgagccaagattgcgccactgcactccagcctgggcaacaaaagcaaaacttcgtctcaaaagaaaataataatcttaaaaagcgattgttaattaaaattatccaaaacatgaaaaaagaaaaagattagggagctgtgtggccttctcatattactctagagcactgtttcacagcttcacccaaggattatttaattccctagaagaatgccaatgcatttgactttgttacttgctgttagagcacagatagtgtgaaactacaacgttagcttatagatttctgtccagcagaaaggataactctaaaaactgtggttttagtgcatgcagaacgtcaccagttttgtctccaatctagcaatcttattctaatgcctaaagatcagttccttcagtactctggacctgcattaactctgcctggtttcctcattaataagttaatacatctttggcatttcgttttgtatttctgtgagagtcaggttttaacttttcaaaaaatttactttgatagtatattttctttgcatgactggtagtgtatgtaaatctaccactcactgacactgatctcagtggacattttataagataattcgactgcttggtgcagtgcatggcacttggtaaatgctcagtaaatgttactgttcgtgggtgctagtggctagaggagattttacctgcatctaacagtaaccatgaactcaccaatggaggtccacaaccataatccagggcaaccccgggtaagtggatacacagacttcctcagtagggactattcccatatatcataaatatagggagccactctgctcaaaataattcccaaactatcaacacagacagtacgactcacttgtatatatttatcacgagtgtgtgggcctgtgaggaaaaaactatcataacttagcaaaatcagaaagtacacagatctaaaagaagccatctccttggcgaccaaaagtatgctgctccatacttaaaggaatcttcaaatgatgttcaaatatatgatgacaggagaaacagcaacacagcaaaataactacattagcatatgaagagaggaaattggactggggaagacctgagagttttccagcaaaaactggagaaaagggaactaaaccatctacattccatagttcatcttctgtcactaatagtgattattatccactaaactatctaaacttttggccaatttctactgtcgcttgaaattttaaaagcttctttttggactgttcatttcagttactgttctcatttcactagacaagagaagccctgaaaaccctagtaaagctatcagggaagagatatatggttaatttcttaaattatgaactccttaagtatgacttctctacaaaaagtttcttcatcaatgaagtgcacctgtaaaaaccattccttgtctaaccttgaaattggcctgtaacttcaaggcttaactttcgagtgtgagagtttcagacacatcaacatattttcaaggccataaacactgggtaatttttcatgctcaagtgtctggagtttcgttttcctaatatcaataagcaatatcacaactagcaaggcagaaggaataaaagcacctcagcctctcacaatgaactgaaaaaccctatattctttccttttttttccttcacatcccatttcttttaccttgcccagctggtggaaaaaaatctagcttccttctgaactaaacacacataattaaatacacacaatcttaatttaccacactgatgtcttcatcatcagctaccctagcaccatttcaaagcagcagaaagaaatataataatttataagccagctcctgaggttatatatttattttaaaacatgccagtttcaacaatataaaatgctttcccatgtttaaaaaacaagactatttgttaccttgtgatgggacaattaaacaagcttttaagcgtgataaaaaaaaaaatacataggttaataaagtagtcttgataaaaacaaagcaaagatttgaaaacattggtatttccataacctacagaatactgatgactagatggtcaagacaagcatcagttacaaattatgtatacagcttgctaacaaattagggaaacgttcccctctggtttctttcccgactacttgtaaaataatattcgcatacaaatttgcaattcaaatttgatgtcttatgagtgcattttgcagatcatgctctgagaaggaagagagtgagctaagagttgcatggaaagtataatttgctgctggcttttagccagaaacactagaccaaatgtttatggagaccacgaggcacctaagcaagcccagtgcatctggacttctcaatactagttgttgctatttatttatatgttaacctccaaataaaaggtcaaatagagtaatatctacattacacattcatacattttaaaatatatttattttacttacacagtacaggaaaggaagtgatttgccgtcactttgagaacacttgcaatagcaatgacaagaaaaaccagtaatttaagcaacactaataaccatatgtctggacctatgttcaactgtaatttacacattaagtataagcttttattttcatacttgagaaaacatgccaggtattcagtatttataatcatagttaacttgcagaatgaggaagctaattacagtagaaagaagaaaatattagccttgggaaaatatgaatttgacgatcacacaggtaggtagtaaaggagccatttctacctcccatgaccaatgcaatacaccagcatcttagacttactatccaacacaccagcatcttagacttactatccaatacaccagcatcttagacttactatccaacacaccagcatcttagacttactatccaacacaccagcatcttagacttactatccaacacaccagtaccttagacttactatccaacacaccagtacattagacttactatccaacacaccagcatcttagacttactatccaacacacaagcatcttagacttactatccaacacaccagcatcttagacttactatccaacacaccagcatcttagacttactatccaacacaccagcatcttagacttactatccaacacaccagcatcttagacttactatccaaaacaccagtgccttagacttactatccaacacaccagtaccttagacttactatccaacacaccagcatcttagacttactatccaatacaccagtacattagacttactatccaacacaccagcatcttagacttactatcctacacaccagcatcttagacttactatccaacacaccagtaccttagacttactatccaacacaccagcatcttagacttactatccaatacaccagtaccttagacttactatccaatacaccagtatcttagacttactatcactgtcaagtattaaagcagatatgatcactatatggataaatatattgctaataaaaatccactccaacataccagtcactccagcacagcacaatataaattttgtagggatatgctgcagtaaaccatgtgacacagtaaaaggaatgacacattacaagcttcccttaaacagaagaccatgaacacgtattgccaacctattacttgagagcatttgggggcaaaagagtcatgctgaaattggagtctctgcaaaaggaacacaaagggctgagcaaacaacaggaagcttaggcagggagcatggcagacactgaaaaaacataaggaaagggtcaacatatagccatgttcaagaacataattttagttaatgctaagtattaagactgaaaactgaaacatgggttgggaaaaattgctgatgaaatcaaggaagatcacaaagaatcattccaaaccaccatatttggtgggtaaatgtatctgtactgtaaaaacactgtaccataaaaaacaacaactagatcatgtatgatgctattccatacatggtggtaattatgaggccaatttgcatctcctcaccgagaaaggattgtgaatccccaaactacatcatatcaccccctaaagaatgttatgggtccctgacctagtggatgatctctccctctctccatgaggccccagcactgacagatatcttctgaactatatttggtcatgtagtctgaacaacaaatcattcgcttgctacctcatctacatgtattatgtacttggatgttttgctggcaccctagagatctggagcttttagaaggctactttaccataggtgtggtaagtgtgatcaatatatacctttaattaaactgtaacttattttaagccagtatcagaaggcaagttaaaaaattagaggactgtaacttctaagtagtataacacgcacattagcattcacccacgtgcttccacttttgcagacatggagcaaaagcagccctcctgctagtgagactactccaagaaaacccctcccccggcacagtggaaaaacccacgacagtctcagaagaagagcgtctatcccaggattcaaggttaattcctttgctctcaccttctcagaaatatcacttcatcattaataacccttttgcccacttatctttaaatcttcatctttgctggctcacacattcaaatctcttcaaaacaaaaaaacagaaccaaaaactccacactcctaattagtgccctattcttttcttctattcacagtcaggtttctcaaaatgatcaagcactcatgactctaaggtgctctagcaaagctcaccaaaggattccctattattgaactcaatgaaccttttcagtcctcacgttaactgacgtctctgcagcacttgaagctgttgacctccatgaagtgctttttctcccttggtttctatgatatctttctctccaggttttcctcccactttactccctctcagtcgcctttgctggcttctctttttcagcttgccccttaaatgttcctgttccaaagtgttccatccatgctgctcctattttcttttctacctaccctctccctacattccttccacctccacagcattagccatcatctgtatactctagagaatgtcttcctcatttctaaataccggcgtccccagcacatagcactcactcagtaaggtcagatgaaagcctgatgaatgatagacaattacagaagcaaccagggcccactatgttgcagagttagctttagcaaattctaatttcttgaccagattaaatctatctacaaatggtcagtcttactgagggctgactaccattgcctgtaagtgttcagctaagtgttcatttagtcaacaaatatgcagtgcctgctatgtgtcagcacagtgcctactatgtgccagctacatgataggccaaagaattcgtggagaaagccctgaaaatagaaacagacaactctttctgagtccatgtatacatctgtgtgtgatctgggcaaaccaattaagcttcctttttttttttaagacagagtcttactctgttgcccatgttggcgtgcagtggtgcaatctcggctcactgcaacctccacctcccaggttcacatgattctcctgcctcagtctcccaagtaactggaattacaggcacccaccacctcgcccagctaatttttgtatttttagtagagacatggtttcaccatgttggccaagctggtctggaactcctgacctcaagtgatctgcccacctcagcctcccaaagtgttgggattacaggcatgagccatcgtgcccgacccaattagcctttctgcctacaaatgtcttcatatataaggtgagaataatatatctattttacagggttactgtggaggttacatgagataatacataaatctaatatgttgcatattacttatgtctgttattcactgtgaataatatgtaataataaatattttatgtactcctttgttaaaacaagcttataagacaagttaaggcaggaattagtattcccactcagaatactaattctattagtattctaatagcagcaccagaacctaagcaatctccccaagcccactcacgcagtccctaggtggtaacgttctttagtgtcagagaccaaactgtgattctctttacttagtatctcttacagatcccactgctgcccagcagcataaaagatcctacccagaaaagggtctacagttgagaagccaaaggtcctaagatagtagccgaggagttgatgagcaaacaaagtgtttgttttcttaataaagaaaaacagttttctgcttggacacagtgtaattccaactataagaggcagcataatgttttcagtcagggaaaggtctccaatttcataagttttgatttaacaagaagattctaatattaaaaactgtcaggttgccacggtaacaatctatttgcaatcaagatgctggtggtattctgttatatttctctcaaggaaaaagtaaactagatgtagccaaggaatttaataaaagtatctgttggaccaaaaccaagatatgactgtttttaggcaatatgacaggatttaaatatacagcaagagaccctcaggttacaataccagttccatcaataaaattaaaagattttgaccttgacaccagtacaagctatagccatatgatctggaaatctgaatcctctgagcaagaaaaataaatcgttaaacaattgagatgacaggcatgggacaagaaagtcaaaattcatcagaaggagaacaaaatcaatccccaagggaggtatgaattataaagactaaatttctcacagaaaattcaaaggtttgatttgggtgttttgttctgctgttgtatgtatgcatgtatgcatgcggaggtaggttttgcactccaggacattcttggatgtttttaacttgctgctttcatctagaaaatgttagaaggacatattgaaaatgaactgattctagacaggagaggaaggaagtgactgtcaggaattaggccgctctgagtctggacatgcagactatgcagacagagaaacttcctccacaaccaccgaagcctcagtcacgcccatgaaaatcacatggattttctctacagttaagacttttcaagtacttgtttctacaacgattcaagaaatggtaacacttgcccccacaactttagccatgaacaactcatttctcttcaatgtgttaataactttacagaactgtatatgcatgctgaatgtctagaatgacaaccagaataaaaactgcaactcctttggcttcgacaataaattggcttcacaagaaaatacctacattcatgacagaagaaactggctcttgccttaacctatatagttaatgcagatttatatataaataacattatatactttttagaacatatatttttataaatgtatatttatatacaaaataactaaattattttctgaaacagccttgaacattgtgtgtaatctcattttctgtaagtcattttccttctactttctctataaaattggagcactgtcctctacccctccgaaaagacatttgttaaaatcacagtgaaggttcagcataccttagaaaatcagacattttaaattctatgaagttcagacaaaatattaatacaatatgatattcctatttaaataaactcctatttaagtgattaatgaatcatttatgtattattgtactatacttagtacagataacatatttttgttgagatagcgttcttaaagatcacagagattctgaaaatgcttctaggttgaggaacttaggtagaggaagctaacaatcgatgaatacaataaaggaaactcatgagtgatagagatttgaggaaagtgctagataatcatccagactttaaatagtttgggcaatgattcagggacataaatggccagcagttagaaatagagttggaactcaggagggggctctgacacagagacaaaaatttactcattcacaattaagtaatagttgaatctatttagaaaaacaatgtgaaaaagaaagtaagaaagagaaacaaggaccatctttgagagatgccaacatttaaagatccatggaggtgaaacaaacaaggtgacagaggtatcttcaaagtcataaaagaggagtttcattaaggaaacagtcaacaatatatgcctcagaggagtcaaacaggacacagaaagagaacaaaatactgtattcaacatttaggatgtaactagttacgtgagtgaattcacttcagtacggtagtagaggcagcagctagcctacaatgggttaatgagttagcagggaaacaacgcatccaagaatttgtcttatattctaagatcaagaaccctcaacgaacaaaggtaagtgattcaggcttacatcataacccttcctaagttaaaaggacaagagcatttgttcaataaggacagaacctgaaattactggcttgtaatgaaaacgtttttaaccctaaacaagaataaatttcttgactagaatatttttctgatgcatcaaatgtcaaatattcaattattctgatgtataaataccagagattcactgtattgaccagagaatgctatgaatctacccaagattcacaatacttttcaattaaattaagcaatttttccttctaagacttccatttcagttctaaatatgtgttatctccattcatccttgtctcataggacaatgatcttcatattttagaggtagacagctttactctttggtttctgttaacaggacatcttgaatttaattgccaatgttatttatgaattataactgtaagagtgcttttcagtatgatgaatattccatcatctttaatttttatgagatgcttaaaatgaagggggatgggacagtctagctgctcttttcctctcttgctacaccctcttctggaaagacaataaacaacataagctttttcctttgtctatataaacctgcaggttcacagacagtgccacttgtcaacagctaaagagaaataagaaaagaacttcagaaggggaaacattcataaagagcaagagcacactgaggtaaaaaaataataataataaatagaagctattacagcaggaaaaaaagaataaaacataagtgcatactaatatcaagaactacaaaggtggcaaattgaaataatctaaatactgaatattaatttttttctatgaccaaaatcatattaaagcttacaaacccaacctaatgcctaatgaactcatttaagttcaaagtacatgaatgtaaaagaaagctgaatataaagaggctatcttgtgttttcaatacaatttaagtgttattataggagctgccacatttgttcccaagtatcccttcataaaatatcagagacaagatggaggttttgtactaataaagtaaaaggtatacttccaccaggtaaaaactttctggacctaacagctttaaaaataagattgtaccaaaagctatctttatataatgatgatgactggaccatcaagaatatgcaacactccctgtatattatacttcatcatataaagaaggaacagctctacttttaaaagccagagaaaatgtctaggtctgcctagaactgtcatggccttaaaaatttcatggggaaaaaaaagagtcaaagtctcatggttttattatgcaaaacttcatgatttcaaacccaccagaatcaaataactaaaaaatgaaaatgaaaattacaaagaggcattacttatatcacttttaagattggcaaggatgaaaaagagtaacagtatcccgtactagcaaggctgtgagtaagcaagcagtgttcttgtatagggttggtggagtgtaaatgcaatatatattagagcacaacctggcaacatatataaaaatgtaaaatctgtttctgcaacttcatttctactaatttatcctatgtaaaaaccagtttcatatgcaaagatagatgtatactgatgttccctacagtggaaaaaaatggaaatacttcaatagcgtactggttcattaaattttaatgttacatgcagccaacaagtgtatgaaaaaaagctcaacatcactgatcattagagaaatgcaaagcaaaaccacaaagagataccatctcatagcagtcagaatggctattattaaaaactcaaaaaataacatgttggtgaggttgcagagaaaaaggaacgcttacaaactgttggtcggagtgtaggttagttcaaccattgtggaaaacagtgtggcgattcatcaaagacccacaaacagagccaccatttgacccagcaatcccattactgacacatacccaaaggaatataaatcatttatcatgaagacacatgcacatctatgttcatcgcagcactattcacaatagaaaaagcatggacaccctaaatgcccatcaatggtagactgaatttttaaaatgtggtacatatgcactggggaatactaagcagccataaaaaaggagatggtatcctttgcaagaacatggatggaactggaggtcattatccttagtaaactaacatagaatagaaaaccaaacaccgcatgttctcacttgtaagggagggctacataatgagaacacatggacacacggagaggaacaacagacactggggcgcacttgaaggtggaggatgggaggagggagaggatcaggaaaaacgactactgggtactaggctgaaaaatgactactaggtactaggcttaacacctggtgacaaaataatctgtacgacaaaccctcatgatacgagtttacctataaaacagtcctgcacatgtacccctgaacttaaaattaaagtttaaaaaaaaaaaaagttaacaaagtttaacatgttcatacaatggaatagtatacaaccattaaaaaattatacgtggtatgcatgtagctgtgtatatactaaataaagatataaatgtggacccaactgttaacagtgttggtctctaagaagtaaggtttctagggtacttggatttctcatttgtgcttttacttactttaacttttcataatgcacatagtttttttatagaccccaataaacatttcaaatgagtgataaaatgtattagcacagttgaaaatgcacatttgcatgtattatagacaatggcttttgttgtgttgaaggatcaaggggacttagatgtattaaaggtaatgtgatggctgtctatagtctgctgttgttattaccaaagagatttctaaaatacccaaaattgccttcttaggtgtacgggtgaggaaagcggccagcaatgtttaaagtattacctgaatgagaatgctattgatctttgtggtggtgtgggacgccaaggtatgaatctggaattttcaaatgcctctgtgctttccaggtactaaaaacatgaactctaaaattacagacacctaggttaaggatcagttctaccactgactagctatgtggctctgggcaagttccttcatcttcctaggcctcagtcttgtctcctggaatacagggataataatagtacgtacccccatagaactgttgtgaagatttaaaatataatatatgcaagccacagtgcctggaatacagccagtattcaatgttggctcttatccttctcaaagcacatcaagtttgctttttcattactgattacaaagacctcaggaaatcaaagtctggattttattgcaagcaaaatagaaacaagggatattaacttcagatcagataatagaaaacacccagcctgtcagtgaagttcattttctttctagaataatgctacccgtcctaagggtagttcagctttgtagagatagaagtcgtcactgattatcaataccaaccctctgactgtgtgaaaagtattaaaatactaccagtaccaaatgtgcacatggaagactaatgaagagcaaaacccaaatctgcctattaagcataaatgggaacttaagggaaaatctgaacaaagtctaatgaacaaataaaatataaatagacaatgaaaaaaatattgaaactagtccccaggacacttccaccattcgacagattcaaatcagcaaacatttattaagcaattcactgctctcaagaatgttcaattctcgtgcaggagccaagacaaaccaataagtaactgtgataaaagacaggatgagatgagtgctggaaaaattccataggtgcccgaaagggaggtagtacacttcctgcagggacaagggaaaacaataaagctacagtgggaatggttttcaggtatgagtacaaacaagatggccacaaattaagattgattcacctagcaagtctgaagtaatgagaatatgttttaataaactgcatgcacacattttatactgtctattgagagtctgttttataagaaatataatgttacgtgctataagggaacacaataacatttctgacatctcctaagctttacaatccagctggggagcaaattatgcatattgtattgtgaattccccaagggcaactgatgtgtcttttttatctttctattcccatcctcttgcacaatccctgcaacatcactggcactaaatgtctggcaaatgaataaataaataagtgactataatacaaagcagaatattatacgtgtcactgataatccgtattagagaagtttaagagagggacagaaagtaagcaaggaagctgcactatttctgtcatctagcactcactcctcatattcctctgaaaatcatcccttcctcattatctgtctctgtgattccttggaacagactcccagggaggacatgcgagctaaggcaagcacatagaaataccgcgtttccctggttatagcaattgcttcaagagtgcatacctgccccaagccccaccagtgaaatacaatcaccactaatcttggggattatgcttaagcaacaaaataataagttacttttcctgttgaatttggagctgagaggatgaaaacctagaacttttggccactgtcttgccaccctaagaagaaaggctatcagagaatcgaagcaactcacagaaggaaagcctagcaatggggggagaccagaccctaataatgttgtttgagcccctggccttagcaatgctaaaaggaagcatttttcagtcatagccaacaaattccttttgtgcttcattcaatgtgggctggatttttctgtcatgtgaaactgttttcatgaaaagactgaattagatttcatcactgaaaactgcagtgggtttttaaatacagaaggaattcaggtgaaaaaaactgtataaacaataagtgaagtaagaaaacagaagactacttctgttacaatgatttatatatatatatttcaagtttaagttcagatgaagactgaatagaatgggttagggttagctaagtaggctgagtatagcaaattggacagttcatgcttcacgaaggggtggctgctacccagctcaagaaaattactgcgatgtggaaactgacccaatatggccacaactcccaattttccaacaaaaagctcaatctagactttacaagaactggcaggagttaatagcaaaagaatgagtttatagcaacatacagaaccaataagcaagtctatgaggcaggatccagcagttagctttgtgactcagaggttacttaaatggccaagaaagtaaaatcaaatccatacaaaaggtatgtggacccaagtaaaggtttcctaaacaccacaaatatgtgggtcttctacggaacactatatgacaagagaaagaagagagaattgcggatatacagaaaaagcaatggaatgaatagctacagcactgagctcctaacacaacaatagctgaagagcagacagagtctatgctctcaagtcaggctgcctgagttcctacccaggctctcctactttgttgttctgtgactcctttgaccaagtgtcctcaagtataaaattctgctaataatagtgcctgcttcacagagttgctgtgaggagtgcatgagttgatacttattgtggttggcagaattttaaggtggccccaagattcctgcacccctggagtacacactctgtataataaatgagtgctgttttaagccactaagatcatacattcctccctcagtattgactctagcacccctgtggataccaaaatccacaggtgctcaagtcccttagattacatggcatactatgtgcatatagcctgtacctatcctcctgtatactttaaatctatacacttataatacctaatataatgtaaacactatataaattagttgttatactcttttttaaattttatattatttttattgtactgttatttttcatttcaaacatattttatttgtggtgattgaatctatgaagaacccaaagatacagatggctgactgtagtaatttattatgcagcaatagaaaaatgtgtacagcgataaagtacttagaacacagcttgacacataggaagccctcaataaatatcagctattattattggattctatttaagtgtacattctggtacatttaaaatagcattctaattacaaaaattcagtttgtccatatcatgtttgctagcacagaagatgcacaggcagacagatgcatcccagtgatacaaagaactagggcaggcaattgactaaaaaatactttctacaacacgtgtattgagagtgattttaaagtgattttgtagaaggaaactaattattgtgttcatctactttagactggaatccagttggaaataagttcaggatattcaatgatagtctactaacctaaaaacaaaatataacatcacaaagttatttgtaatacatattgggtcaacaaatacttagcagagaacaaagcataataattttactggtaaatgaaattatagttttatgtatgtgatagtattaaataaagatactatatttcagatgctcgtaactaagaaaacaagccataatacaaaatacatttgcatgaactcctatatagcacacgtacaaaacaaatagtataaatctgtataaagcaggcagcaaaatataatgaacttgaagtcattcccatggacatagccataatacatatagaaatttatttcagtttaaaaaactagttcaaagcacattgtaaaaataataaacatgaaagactttcaatgtaatgtgtacatatgccataaaagtacatatttctctgaacattagtaaatgaccagcaactgaaaatatgataaaaatagacttcaatgaatacataagcaggaaaaaaaatagagaggaaaaaggtatcataaagattttgatgtttagcctcaaagccaagtaaagcaagcccaaagcatgaaaatccacttactagcactgctagagtttggagttttctctttatcccaagcatttatcccattagccacacagtcaccattatctttaaaatacaccccctgcagcctaatcgctgtacaactcttgacattaagtttgaacttaatgttctgtcaatgcctctgctgctttctgagccataggctacaaattaataacttcatatgtaaagaggaaaagccccatgataaacctctgtgggctgcggcttgtttgtttttaaaaactaccaatgagacatgaaactttcatctttgttgagattttttatgttcctgcactccatcattaagagcagccttgcttgctacagcccaccaggaacaactaacatatacctgcttggtcttacaccctgcaacaggcacagaagatagaagctaaattctcatacgattacttggaataaggagcatgtgttactttacaatctattgcctaacataagtcccttttcctgaggttgccataagcttacatgagaaggtgtcctaaatctctcacagtaatgctgaatccgaaagggttcggagcactcattttgaggagcacagacctcattcagtgaaacaatgattaaagattctgtttcatattttattctaaaatcttacaagaagatacagaatcgcttccagaaaaatgttgaactccaacaacaatttaatagaattatagaaaatctcatttcaacacaagcctcagcagaagagcttccttgttatcttcaatgtaacacaaatcatctttttaacataaaatattaggaatcatgctaatttcacagctttgttacattagaaaaaaaagttaatggtcaattcaggctgcatccattttataatgtacagataaggggtattttctcataaatctgcttaaaaatgaatattaaagagggataacgtgacaccatgtcaaataaacaaataaggatgataaaggaaatatagctatttgaagaagattatttgaaataacacatgggcttccatagtcatatttagagaaacattctaactaaagtcagactttgtattaattaccacagaattcttaattacaaaatctaacatgaaggaataaaaaaacattttaaggttcctttcttcaaaaagtacacaaagttagcttgtcctacaattttcagtcattatcttatcttaataaatgagtatgatatttaacagcccaactctcctctttaatttgctcttgatgtctaatggcagcgttcaaccatgacaaagcaaaattactaaagttctcaccttcaagtttagaaagagctattgttgataggtgagccatgtactcacacaacttacagtggatttgctgaactctcttggtggcaccacaaaatatatttctgctcctgtcttcattacaaatcaaaattgaaggcttatacaaatttaagctgcattaaaaatattcaacaggatcccagcacattgggaggcggatcacttgaggtcaggagtttgagaccagccaggacaacatgacgaaatcctatctctactgaaaatacaaaaattagcagggcgtggtggcgcctgcctgtagtcccatagtcccagctacttgggaggctgaggcaggagaatcactcgagcccaggaggcagaggttgcaatgggcaaagattgtgccactgcactccagcatgggtgacagagcaagactccgtctcaaaaaaaaattcagcggggtgtatcttcaaactttgtgccattttttcccttgaaataaaaaaaaaattagaaactgggacagatatatttttcctatttgaatgctcatgaataaaactatattttatactctaaaattataataccttaacagcatggtggaaccactaacagatatggcttttcaatggatagtcactttagtactttagtataatacttaagagatcacacaatacataaaaataaacctctatctccaatttattatggtataagtattaccaaaattaaatttgtacaccacttttaaggtgtaatattgtaaaactctgcactacaaagaattaattgaagcaaactcgctcagataagatcattttgacctctgttcttcacgctagacattttcattacagaacaaaacagtcacaagtttactaatcctaaatgacttggcaaagccaatcctaatgacaaggattttgccgagtcatgtaggatttaagtgactctgtggttcctggtgagatacagtacttcaaaacacactggctgatcctcagaccaatgacctgacatcaagtcagatggaagtaactttgagtttcaaacataggggaggatgggtttttcttaagaatgaaaaaaaaaacaactcagcttttcattcagagcaatatattctgagaaacaacttatcattttggtaaaaacaggagaagcctaatcactcagcttctactctggagtataaaatagttttcacacttttagtccacatgaaaaatagctccgctgaatttctaattgctgtatttagtgctgaatttgtccttttatatattggccacctcctttttgaaactctcttcttttatagatctcaaaccacctgagatcccaaatcctgagtcaccttaagtggctctttctcttcatgtctttctaaaaatccttctcagtttattctgaaaagcagaaaacaaaaagcaaaataaacaaacaaaggcctacagccacgtttcccatttgaagaaccctgctctcataaattaggggattcttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcatgatccgcccgcctcggcctcccaaagtgctgggactacaggcgtgagccaccgcgcccggccaaattaggggattcttatcaggaagagaaagcagcacgaggagggctcacaaagggaagtgaggctcactagaacagccccaggcataaattgcaggggaaacctgaaatcaactgctcctaacccaaaacaggcacgtccgtcaagcatgaaccagcagcaagaagctccttggcatccagtcacaaggatctaatctcaactccaggtacctcggtagcctatttgcaatggtgactgttaaattctaggaagtcagcactgactcttccacctacagtatcttccattaaaggccaaatcaaatgatctccccactccaaatctccatcttaggtctccgcatcaccattatcgcagtctgctggagaatactgtgagcacctccatgtactgaacgtggaaagcaagatttacaaaaagaaggcagcacagttttgctttcaacgaatcttcaatataactatatttatttatatatttctttcatttatcctaccagacagggcggaaatgaagtcttaattatccttatttctccacatggtgctgtgaatagagtcagtacaaatttgttgaactgaaatttattaaactggttctttctgacctaaaagagccaagtaagaatcccactgctttgttttggccctatttgtccactttttcaatatgccatagaaataaaaggatgacaagtcaaaccaattttcccccacttctttactgcaaacaaataatactaaatattataataatataatactaaatatcacagtgatatagagaatgagggagagagtttcgtcccagaagaaggccctcctagccgactacaacagcaatctctagaaaaaccccctaccaaactgacaaattcaaaacagcaataccatatgatacttaagaggaagaatggttcacatttacaatttatgatagcacaaaggcactccagaattttatgttcagtgtactgaatagaaagcagctgttaggcaaagcatgattaaatgacttcaatatgggagaattaatcacattttcttatactcgggattctgctgtcactcaaaaataaagatggaaaggactgtaaggtcagtatttttaaaaacaacatcaaaatgggcacctaaactagtatccatctaaaaaatgtaaaatgactcacaggcctaagatagtaagattttattatccatctaaaaaatgtaaaattacttatgtgcctaagatagtaagattttattatccatctaaaaaatgaaaattacttatgtgcctaagatactaagattttaaaagcttatttgcactaaaagtttttaagaagcatccgttctgtattaatataattagtagaacatcaaaggtgcctccaaaaccaatatgtattttttaattgtgaaaaaaagtttaatactagcaatactaaaaaaaagttaaaaaaagcttaattgttaaaaaaaagtttaattctcatttaattttcatttcacagactaggctacaattctagcaaaacaatgcatttatcaaaatacatgatcacattatgccatggatgggaaaacagaaatataaaatacatgcagacaagaaaataaaagcaggcacttggattatcatactcctccagccagacgaaggtatagtgaactagagagttcaccacaaacaggaatagaataaccaaaaactccaatacatcaaacatgtcagaactgaatggctgcctgaaaatgaatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactgcaaatgagctttactttatggaataccagacactacatgaggaaatctaggtttttaagacagagcaatgagcttgccaaaataaatcttcttccacaaaaaggttcataatagaaccctgttaaactctaaattttcctagttaatataacctggtatattatttataaacattataagcaatgttttcaggaaaaaaatttgctgtacaatacagcactgaattctatgtttatcattttgctataaagataattagaagtaattagtaacttggcagctccaatgaacaagacctgcttttttcagaaaccattaatcctttgattcttcatagaggacaagagaaatcggaggcaagtctacctgaaaagagagaatgacacgaatagactggaagaaaagagctccaaaatgtctggaggtgagacactgacattcattttcagcagccattcaatcctgatggactggagcttttagctcttcccattagtgatgaaatggccagcttaagatactagcacctaactggaggagcaaaataatggaagttgctgccctttctcttacccacttatattttacacttctgctttcccattcctgtcctaatggacatgtctaagagagttgtgaaaggtttcctagaaaaggcaccatgtttaaacgaaatttgccaggcagagctgaagaaactgtacgagcaaagcttggaagaagaaaaggaatcctgagttttaggggaaaggacaaagagtaaggcttttttttttttttttttttttttctgagagggagtctacctctgtcacccaggctggagtgcagtggcgcgatcttggctcactgcaacctctgcctcccaagttcaagcaattctcctgtctcagtctcccgagtagctgggtctacaggcatgtgccaccacgcctggctgacttttgtatttttagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaataaactaaaagataatttttaactatacagaacataatgtcttgtttccacaaaatgctaaatactttgcaagattctccttgctgactctgaggtggcagaaagtgacaaatatcatccaaatcttactgatacaaggaaaatattttcagcacaaaaaaaatctttgtagcatcatcattgctctaaagaaaagctagaagcctgccataatgattagcaaactcatatagatatctccaggaaaggatttacaaaatgtcatcacatccttgtaatcatctaattatcaaactcagcagtgttgacaaagcacaagcccactcagctactgctaatgattattattcaaagctacatttctaccaaatcagaataacttacaggtagaagctcattagccttaggaaccaccctccttgaacactcacacgcacacgcacacgcgtgacacgcatacacacacgcgcacgcgcgcacacacacgcacacacaccccagccataactaggccttgctgaattgtcatttgctttcatgaccctccttcgtgtatatgagcagctttacgaattggttcaaaaatacccagcctttcaaaaataattccctatctagaaaaataccctacagacatctatatctagagaaataccctatggacattagtttgctaatgtcatagcaacagtgcggcaggcatcgtcaagctttggtggcttgaagaaacacactggcaatgcaacaatgggaaggagctaaaacgtaatgtaagtgacaatgcaacgtgaaggaatggaggcataaaggcaatgcaacaatgggaaggactgaaagcataatgcaagccatggaggaaaagcatacactcactgaatctccgcaatctacttgtcactacaccaggtgctaggaaaatggttacgaccctcaagctgcttgcagtctatgcaagcagtcagccagctccaggaacgtggcatgagatgaagcttgcagggtcctcaaatgccatacttaaaagccttgatttcatacaaaggcagtagggaatcaacagacatctttttgcaagagattaaatgatcaaatctgggttttttttcaattatctctaatggcaaaatataaaaatgaattgagactcagggaaacagtgagaggcaaggatatgagttagaggccatttaggtgagatcggaaggattttaataataactgggacagtgacaaaacaatataaaaataaaacaatagagtcaagagatctttaaaagcagcataagcagggcatacagaagtttgggggaagaatcagaggtattcctgatattcctggcacggctggctcaggagattgcaacgtcaagagagaagacagcaaaggtggagaagcagtatgctgtgcggaagaaaaggcagagtttaggcactgcacacgacgaatctgaagtaaaaccaggtcacatagatgaagatttttgttggtatatagaaaatatgggatgagctcagaaacacaggcaggcaagtaaagccatggcagcaccatattgtcattcaacaggtaaccagagacaaatcagcaaataacttttaaaacaaactggtgagacaggcagaaggacaatgatgagcaggttaaaagacttccgaaggttaaacactatcacacctcaaatctgcataccttgagatttaagtgggtattgttggttttggtttgtttgtttttcgtttttttgagaccgagtctcgctctattacccaggctgcaatgcagtggcacgttctcggctcactgcaacctctacctcccaggctcgagcgatcctcccacctcagcctcccaagtagctgggaccacaggcatgagccaccacaatttttgtattttttgtagagatgggttttgtcatgttgcccaggctggtctccaactcctgagctcaagcgatctgcccacctcggcctcccaaaggactgggattacatgtgtgagccactgcacctgggcaaagtgggtattgttccataaaatcttggccaaatgggaaacaagaaaacccacagtatagtcacttcttattacagaagacttttgaggcccccaaacaatataccttaccaacttctgctctaacctgaaagacccacagccactgaatgattgtgaaggaggaaaaacagaccctaggacaccaaccagcaagtcacacacgcctctgcagatgctgtattggctgaagaaaatgctgccacccatcggggaaggaaaggaaattctattaaggatatttttaattctgatcctaattcaggtgatcctaattaaacagctctgcataaacagtgtcttgataaatttttcctataagcatcaaaacgaaaaccaaatgtcaatcaaaacttgaaatagcgcccatgactgccaagtctggtcacatgtagctctaatgcttttcttttacttgacaagtatttattcaaaaacaacattttaaaattatttgcctatgtcattaatatcaagtataaatgttaaggtcaaataaatatcactaaaagaaaaagaggtgttaataaggccaaagagtattttcttatacactgcatatatagtttatagcatagaaaatgtttaaatctataaatgcatgtatctatagaatcatagggaaaagcacacccaataatggcttgaaaatgataaagactcaatctggagggctcctgaataattaatgttttaatatgcagtactaaaagattgtagaatgcagatttcaaaaggtaccttaactccatgcaaattccatgtcaattatctttattttcacatacagttgtggcaacatcagcacagaatcatttgacatgaataatccaccctcctcccactcaaactaccagcatttatttagatttgaatatatgaaggacagaggtatgtaaggcatgatgtaccacctggataaaaatagcagaaatcctgattaaataatttacagttttgcctagagcaatactttagtattagagaatattatcaaatattcttatttccatcattctggattttgctaaggcttataatggtccataattagggctctaacagagaactaatataacacagaatgcagtatggtggaatgcagaaaataagaactctggaatgaagaaagccatgttaaagctctgtctcttttacttaaatatagtgtgaccttacgcactttctcatctacaaaggcacgatacccataactcagagggctactatagaagataatgtgaaagtacacattaaagtacttggtagaataaaaaattaaaacaaaggagtgcggcactaggaaacttgtgatcaatccgccaattgtcccttgatctgttgatgtaagacaggtaccagtgtctaatactcatttgcttcctggaaagtatgggccaaaaaatgggaaatacaagacaaatccacatactcaaatatgtaatacagcagttctgtttataactgagttatctgaagggaaggcagacagctggtttgggaagccaaaatcatttaaacacggacatacagaatctctgaattgaaactcatcattagacaagctaatctagtttcaaatgtcgaacgatactattctgtaacttatttttaattttctgcctttacacagataggcttcaatataagaaacagatattgctgaaaggttgtctgtaatttaacttctgtttgctgtatcacattttcacttcaacttagcagctaagttcttgagcacttgggcatcaactaacagaaagggcattagacagaactcagaagacttcagttctagctttcttcctgtcactgggtgactacttccccctctctaagccacaactgatgtattctggagaaagggagaggagaaaaaatgggaaggctatggtatcagagagtttctgtgatctcttcagccctaaagttgtataattttattttgcttaaggaagaaaatggggacacatgacctattttcatgaaatttatagtctaagtgggaacctaagaaaaaaggacagacaacttagaaagtaggggatagtcacagttgtcaaatgcttggcatagaaaataacagtgactactgattttacaaaagggaaagctcaatcctaaccaagtagatttcaccaaagatctgagtagaaaccttaagaataagcaggacctcaatagagagggcgagggaagataaactacacccttccatgatgcaccagaaatatcacaaactcacaaattcaaagagcagtttacatatcatctaggcctaccttatagagacaacccatcctgacacgtaattctaatcctcagtgaaactcttccaggaagaagtagcttccagctgtaccaggacacgctgatacgttgttggaacgctctggttataaagctcttctagataataaaacagtatttttgtcctttcttcatcatgctttgtaaatagacatttatttgaatatgtctctttaaacatgtaacattaggtactaaacacagaaactgtaatgaaaatcaacttttgaagatagaaggaagactcttcctctttgattaagatgctttaaaagaatctggtttggcgaagccatccccaaactcgcctgcttacctttatgatataccaagtcatcttattttccacatcaaatggcaatgtctgatttttgcccctaaaaaaaacactctgtttctgcctattacaaaatttaatagagcagtttatcacagtttttcatcactcttaatattatatctctaaaacatatttgttttttcctcccatgaaaggtccttcttatttgcaatagaaacagccaaatcataatttaaagtttgagggcaataatccacaatctaagaaaaatcaaacaaaaactttgaacctgagttacataaccacaatatttctaatagaaaattttatctttatgtttcatttcaaaacaaaataacaaaatataacacctttaattaagaaccaaaagcatgatagcacatgtctgtagtctcagctactcaggagactgaggcaggaagattgcttgagcccaggagtttgaggtcagcctgggcaacatactaagaccctgtcttcatgggtttttttttttttttttgagagagtttcactcttgtcgcccaggctggagtgcaatggcacaatctcagctcgctgcaacctccccctcccaggttcaagggagtctcatgcctcagcattctgagtagctgggattacaggcatgagccaccacgcccagctaatttttgttgttttggttttttttttttttttttttgtagagacggagtttcaccatgttgcccaggatggtcttgaactcctgacctcaggtgatccacccaccttggcctcccaaagtgctgggattacaggcgtgagccaccgtggctggccaagaccctgtcttttaaaaaattaaaaattaaaggccaggcacggtggctcatgcctgtaatcccagcactttgggaggccgaggcgagcggatcacaaggtcaagagatcaagaccatcctggccaacatggtgaaaccccatctcaactaaaaatataaaaattagctgggcgtggtggtgtgcggcctgtagtcccagatactcgggaggctgaggcaggagaatcgcttgaacctgggaggtggaggttgcagtgagctgtgatcacgccactacactccagcctggtgacaaagtgagactcctactcaaaaaataaataaataaataaaataaaaatttaaaaaaaaaggaaacagctaagaatgacagtttaaaatattaagacaataaagtccctgctttttctattttataatttctttctctctttagtaaaataattgcagttttcttactataccattgagataaaacatttttaaattattgaattaaattggctttagagtaaaacaaaaattgactcaaaaaacaattactgtgtgtgtactgtgctcagaaatgtgaccagcaatgtaaaccgacagaaccaatggctttttagaaaataacaaagtatttccgatccttttttaagtagagaattttctcccagcacatcctatttccaattgtgtgcaaaaaaccttccagcttacaaatgttaattcaggggttggcaaataaaggcccagaggccaaatctggcccaccacctgctcagtctgcaagctaaggatgttttcttacatttttaaatggttggggagaaatagaaagagtatttttgaatatgtgaaaattacatgaaaaatcagtgttcagtgtcaatgtttctttggtatacagccacacccattcattcacgtattgtacacggggcctttcaggctacaatggcagagttgagttgccacgataagcatgtgaggtaatgcatatgttaatttgctccatttagccactccacaatatatacgtatttcaaaaaatcatgttgtacatgatatatataatttttatttgccaatttaaaataatttttttaaagaagcagctaccacagagaccataagtagcactctctttacacactacaaattgtcatgaggcagttgtgactcacttttgtctcctgcctggaaagcctaaatatttacaatgtgagcttttagagaaaaatgttcttcaaacctggaataattaatatagttattcatcattccttgaagaacttagtataatggcagtctctatgagtcagagctatcaagtaattactagatttcttgaatcttatcatgatattagtgtttctttttgtcaagtctcatatatttatattatgtattaatttttaaaaatacattatctgggccagctgtagtggctcatgtctgtcatcctagccctctgggaggccaaggtaggagaatcacttgagcccaggacttcaagaccagcctgggcaacatagcaagaccttgtctctacaaaagtaaagcaaaatattagcaaggcatggtggcacacacttgtagtcccagctgggcaggggaatcacttaagcctaggagttcaaggctgcagtgagctatgatcacatgactgcactctagcctgggtgacagagcaagatcctgtctttaaaaataattttttaatgaaatgaaataaaatataaaaacatttatcaaagtgtgctccacaaaacggaaaagggatactgttttctcacattccttcaatccgtcaaaaattaaagacctcctgcatacaatgaaggttgctaggaattcaaaataaataagatgtaattcctggctccacgtaattgcattctagtagagagacacagtattccagtagattgttgtcactaaaggaaaagccaaagcaatgacagtaacctttgccatttcataatgtcatacagacatttaaaaaatatcacctctgtctgcattaatggcaagttatacacttaaatagataaagcaacaaggcttgacaaacacatttatccatcaatactttcaagcaaagcattagccttacataagcaattaaccttgaccaacacgggtataaacaaaaatgctgattaagaacttactaattatccttcccaacttcagaagtttagctggcatctggtttttaactatgataaatatacaccaactcatcataggttattaacacataagtgaaaagaaatatttaaccaaatggctacgaatgaagaacacgataaacaaatatcatcattaaaaatccaaacaatgagttgttttctttgaaagcccaagtgtcctacaaacatcactttatttgaaggtagagaaatatttctgagaataattgtctcctgaatcaacttcgagattcaatctgttgtaataaagacaacatatataaatcatagatgcatgacaccgtttcataattagaatgccaggatctgcatgcagttaagcatcctagctgtttgcctgctttacttaacaccagaagagaagtataatcccaacagctaagtattctagcagctgttgtgagcagagtagagagatgtggcatgtagcagtcaccaccacacgtaaacacacaagcaccccggtgactggaggttagcaatcctggtgtgcctgctcgcttttagtgttaaatatttaatggcatatttttccttaatggaacccaggcacatctgatcagtcactgggatcatttagtaatgcagtcaaagttatcatactgccatttcacatcaactttgtaattagataatccatcactttattaattcaaaagattgctttctttactaccttatagcaggctacagcagtgaaacccaacagagctcatcaacaaaaaaggctctaaaatctggtcctacatgaacttgaaaccctcaagtgacaaacatatacacactcctgacctttcaaaacaacagaggtaatactcttcccacaaattagcccaccaacaacaatgaagtaacagagcaccagtgtatccagaatgagatggttaacagaactgaaaatttaagcttaaaagctgaatataacatgatcaactttgttctcgctttttattgaggtacactgttcaccagaggatgaaaaggatacacaaaaaagtcatttagtaattttccctccatgctgatttatatacttcactaaaattatgagggaggttatagcagaatatcacatccattatttatgatcactctaaatgtaaaggcacataccggccaaacacaagcatgtaatcttgaatatagtatcacgattttctcttgctttatttctaacataccacaaaatattaaatcgcgatttcttatcgtattgtgaattggtaagattctcgttttaacaccttcacagcttctccaatttaaaaaaaaaagaatcctccaataaaaaataatttactcagaatgaaactgtaaaatttaaatatcatagtaccaaaaacaccctctaaaatactcactttccaatctatgcaaccagtacatattgcaaaaccagctacagctaatataattaaaaattagattttggaaaagcaagctccggaggtcacatacgtgccctaaagaacaaaaataacatgctaccaggagaattattaatttgaaagaaagaaggagagaacatcttctcaaacagatgtggaatttctaatcaaaaaaattctgtggcagttgcacaacattataaagttcagcagtactttgcagagctccggaaacactaacaatggcatatgttctgtggtcaggaaggtcacttttattcttgttgccgccaatctaatgcctgtttttgaaacattctatgcaactagtctattttctattttattgttcagattttaccacatttctaatcaggctgccaaataaatttttagaaaagaaagttataagcccagaaaaaaaaattatatatttttctagaactctgtacaataatccctaaagaaatcttttatgtgcataaaaaaaatctcaaaacaaattctactgaaattacgttgagactatcaataaccattgccaataattatcaatggacattttaagggatagaatagagaaatacaatacattccatggcgtttcaattaattagaacatgacaactgaagcacgcttaattccatccttttaagatgcatgtgtgagaaagatttccatcatcaagggaagcctacttttacatttcccacgtgaaattccaagaaactactttgataccatggagtttctaagaatgttggcaacagtacatgatttctgtccacaatggctatgactgaaactaagcctcaagaaaagacaccattgcctgtttgcaaaatttcttctcaacaaaacaggtaattctcaggatctcaagagacaccagcactgggcacaactgtgagcaaccatctgagactctagtttacaaacagtggcagactgcgctcttggctagatgacagcacagggagatttaaaacaccaaagttctataatccaataaaaataaagctgagaggtgggagcaacagtagtagaaattaataatatgtgtcagacactactaagtacgttatagttgatcctccttgaaatctatgaagtagatattagtatttccatttacagataagaaaattgagatggagagaattttatttacttgactgaggaaaatgacctaaccatcatattattcagcctcccatttaaatttggcctctctctaactgtaatttttgtttgttttgagttggggtctcactccgtcccccaagcagcactcatggttctctgcagtctcaaactccggggctcaagcaatcctcccatctcagcacaccgagtagctaattgtaattttctgagtttcgaaggatatatttatgcttaggagtatatacattttctatatttgtagcaaatgtttcggacccaatcagtacaccgaatcacagcatttgtcatgccatgataaatttttttgagacagggtctcactttgtagtccaggctggagtgcagtggtgagatcacagctcactgcagcctcgacttcctaggctcaagcaatcctcccacctcagcctcccaagtagctggaactacaggtgtgtaccaccctgctctcagctaattttttttttaagtttttttgtaaagatggcatctcgctatgttgcccaggctgatctcaaactcctgggctcaagtgatcctcctgcctcggcataccaaagtgctaggactataggagtgagccattgtgcctgaccaataaatccatttcaaaatctaacaggtgctgggtggggtggctcacaccagtaatcccagcactttgagaggccaaggtgggtggatcacttgaggtcaagagtttgagaccagcctggccaacatgacaaaagcccatctctactaaaaatacaaaaattagcccggtgtggtggcgcatgcctgtaatcccagctactcaggaggctgaggcacaagactcaacttgaaagccaggaggcagaggtgcagtgagccgagatcacgctactgcactccagcctgggcaacagggtgagaccctattcccaaagagggggaaaaaaatctcaaaggaaattttgtttgaaaatggaagtggagatttaaaaaaaaaaaaaagtgtgtggtagagaggagaaacagcttgtagagatggagacatacatcttctcttctctaaacaatgtgaaaaagagccagcagagatgaaattggcctttattttttatatgcatataaataatcacatctcctgtgttcatctgtatatccccggtgcacttcctatcctttcaacaccttcattgctgtctgtggaaattaacacctttcattgctcacactttacacttttatctccgttcagccacacactccccagggaacatacaatctaagttttttaaaaaaaacaaaactatccaaataaagctgcaagtaatttgctctagcctctccatccaacagattatcactcagcatcccctcctctagagaaattctgggagtatccctaccctcactttctattacatttagtgcaaaacaaacattttaaacatcaagctcttattctaactctactgtaattactaaatataactgaaatctgtattccacaggtaacaacttcctttgaaaaccttctccggaggaggttgatatatttccctcaggaggttggaggaatcaacaccctcactccccaacagcatttctagaccactgtatatcactgtttcccaacaccagcctcgcttttgaaatttacgtcagtttccacttctgatatgaggtcctccttgacacccacccctagaaaaattcctccttcctatggctcatgttactcagtttttacagccaggcaacaaattcataagtggacaggatatatctatatagaaaactccacaatcaaactccaattgctattagggtgtgtgtgtattaacactggtgctaagagtcagagtcagactaacactggtgctaagaagtggggtgaaaaggaggaatatctgggaatatgaccgggaaaattacaagtaacagaagaaattttccaggtaaaattaaggcttacgcagcagatgcacgttcagcattgagaacccggtccgacaggaaagacacaccatttttccgccagaaactccagtgttcaaaatacaaactgccaacttttcaggcaataatcatgagcttccattagaaaaagccatcagctcaccagacgacgaaatatgctctcgggattaagaactttctcatcctccctgagccctttcctttcaggggaagtgcaagtttgataaagatatgcatattcttcaagtaagacttttgacctgctgaagttttctgccttgatagataattttgagatttagaattagccacatacttctacaaccctgtgtcaagagtattttgtacacactagacctgcaaataaataaataaaagtctgctgtacttgctaagcaaattcagattcaactaacaaacacctctcagcagggcaagagacttggtaagaaaagactaattctaatgaaggtttaaaactccgaagagaaagaacatctgtgtgaactgtaagtattaaaaatgacagatataaaatgagtctgaaaattagggaaaccagctgatagaaacatgaagattcattctactagtccctctatttttgtgtgtgtttgaaaatgtccataatttaaaagtcaaaaaaattaagacataagcaattttagaaaagctctcagaattccatatgcctttcaatgaaaattagatggtctaaaactggccgggtgcggtagctcacgtctgtaatcccagcacgttgggaggccaaggcgggcggatcatccgaggtcaggagattgagaccagcctggccaacgtggtgcaacgttgtctctactaaaaatacaaaaattggccaggtgtggtggcaggcgcctgtaatcccagctccttgggaggctgaggcagcagaatcgcttgaacccgggaggcggaggttgcagtgagccgatgttgcgccactgcaccctagcctgggcgacaagagcgaaaactccatctcaaaaaaaaaaaaaaaaaaaaaagatgggctaaaacataagcttagtatgtctattatctgcacagaacctgaatgaatgtaaatgagaggaaccaaaagaaaaacaaaaaacaagatcttgtttattgaggccaggtatagccagccttgttgacagcgtaaattcagaagtcagcagcttcctctgtatgtacaaactgtcagtcagggatagttgcatgttgacccgctttccacagcctaatgaactgacttttgaattttcgctgtgaagaaggctggctttacctggcctcaataaacaaaatcctgttttatgttatttttttatggtgcccgtttcttctctttgattaattaattttataccagagtaaaatgaggagaggagcagtagactgggataaaaatctctgcccagggatcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggagaaggagtcgggggagcgggaaggagggagaaggagtcggggggcaggaaggagggagaaggagtcgcgggggcgggaaggagggagaaggagtcggggggcgggaaggagggagaaggagtcgcgggggcgggaaggagggagaaggagtcgggggggcgggaaggagggaaaaggagtcgggggggcgggaaggagggaaaaggagtcggggggcgggaaggagggagaaggagtcggggggcgggaaggagggagaaggagtcgggggggcgggaaggagggagaaggagttgggggggcgggaaggaggggagtgatttaaggacaaatttataagcagaaaaatacaaattaaaaacattaacaaaactttcaccagaaagtacagaagccataggttattggctgctttcatctgattattaacctatattttaatgcagaagtgacacactaaggccaattatgcccaaaaatctcaaaactgtgtattttctagcaataacaaatattatgtggggagaagggtaagcattatattaaaaattggtacacttaatcatagcaacagaattttccccctatacaacatggagataatttcattataaaatacatgagactaaaatcttcagaaagaaagaagaactaggatagtaattcacattttacatgtagcaacagaaagtattttaaaatatttttcatggatattaataacatcagtaattatcactggaacattttccaacaatagaaataattaccacagaatagccacaaacttaacactaggaatgaggtaataatcatcataaggtatatttttatctttcagtaggtgttcgtgtttatagtgttgaacatgaaaacagccttgggcacggcacacgatactactacaggttataattttcagaagcatatgaaatagatgagaaagttttcagatgcactgtaagaaatcagtaaattttgaaatcaattttaaattatagataaccagaatataatgctaagatgacattaatcagaaaatcataaaaatgtaccatacagaataaaaatacatttgagaaaaactggaataaatctccagcaatcaaaccaattacatttaatttttcagaaaacagtaaattttaaaacatgccttaaaatattaatggcataaatatatcttcaaacgtgtgcttacaaattacaaaataagtggcaaaattgtcaaaagtaaagttttacttgttattaaattgtgatcaacattaaaacaaatgcaaacacacaatgtgagaaagcgaggacagcagatccatagcagtgagggggtgtttctgtcatccctatcccagggtaaatatcaagaagcaatcatttcatgcctatgggctagtgaagaaaaaaaaaaatcaatcatcgcactcttcctccctaggccaagataaaccctcggaatcatttaaaaaaaaaaaaaatacttcaggaggccgggcgtggcagttcgcgcctgtaatcccagcactttgggaggccgaggcgggtggatcacctgaggtcaggagttcaagaccatccgtctctacaaaaacaaaaaaaaaaaaacaaaatttagctgggcgtggtggctcatgcctgtaatcccagctactcagaatgctgaggcatgagactcgcttgattctgggaggcggagattgcagtgagccgagatcgcaccactacactcaagcctgggtgacagaacgagactctgtctaaaaacaaaaaagaaaagaaaagaaatggatttcaataaatttttcatttcaaagacaggctctatgcttaaacaaccaccataaaactcaatgaatgcaatgcaacggcaaacaagtccattcacaaaaaataatgggatatgctattttcttctgagaaaagaaagcatactctttcttccaagggtacactttgagaattcacaatgaacatactcaggcaataacaagaatattaatcaaacagaaaaattcatacccttctcaatgcacacaatacattctctcatgctctactcactatgataaggaagtaatataaggcattaagggtcttgaatttcctgtcaagattctcgacatttttgtaactaacaacaaaataaggagcaaatggttgatgtatggaattagcaaagagcaaacttaacacttacttttgcaaaggcttcaaaaaggtcaaaggcaggtggcagctgagaggcatcctgtatttcttctctcatgaaatgttgaaatgtcattacgagttgcctgaggccctctttcttatcttcagtcagtttgttaatatcttttttaaagagaaaataaatagcacaatctcaaagtaaacttctgaaggataattttcaagtgttcaatgctggctgttaaaccagatatttcctaccttacattggattttgacaaagagcaaatacatattgttttatcttttgacaactaaatatgatgcatatgttatcaattaaattctgccaaattttgtctgcaatgtaagatcaaacacctatcaaaacataagtacgcacatatatgaaaaagcattaaaaccaaaatcactgagattgtgtgttaccagattttctacatcattctgtacacacatacaaacaattatcagttcttattaagtcagtaaacttaagcagacttttccatgaaataatttacaactaggtcatgactaaactaataaacagcatcacctctaaggcaaaaagacagaaaataagaactaaaaagttcagataaagttcaaataggttaaatttgtcatatggctagtacatcatgaatagaacagggatcaagcacagcaatttcaacttcaagttatctgagttgaataaacaagataaaggagcctggcgccgtgactcacgcctgtaaccccaacactttgggaggccaagacgggcagatcacttgaggtcagtagttcgagagcagcctggccaacatggtggaaccccatctctactaaaaatataaaaatcagcagggcgtggtggtgtgcgcctgtaatcccagctactcgggaggctgaggcaggagaatcacttgaacccaggaggtggcggttgcagtgagccaacatcgcgccactgcactccagcctggacaaaaagagagactccatctccaaaaaacaaagacaaaaaacaagatatgatgtggcatcaacccaaacagaaggagatggttctaaaacaaaagaagaagaaaagttctaacgccaatactacccccttaaatatcattttcaatcataccacaaatggggtgttaaggctgaaaggatacaacaggtcaattaataacatgtgagagcatttcacttaaggtcatgtgtatgacactagtactgagtagggctaatgtgaagagtaaaacccatggtaacagatgttatttacctagcagtaatataacaagaaaatttgaatactttgctgtcttttaaaacttgaaaagatacatcaagttgaactacagcataactctgttgcttatgtctatgcatatcctttagattacttattcaacagaataacccaatgatttctttttttttctattttatatgcttgttaatttttttttgatggtaaatatatgtttttttattttatttattttttcttttattattattatattttaagttttagggtacatgtgcacaatgtgcaggttagttacatatgtatacatgtgccatgctggtgtgctgcacccattaactcgtcacttagcattagatatatatactaatgctatccctccccactccccccaccccacaacagtccccagagtgtgctgttccccttcctgtgtccatgtgttctcattgttcaattcccacctacgagtgagaatatgcggtgtttggttttttgtccttgcaatagtttactgagaatgatgatttccaatttcatccatgtccctacaaaggacatgaactcatcattttttatggatgcatagtattccatggtgtatatgtgccatattttcttaatccagtctatcattgttggacatttggcttggttccaagtctttgctattgtgaatagtgccacaataaacatacgtgtgcatgtgtctctatagcagcatgatttatagtcctttgggtatatacccagtaatgggatggctgggtcaaatggtatttctagttctagatccctgaggaattgccacactgacttccacaatgggtgaactagtttacagtcccaccaacagtgtaaaagtgttcctatttctccacatcctctccagcacctgttgtttcctgactttttaatgattgccattctatctggtgtgagatggtatctcactgtggttttgatttgcatttctctgatggccagtgattgtgagcattttttcatgtgttttttggctgcataaatgtcttcttttgagaagtgtctgttcatgtccttcgcccactttttgatggggttgtttgtttttttcttgttaatttgtttgagttcattgtagattctggatattagccctttgtcagatgagtaggttgcaaaaattttctcccattttgtaggttgcctgttcactctgatggtagtttcttttgctgtgcagaagctctttagtttaatcagatcccatttgtcaatttttgcttttgttgccattgcttttcttaaataataatttattaccatgggaacttcagatcccacaaccttatataaatctgtactagatcatcttcttgtctccatccagaagtattaaactgtgcagcaaatttactgtatgtgccctggctagttttgagttgaaatcacttacaaccttaacgaaaaggatctgcgccaatacaaaatcaaaacgaaacctacctttgcttagcactcagatatgggaagctttttaagtcatcacaagaaggtggctacctacatggtagtttcagagaagaatgatgcttcacactgccacagagactgagtcatctgttccttctaccttccttaatgtctaaaagatcagtaaccctaaaagctctgtggaatccccctgttcactaatcactcttctctgacatcaaaaagaaaacagaacaggaaaccaagagacagaagaagggaaacagggaagaaaaaaagaagaaaaatgattttgtcaactggactaatggttacactaccccatgtaacctgaacatcttcatggcgctttactaacccttatcaggacgaagctaccctggaataagtgaaataaaccagtgtgacagttgtatataaaaataaattttgttaggtttgcatcacattataaagaaacagaaaaacatagttaaaaataaatccattcaccaactcagcaaacaaattatagaaacttttttaagatgctgatagacaatcacttacttgactccagatcataaaatgagtaaagcttctctgattctgaaggtgctccatccatctgtgaaggaaaaggggaaaacgccaataacaatttcaagtgttccaatatataaacaaataagtttgagtacctttgtatatttaaatgaaagtccatcaaaaagaacattttctatatattctttctattcatcactctcattagactgaattaatcaacaactttaaaataaaaatctaacttgtatcttcactcaacagtttaatctccaaatgcaaaactcttgtacaaaaagttcccatatttttatattcataaaaccctctataaaatcgtgtaccggccaaaagagtcagtaaacaataggaaaaggtggggcatggtagctcacacctataatccccgatactttgggaggccgaggcaggcagattgctttagcccaggagttcaaggccagcctgggcaacatggcgaaaccctatgcctaaaaaacatacaaaaattagccaggcatggtggcatgcacctgtagtcccagctactcagcaggccgaggagggagaatcacttgagcccagcagttcaagcttgcaatgagctatgattgtgctactatactccagcctgggtaacagagcaagtccctgtctcaaaaaagaaaaaaaggagaaggacaaatcgggagcctacaataatttgagaaagatattcacactaaagatgggtaaaaaaatctaaaaggcttcaccacagcaagatttcacagagtttactgttttgccacttatgaaaaagggccgaagaaatcacttcagtgaattttaggaaataagataagtactcttccagtcaatactaattatgtatgtgtatcttccttgaagaggaaagtagaaaatgacatgctcgccctgtgcattagtttacaatacccaagttataaaggcaatgtaacagagattactaccatctcatacctcagagatagaacctcctccatctttattcccacaagaagatagcagggccttcaaagagagactgtgtatttcttcactgctacagattccatgattaataggaaaagaacaaatttttttgtctaagacactccctggaataatctaccttctacattaacatggggttaatttcagccttaaataggaataacacaggcatacctcattttatcacacttcactttatagtgctttgcagacattgcactgaagatttacatcatcgaacaagtctgtccataccatttttctaacaacacgtgttcactttgtgtctatgtgtgacattttggaattctcacaatatttcaaacttttggttattattatatctgttactgtggcctgtgatcagagatctttaatgttactactgtaattgttttggggtaccacaaaccatccccatataagaccacaaacttaatcaataaatgttgtgcgtgttctcactgctccgccgaccggcttattcccactgcctggctattcccctatctcttccctctcctcaggcctctgtattctctgacacaacaatattgaaattaggccaattaataactttacaatgacctataagtgaaaggacgagtcacacatctctcattttaaatcaaaagctagaaaaatgagtaagcttagtgagaaagaaatattgaaagctgatatagaccataagtcaggcctcttgcaccaaacagccaagttgtcaacacaagggagagttctgaaagaaaatgaaaagagctactcccatgaacacatgagtgataagaaagcacaacagtcttattgctaatctagagaaagtctgagtggcctggatatagaagatcaaaacagccacaatattcccttgagccaaagcctaatccagaggaaagccctaacttgcttcaattctgtgaaggctgagagaggggagaaaattgcagaagagaagctggaagttaacagaggttggttcataaggtttaaggaaagaagccatctccataacataaaagcacgaggtggccaggtgcggtggcttacgcccacaatctcagcactttggaaggccaaggcgggcagatcacctgaggtcaggagctcgagaccagcctggccaacatggtgaaaccctgtctctactaaaagtacaaaaaatttagctggccatggtggtgggcgcctgtagtcccagctactgaggaggctgaggcaggacaatcgcttgagcctaagaggcggaggttgcagtgagccaagctcacgccactgcaccccagcctgggtgacaaagcaagactccatctcaaaacatacatacatacataaatctaaaaaagtgcaaggtgaagcagcaagtgctgatatagaagctacagcaaatgatccaggagacctaactaaaataattgaatttggctacactaaacaacagatttttaatgtagatgaaacagccttatattggaagaagatgtcacttaggactttcatagctagagagaattcaatgcctggcttcaaagaacaagtggacttttttttagggactaatgcagctggtgactttaggttgaagccagtgttcatttaccattcctaaaatgccagggcccttactatttgtggtaaatcgactttgcctatgctttaccagtgggaggtcaaaacagcaacatgaaccggagttcagaagattcagaagaacttggttccaaccttcatggataacactgaggggtcaagacttcagtagaggaagtaagtgtagatgtgatagcaagaacgaaggagctggaatcaagatgaaaacctaggaaatacccttctacacatcagtcttggcaaagaatttatgatgagtcctcaaaagcaactgcaacaaaaacaaaattgacaagtggacctaattaaaataaagagcatctgcacagcaaaagaaacctgcaatggagtaaatagacaacttacagaatcgaagaaaatattcgcaaactatgcagccaacaaaggtctaatatccagaatctataaggaacttaagcaattcacaagtaaaaaacaaacaacctcattaaaaactggacaaagggccaccacagtggctcgcacctatataatcccagcacttggggaggcctaggtgggagaatttcttgagcccaggagtttgagaccagactgggaaacatgatgaaacttcgtctttccaaaaaaaaaaggaaaaaacacaaaaactagcggggcgtggtggcatgcacctgtggtcccagctactcgggaagctgaggtaggaggactgcttgagccccagaggttgaggctgcagtgcgccatgatcatgctactgcactccagcctggggcaacagagtgagaccctgtctcaaaaagtgaaaataaaaagtgcacaaaggacaagaacagacacttctcaaaagacaacatacaggtggccaaaaaacataggaaaaatgctctacgttactaatcatcagagaaatgcaaatcaaaaccacaatgagacaccatctcataacagtcagagtggctattattaaataaaaaaaaaacacatgctggtgaggctgcagagaaaagggaacacttatctactgttagtgggaatgtaatctagttcagccactgtggaaagcagtttggagatttctcaaagagttaccattcaacccagcaatcccactgttgggtatatatccaaaggaaaataaatcactctaccaaaaagatacatgtactcatacactcatcacagtgccattcacaacagcaaaggcatggaatcaatctaggtgcccattaacagcacaatggataaagaaaatgtgatacataaacactatgaaataccatgcaaccattaaaaagagtgaaatcatgtcttttggagcaacatgaatgcagttggagggcattatcctaagtgaattaacataaaaacagaaaaccaaataccacaggtttttactcacaactgagagctacatattgggtggacatggacacaaagatgggaatagcagacactggggaatacgagggggaggtaagaagcagggagtgggcaagagatgaaaagctagctactgggtaccatgctcactacctcggtgatgggatccatcataccccaaacctcagcatcatgcaatatacccatgtaacaaatctgcacatgtaccccctgaatctaaaataaaagcaaaactttttttaaaacagagagaagtagagcctaaagaattataaattaactgattaaaaattaactgattttctgcaatctcatgataaaacttgaaaagatgaggagttgcttcttatgaatgaacaaagaaggtggtttcttgagatggaacctactcctggtgaagaagctgtgaggcatcatatgttacagtgaaatcatttgcgaaaggaagaggcaatcaatgcggcaaattcgactgttgtcttattttaagaaattgccacagccaccccaaagttcagcaaccaccacttgattagtcagcagccatcaacatccaccagcgaaaagatgatgatgcactgaagggtctaatgatccttagcagttttagaaatatattttttaattaaagtatgtacattgttctgttggcataatgctactgaacacttaatagactacggtataatgtaaacataacttttatatttactgggaagccaaaaaatttgtgagactcattttattgcaatatttgctttattgtggtagtctgaaactgaacctgcaacatctctgaggtataccggaaaatgcaattgcatatgtttatttaaccaaaacccagctatatttcatgagttttatactcacaagtttgaagacaactctgccaagaagtcgaacggagtctggaggatatctgggtttgcagcttttaaggcatttgcattcccgcttgtggtctggccaagcttttttctattaaaacaagagtggggagaacataggtgacctaaaatttaactttcatttatactggttttgaacatcaagagtcataaacattaaattttaatagtccaaatgtaactgcacaatagaaaataaaagcaatattctaaatctgaaaataatccaggatgagtctttgccaaatatgcaattactatgcaaggacattaaaagcctcagcttcacctctgtgctttcatttgtcccctggttattacctggctagtggagtccaaagaaagagccattacagcttacttaataatgtataagatggtcttggaactgattaaacaggattcaacaatagtcattttgaatacaaaaggaaaatgtcactccaaattagaaaataaaacgtggttcagaagactcaaaatagggatgacagccttctgaatttctgtgctgctacagaaatatcaggagggctaacacacccccaaatataaaatctctttgttttaaaagcaacataaaaagaactattagctaaaatcattaaatgtccagtttgtcctggatgtgtctaggtttgtatctatgtcctggcttaaatattaatagtgccccttttcactctgaaaagttctggttttgatgacaaattatatggtcacctaagccatgatcctagccatgtgttgatgtggctaaagagaccattgagtcagttgccaatgtacagatgaatggactaaagggaaggacactatccttgagccttggatcagaaaggcgacggctcctttcacacggaatcactttcatatggaaataaaatccagatcatctaatatttagccctggtgagtagaagaagcctcaatcaaatgtctctcgtgttatattctgaaaattggaatttccattactgaaatgcctgataccacttactcattcttatttcaaaaattataaatctgctcctcaatttctgggtctacaaaatcaatgtgctgttcataatttttgttttagcatttacacttcactcacttctaaacaagactgagctgattcaaagtaaagatgtgtatgaaataagactgcaaaaccagaaacagaacatattaaaattatggaagggggaaaaaggaaagcacgctagcatttacttagcattctacaaggtactagatacatggctaagcaaataacgaagcacgtttcacttgattttcgtaacaatccaaatggtaggtattatccctctattacaaataaaggctcaaaagctgatatctaactatcaaactgcccaaatacaaaaagagagagtaaaaattcttagcatgctaaacatgagagctgaataatttctgcattacatttgagtatttgtacgtcacatttatttgagatgccttacaagcaaggcaaaaaagaaggcataatggcttatataatcctcaactgacagaaagtaaaaacatacagtttcaccaagtattaaatcacaggagggatttattccaagaatgctaatcaacacactgaacaatgtccttaacaacagttcacaactataatggcctttcatatgacttctaatatcagtactcactgaaaggcataatattaaaatacaactcagtgaaagaacaagcttctgttgctcagggggctagtccttgactagcaattagcaattaccaatgtgtgtaagaggcctaaaatatacatggtacaattgtcaagtaagttttaaaaacacaatatcatgttgaccctacttagagattcaaaatatacttagcatcctaaaagttctaaaagtctatgcactaaagaaatgtgtataaattatttaacacagtttcccatgcttgttattgtcaccctttagagagttaggttggtattcactaactcagatatatctatatattttttttcacctggtctttgtatgtgagtgggttaagctaacaaatttacattcatttgcactcacaagaaacaagaatgttaacttttttggttttttactgatagaagggagaaccataactttggcgttagttttcctttgattatagaagttgagaaacctgtcagatgctctcatggacagagcgtgtaggcaggaacggataacatagtgccagtgggtctatcagaaagtaccttaggctctgttcaaatgcctcagtgtccagctgaacagggctcacactcagcaaaacaaggcagagataatttgaggcaaaagaccttaagagcagattttaatcaatgctcattttaattacaagagatcatccataacccctctgttaaaacctaaatatttgagcagctcagcctcctgatagcttaccagggtgagataagtacaaaacgtacaccagataatgaacaaccgatcagttagatgacagcatttggaattaaacatccaaattttggaaaattcctgttaaaacaactttaggtccttaacataattgatatagagctccttttctcaacaataactagaaactagacaaaatgtttcttaaacttattcctagatcattgcctgaaaacatacttattttctcatttgcttcagcaaaaatatgttcattatttccatgaaaagccaaatcagatcatttaggcataaatagagaaagcaatcataccacttaaaattggtctgtaatatggtaccacatatcagcccattccttttctttttaaaacattaactgttaaaatttatcattcagcttcacctatcacatcttaccataagggttacgaatacaagcataccatagaaaaggcttacaaagaaatctttttacgcagctcctttgactttgaagcaaaacgtgacaatcatacaaaaacaaaaggcattatcttcactcaacaaactaaccttggtcaagacctcgatgacacatttgtcatatatatttgccaatttctcaaaagacaaccttcctgatttacattttttcctattttcttacattacttccaatacaggatataattaagattttgctcataacattggctgtagtattttcttttgtcatagctgaaaattaacaatgatgtacaataagcatgaactggcttgagagacaaaggaaattaaaatactacattaagaagtaaaaacaaaaggagacaagagtttcatgctggaaaaaaaggaaatgacatctataacacaattctttcagtgcatgcatgactcaaaaaacaacttcagaatctatacagtttcataatgtatttttatagtatttataacagttcacgacataaactcattaaccacaccagtagttctcaatgggagtgacgcctatcttgagggttgtttgagaaatttatgcgggtatttttatttgtcacaaggtttatggaaaattacaggcacttaatgagcaggaaccaaaggagccagacattctgtgtcggacagttctccacaatgaagaattatccaaatccaatgcaactttcaagtgtccaaccaaattccatgacggtggaaaacttgtttataattgtctgagcctagaactaaatctccttttacatttaaaaacaaagagctcgtttttacataatcctaacagcactgaattttctaggtaaatcaaaggaagactgtattttaagaattttacctaaattactcaattaaagccatatcactgaaggcaacaccacttagagtacttgagttaccaatacaacacggcttctgacccgcatctctacttcccttctcacagtgactctatgtataggtgcaaatatgtgactaatgatgtcttccagtctaatacctcagcatttatatactaaaatacatattattttatcataggttttaattttctttttccttatattccaattatggcattatattaatgttttgaaaatatgtaactaggtatattgcactacctgtaaaatttcatttcaagatagtagagagggcaataaaaatagttctcacaaaaatggggagttgggtctgaaaagaactgagaagcccagatctaaaaaaatgctacacagttacacatgccacacacatacacaagaatatatttttaaacacatagcctaacacccaccctagggattctgacactacccatgagacagaatcaagcatcccactgcagggctgctatggtttcaatgtgtacctcaaagttcatgtgctggaaacgtaatccccagtgcaacatgttgagaggtggggtcgttcagtagcacagcgctcacgaacggattcatgtcactattgcaacagtgggtttgctataaaagagagtccggccctctcttgttccctctcaggagcacgctcccgtcatgtgacgccttctgccatgctaggatgcagcaagaaggcccttacagatgtaatccctcaaccttggacttcccggcctccagaaacaccagccaaataaacttctattgtttatgaatgacccagtctgcggcactctgttaatagcagcacaaaaacagatcaagacaagggcattccatgagtagctaaagttgaaaaaccactgagttaaactaaattacaaaggaggtcgttatatatactaaatagatgaaacaaaatacaattctataattatcattgaactattgttctatagaaataaatattgtataatattaaggtggaaaaagtgttttaaacagaacataaaatgtaaaaaccataaaggaaaataaatatatattcaattacataacaataaagaatttttgtcttgggggaagaaaaccagaaacaaggtttaaaggtaataaaccatgaaacagtctaaaatacatatatagacacagtgttaaatgtctccaatatacaaaaaggccttacaaataacttttgaatatttcaaaaaatataaataaaggtaaaggaaatgaataggaaattcatgactgaaaaagaaaaaccaatagacaactaatacaaaccacaccagtgctcaaagacatgataacagaaactagataacatagtgtcccattaatttggcaaaaatgaataaaactggcagtatttagaagcatctaggatttggggaaataggcattttccagccttgttagtagagttgtaggctgctctgatctttctgatgggtatttggtaatgaatatcaaaattgtaatgtgcatattgttgacacagaaatattattcataaagtaatttattttaaaaaatttaaatagtataaagaaataaatttaagaatgttccaccctaagcaacatagggaaatcccatctctataaaaaaaaattttttttagttagccagacatgatggcatgcacctgtattcccagccacaccagaggctaagaggagaggatcactcccagctatgctggaggctaagatgggaggtcgagactacagtgagccatggtcacaccactgcattccagtctgtgtgacagagtgagaccccaggtctcagggggaaaaaaaaaagaatgctcacaatagaagatgattaaaatactgaaagttaacttttccagcttttcctaaaagaaattgctatttttgtctttctctttatagctttccattactatttaaattttctacaaagagcatggagtttatgaataaaaacaaatataattttatgtgtagtaactgagaatcagggagaagtacttttatacgaaagggacagcaaaattactgtttaataggcactggtgcttcttaactttttaatgtttattttggaaatctagttgcaactcaaagcatgatttaaatgtgttaatttttaaatgttaaaaaatgcttcagtgaactgttctgtaatgctgatgcaatcttttttaattcagagattcactcagtaaattcttttattagtttggctatattcatgtctgtttttcttaaatgagtatagtaccaattaagtacaccttgcatgaaacaggtgttcaatacatattttatgatttattctaaaaccagtaccattcagggggtaaaatttactatatattatcattatttgaaattaaggccatacaaaaagaagaaatgaaagtagactctcacaattctttctttgaccaataagagatggtcttgattacatgattatgaaaggagtgtattgatgagatgttacactaataagagaaaatcaatttatttctttcttacgcaaaataacatttgcactattatcatatttccctctcctctttacatacaaagtccctattgctcactcaagaacccatttaaatgctgttaaacaccaagttttggttggagtggatatccattttagggtagctcattattgtttgggatagagtgtaagaagggtcatcctgtattgaaccttggattgggtaaaatacatccaattcatgacatcagctcactaggtatttattccataagaagattagattcaaagatctgcaaggcagtcttccaatgataaaattctgagtctgtaacatccattcctaacaaatatctgaattatgtcaaaataggtttgaaacctgcttgggttaggcttacaatcattgaaaatttgcaacagtattttcctcagctatttggtcattaaggatgaagaagctgtctttaaaaatatagaaaagaaaatgaattttttgagcccacttattcaacagtttcatataatattaactaaacatcttctacgtgaaatatcacagtgatttttttcctacatattcaggacttactccactcacaaacaatcatctacagaggtttcctatgggcaaaacttaggatagttgagctgccacgcaacttgcaggaaataaaagatactcgacagttttccatttacatccagtttgcttgatagcaaataaataatgcctcctcctttatccttgaaatgtagtccaatattgaattacagattgtcagatgcaggcagatctgaaaagctggaatctgggaaaagaaaactggaaggctaagcaggttgtctaacagctacagttgactgacaggtattgattaagatcttgcaaaaaaatctctttagagcacactagagattagtgatagatatgagacttctcactttaaaagcttactgaatgctgtatcaaatgtagagcaagagcatcttctcactagtcttaatcaaattagatgaatagagctaaatataaagaaggaatgtgccatgaaaatggtcttagggcataaggttgacaagaggaaaaaaagaacgtgaataaatgaccatttcttgggcaaatgggaattacggtctcctgttaagtgaggaacctataatatgagacaataataacaacagtgcccccaaagtaagtcaatcatcatctactgcagggttccaaaaatatatggctcataggtaaaattcattttacatttttacatttatgtaaaattcaaattcatgtacgttctaattcgtgctacatttttagtaaaattgtacattacagggatagagccacacttattagttacattcattcatttcatgctacatcagagttgaacacatacgacaaaaatcatatggccacaaagcctaaaatatttactatatagttctttacagaaattagccaatgcttgatctaatgagagatcatatgaagacgaaatgacttaattgatagtttggctggaaagcaaaataaatcatgcacttccacagacttccaatcttatttggaaaaagcatctatcctagattaatcaaaatatcaacaccagcttctagctgaatacggtaggtgagcacatgtattttatttcctcaaaacaagtaattatcaaattttttactcccaaagtgaactggaacagccatcaatggatgagtggcagggaaggatgtggttagccccatttgagagtgaaaaagtggtggtaagaggacaggctgcagaagcagggtcaaagaggccacatgtagggacagtcccatctgagagggaaggtcagcctgccaagcagaattccagaaaggatctagaatcaaagactatacattggtagaatggaattgaaaaatagatgagaaagagaaaattaaccacaagtctgtatgccaaagagtctcaaaacaccccttctctacttttggcttgattgagtaagcaatggaaggttaatgtacagaatcttgttgaatttgatgctaagattatctctgatccagattattgctatagcctcctatttggtcttcctgccctgactcttacccttctacaacggcttcttcaaacaatagtctaattctttgagtggcttaaaaattgtgatcactgtattacagaaaaagaaataaaatctatgcatacttaatagctctgtggtgaccaatatgtttcaaactacttacttgaaatataatttacattattaaattatatttaggttggtgcaaaagtaattacttttaatggcaaaaaccacagttacgtataataaaatgtatccattttaacagtatagtttgataaatttttgtttttttgagatggggtcttgctatattgtccaggctggtctctaactcatgagttcaaacaatcctcccaccttagcctcccaaagtgctgggattacatgcacgtgccaccacacccagctttgataagttatgacacatatatctccatataaccaacaccaaaattaagctacagatgttagtactccccaaaagttcccttgtgccccttacattcaagtcctccatcccaggcaactcagtggttttgtctctataattgtaagatcagttttgtctagcctagaacagtcttacttcttttcatctggcttcattccctcagtacagtgttttgagattcactaacgttgcggcatgcatcagtagtttgttcctcttaatggacaagtaatagtacagtatgcatctctttattcatttacctgtggatgaatatttcacttgtttccaggtttggaacattgaacatttatgtacaagttgtttttgtagatgtaagttttcataactcttaggtaaataactaggagcagaactgctgggtcatacagtaagtacacctttaacattattacaaactactaaactttcccaaaacaatgataacgctttactttctcaccaccagtgaacaagagttccagttgctccatcaccttgccagcacttgacaaagtcagtccttttaattttagtctttctagtgggtgtgtagtaatatctcattatggttttaattttcatttatctggtgaccagtgacaatgattatcttttaatgtatatcttcttaaagtatctattcaaatcttttacctgttttactcagttttcttactactgaattataagtattctttataaattctggaaacaacttcttggttggggtgagagagagagaaggagggagagaaagagaaaaggagggaaacagggggaaagagaggtctcaaatattttctccatgtctgtagtttgtctttccaaggagctgaagggtttaattttgatgaaaatcaatttatcaatttttcttggaggcttagtgctttctgtgttctacataggaaattttatgtaccccatatccaaagagtttctcctatgttttctcggttttatagttttagcctttaagtttaagcttattgaacctaaatcttattaaatctagtgaagaattgtttttacttttatcatttattttccatgtgcatattagcacaattttttgaaaagatcatcctttcattattgaattatgttggcacctttgttgaaaatcaactggccatatatgtgtagggctatagtttttatatttttatttctgaatacaggttgagtatgccttatttgaaatacctgggaccagaagtgcttcaggttttggatttctttggattttgaaatgtttgcgttatacttactggctgaaccatcccaaacctaaaaatccaaaatccaaaatactccaatgagcatttcctttgggtatcatgctggtgcttaaaatgttttggattttggagcgctgcagattttttgatttgggatgctcaacttgtattatgatgtgttgacattttaaaaacctttctgactaaggagaagactgctcctgctcctcccagggacagccaattctaagaaatagcaaaaagctcaatcctgagcatgcctttgataggcaaactaaatgatccacagccatacatcctctgtctggccctaacaccctaagaggcaatattcttctgccttaatcatcccagggccaggtaccaggcaaacagagaccacccttaaaccccaggatcccctgatattactcaaactagccaatcctaaactgagaaacacctatgaatgccacagtccagggacaaaggctcaccaaaaacccaagacctaatcatagaactatagaactggccgggcacagtggctcacgcctgtaatcccagcactgtgggaggccaaggggggtggatcaagaggtcaggagatcgagaccatcctggctaacacggtaacaccccatctctactaaaaatacaaaaaattagccgggcgtggtggcgggcacctgtagtcccagctcctcgggaggctgaggcaggagaatggcgtgaatccgggaggcggagcttgcagtgagccgagacgttctactgcactccagtctgggcgacagagtgagactctgtctcaaaaaaaacaaacaaactaaaaaagaactacagaacagttcctctcctcttacatcttgccatcacactactaaaggcctatttacagtggttccttttacatcacgtctagctatcaagaaaaaactataagacatactgtattagtacattcttatgctgctatgaaaaaatactcaatactgggtaatttataaaggaagacgtttaattgactcacagttccacagggctgtggaggaaacttataatcgtagtggaaggggaagcaaacacatccttcttcatatggcagcaggatggagaagtgcccagcaaagcaggaagccccttataaaaccatccaatcttgtgagaactaactcactatcaagagaacaggatgggggatactgcccccacgattcaattatctccacctggtcctggtccctaccgcgacacatggggattatgggaaccacaattcaagaggagatctgggtggggacacaaccaaactatgtcacatactaaaaggcaaaaaaacatagtttgaagagacagagcgagcattagtaccagactcagatatggcaaggatgttggaattatcagactaggaattttaaaaaactataattaatatgctaaggattccagtggaaaaggagacagcatgcaagaacagacaggggatataggcatagaaacagaaattctaaaaaccaagaagaactgctagatcaaaaacaccaacaaaaataaagaatgcctttgatatcttattggcagactggacgtagctggagagaagaatctctgagctgaaattatctcaatatggtaaccaccaacattaagaagcaaagacaaaaaaagactttataaaaaaaaaacagaatatccaagaactgtggaatgattatataaaggtataagatatgtgtaataggatatgtcagaagaagaataaagagagaatggaacagaagaaatacttgaagtaataatgactgagaagttctcccagattaatgccaggcaccaaaccacagatccaggaaactcagagaacaccaagaaggataaaagtccaaaaatctatacttaggcatgtcattttcaaactacagaaaatcaaaagttttttaaaatactgagagaagccagatttttatagctaaagataagtatatgtctgttttaggtgtttatagatactgaaatggtttcagtaatatgtcattttctgaaaatctcaaaacacttgaaaggtgtgtgcaatggtttgaaggtctgtaccctccaaaactcatgttgaactttaattaccattatatcagtgttaagaggtgggaccattaagaggtgactcagccatgaaggctctgtcctcatgggcaggattaattccagtatttgatgccctcttgtctcctggcccttccaccatgtgatgtcacagcaagaaggccctcactacatatagccatcttaatatagaacttccaggcctccagaaatgtgagtcaacaaatttccgctcttcacttatacactgatggtgggaatgtaaattagttcagccactgtggagacagtttggagacttgaactaagtcttgaactaccatgtgacccagcaattccattactgggtatatacccaaaggaagataagtcattctaccaaaaagacacatgtacccatatgtctctccctgcgctgttcacaatagcaaagacagggaatcaatctaggtgcccatcattggtggactgaataaagaaaacgttatatatatatatatatacacacacaccatcaaatactatgaagccataaaaaagaataaaatcatgcccttgggccgggcgcattggctcatgcctgtaatcccagcactttgggaggccaaggcaggtggattgcctgaggtcagcagttcgagaccagcctggccaacatggtgaaaccctgtctctactaaaaatacaaaaattagccagacatggtggcaggtgcctgtaatcccagctactcaggaggctgaggcacgagaattacttgagcgtggaaggcagaggttttagtgagcctagatcgtgccactgcactccagcctgggtgccagagcaagactctgtctcggaaaaaaaaatatatatatatatgtcttttgcaacaaaatggatgcagctggaggccattatcctaagcaaagtagcacagaaacaggaaatcaaatacagtatgttctcacttacaagtgggagctaaaattgggtacacaagtgtataaatatgggaacaacagacattggagaatataaggaaggggaaggaggaggaggtgcaagggttgaaaaactaccttttgagtactatgcttactttttgggtgacaggttcaatcatactcgaaacctcaggatcacacagtatacctttgtagaaaacccgcacatgtacccccagaatctaaaataaatgttgaaaacaaattaaataaatttgaaacaataaaaataaatttttttctttataaattactcagtgtcagttattctattatagcagcacaaaacagactaaaataaacaacttacatatagaggaacaaagaatcatagccaacttctcagaaaccatgtacaagagagtggaatgaaataaagtactgagagaaaaaaaaattactaatctagaattctgtaccctgtggaattacccttcaaaagtgaagggaaaataaagactttttcaggaaaacaaaagttgaggaaatgtattgccagtagacccacccgcatgaaatgttaaaagaaattctgtagagagaaggaaaattataaaggttagaaacttagatctacataaagaaagaatgagaatcaaagaaggaataggtgaaggtaaaataaaaactttcatttttcttattcttaattgatctaacagataatagtttgttcaaaagactgctaatagcatcaatgtatttaattatgtatgtttatgtataagctaaataaatgacataagagagggagcaggggccgggcacagtggctcaggcctgtaatcccagcactttgggaggctgaggcaggtgtactgcctgagcttaggagttcgagaccagcctgggcaacatagtgaaatcccatccccacacaaaatacaaaaagtagccaggcatggtagtgcacgcctgtagtcccagctatttgaggaggtgctgaggaaggaggatgagttgaactgaggaggtcaagtctgcagtgaggggtgttcaggccactgcactccagcctgggtgacagagagagatcccatttctaaaacaattttttttaaagagagggagcaggaattaaaagtattttgttattctaaggtactcattctacctgtaaagtggtaaagtgttatttgagagtaaacttggattcgtcgtaaatgtatattgcaaactctggggcaatcactaaaaaaggagatatatctatatctgatgttctaatgaagagaaaagaaatcatacaaaaggctcaactgaaaccacaaaaggcaaaaaatagtgaaagacaacaatcagaacaaataacaagggcaacaaatagaaaacagatacgataaatattaacccaactatatcaataatcactttgaatatcaatgatctaaatgcatcaattaaaagacaggaatggtcgcagtggatcaagacacaaaacccaaccatatgtcatccacaagaaacccattttacatataaatagattaaatgtacatggatggagaaagatataccgtgctaacactaatcaaaagaaaagcagaaagagctacattaattctagatttcaggttaaatgtcacctctacaggaaacccttctgtatccacctactcacaggtgagtttgtgctcaccccaatcacattcaatcatataatcatgggcatttgtcactgtctctctactccataacagaagctttatcaaagtcaggaccttatttacttgctcactgcctattacttatcataccaaccaccaggacttagagcataataatcactctaactcctgtgtagaaaataaattagaagttggaaagaatcgtagttaacaatgcagctaatccagaaaagagaccatggtaacaggtagtactaaagaagctgacgagaagggaaccaattcagatctttaggtagtaaaatagtaaaatcagcacgacatgatgactaaatggatctgtcgccaagaaaggatgagaatcggagatgacacctggcaactcagactgctgggtggctggtgaaactgttcactgaggctggaaaacatgaagggaagtgggtctgggggaagataatgtactcagatttacacgttacaccagagacgcctgtgcaacagccaagtggaaatcaggagaaaggaggctggagacggagtcttgagaaggattaatatacagatgccacttgaagtcataggagcagataacatcacacagcaggcaaaggtaaagtgggaaaagaaaaacttccggctccagacacctgtggaggtcaaaaactgaaatacgaccaaatcgttttaaacttcatgtagtactccctttgtgttgacagttagatacaaagctgacttatctacagtacattccgtgcaaagcctatcagtttcaggccgaatttatgaagtaaacaaagcttgacttccttcattatcactgctttggttatggtagtctaagaaccagcctattaaatcactctgttaagtgcttactaatgtgggattaattttctacccatcgaatatgaatcaaatcattccacaactaagcataaaatgtaaacccaaaaatacgattcacatttttaaagaggtctataattatcaatataaaatagagcttgtatctgctaatacagtgcttttaaaaagtatataaattacaatttgatggagtgcctaactccttattttgctcagcaattaattcattcaactagaaatgtatatattatcaatcatattaaatcctcaaaaggtaaaataatacttggtgaattacttgaaattgacttacttgctatcaccactgctgccattttttgttttgaaaatgcttttttataagaaattttagcctgctcctcctctttgatctcataatcatgtgtgatgttctgtttatagcaatagagaaaaaagactggacctccttctatgaaattatatgatagacacctgataataaggtatagaccagaatataaagccagtgatgacaaaaatattttgaccagtaacagaaacagtactgtacacaggagtaaatacatatgtcgatgtgtacgctatatatgatgcataaaccaatagtttggtgtatatcctccatccataaaatagacacatatggattatctctgaaaaacagaagtagaagcgggggaaggaagctggggaaagacttttatgttttaccctgtatgattctatatggtgtttttataataaaaacatatccttgtattgcttatgtttaaaaatgaaatgtgcaccagatgcggtggctcacggctataatcccagcactttgggaggccaaggctggcagactgcctgagatcaggagcttgagagcagcctggtcaacatgatgaaaccccacctctactaaaatagaaaaaattagctgggcgtggtggcacatgcctgtagtcccaactacctggggaggctgaggcccaagaattgcttgaacctgggaggtggaggttgcagggagctgagacggcaccactgcaccccagcctgggcagcagactaagactctgtctcaaaaaaaaaaaaaaaaaaaaaaaaaaacataaagaaagaaatgtgaataccaatagcactgacaccatcctgtgggcacaaggtacatgttacacctgcaataccccaatagcctctctcagacaacttgatgccatggtcccacacatcaaatgctaagctagtgaaccaaaatcatgtccccctggggtatacatattatggattttatactacagatttacatcctctgtttcaatttccattccaagtgcttttgcgttctgttcatcactgttcacagttcagtatgtcatttaattttgcgtagttttgtgggtatccacaataattacaatgtttaatgttgtattttaaggttgagataaacacagcagtttaaacgcatatgttctggccaatctttaactccccctccacacacacaaacacatactctagctgttattacatatatccttcatcttgctagctgttttcctgttaccttccacagtatatctgacagtgacattgttattgatgccacagtaaacagctaatatatgtagtaaaaacacatgcactacaggtaatcaaaatgacatacccacccaccaaactcctgctactcattctaatcagataatggcttttctcttccctgagtgtactacaaaaggatgatgtggcactagaggaaaaatagtcacaaaacaggggaaaaaaatgttttattaagtaaactgtttattaagtgttttattaataaactgtttaggtcattgagattagaaagcaagtttgcctagacttgtgtcaaataatatgataatctgtcgcttctctatgtactctgtttaatctgaagttcctagaaacaaatagctgagcttcacgtgaataaaacacctagaacatcaccataaaccaagctttctggaacgaatactgtataaaaagcagtattaatgtttcactttttgcttttagttactcttgttggtaacaatcttacataaatcagggatctttctagcttcgacaaaacttttgtttaaaaaatgaggtagaaataatattattgttttgaaatttcctatcctattttaattagaaagtgttatactggctgggcacagtggctgacacctataatcccagcactttgggaggccaaagcaggaggatcactagagctcaggagtttaacatcagcctgggcaaacagtgagatctcgtctccattaaaatttttttttaaattacctggccatggtggcacgtacctgtagtcccagtggctcaggaggcagaggcagggagaccgcttgaacccaggatttcaagactgcagtgaacttgataacaccactgcactccagtccaagagacaaagcaagactgtccccaaataaaaacccaaaagccaagaaacaaaagaataatacaatatataatggaaaactagacctaatcagaatgttagagcaagaacagaatttaggtttaaaagagcagttaaaagtctgaatacctgggtttcattcctgaaacttcagagcctactagttacagaatatttggcaagttggctgtctctctgtcctcattgtccttattaataaaataaaaataataatagtacctaattctcacaagactcttggaaaatcaaatggaataatacagtgcctggcacacagtggatgcctaataaatattaactcttattgttagtacagattcagaaactgaggcccacacagtgtgtgttttccctgagataatttaaccagcaaatgccagaattagcatgagaacctggaacccctgatatttttgaacttttgatttcttttccattaagaccactttttgtgtcgtctcaaattactttcaaaggataaaatgagagagaagaaaacccctgagacaagcatggcctaaatttaaaagaaggaaagaagaaactctggaggtgtgtgtgcatatacaaaacataagaaacaaaaaggatgagtggagggtggcagggaggaggcaagtgacatagacacaaaacctctaattagacttttaataagatgtaactcattaggacataattacatttcttattaaatgattaatcataaggttagaagaaaaggtcatgctgaatgttaattatacatcctttcaagaatttcaaagatgttaacaacagtactcgtaaattaactcaaactcttggcaggatatttggcattatctttaaaaattcaaaaggcatatatcctttcaacaatcaatacaataagaatttatcctactaataatttggggaagtgtgcaaaatgtgcaaaacaggatgtgaagtgcattattggcaataccaaatattagaaaagtgccaagcattcattaacaaagaaattattattatggtcaattcatacaatgaaacatatgggatacaaaatgttccccaaagtagatcgttaaatgaaaaaaaaaaagtacacaagaattcatgccagattaaactatatctttttttttttaaacataggatgtagatacacaaatatgtctgcacaagcaaatgctgcaaagacacatgagaaacttaacagtgattgcctgtggaaatgagaattgaagtcggggggcaataagatggggaggaatagacatttactttcacatagtagacatatacacacacacacccaatttttaaccatatatatttaacatcagttttaacattttaatgtccctggcaacctgtgtgactcagcaggtgaataacaagtaaaagtaaattaaaggctgtaaagaagtagacacaggccaacaggtatagtgaaggacaaatttaagagtaaagaatttgaaagcttcacttatatatggctgaaaagtcttacctgacacttagcactacagtatttggcgacgcggcactgagagcatcgcatcagcttttccttcctgtggggaaaaaaattaattctgcattaagaaatgagtgggaaacatagtacatagttgaagaaagaaaacataagtcaacatacggacacccgtatgttctgtttactccattatgtacagtcccttaagatttggattttcacactgatgagcctcctcttgaaccttccatgtgagacactgatagaaaaactaagtccttttgtctgacagaagatggcggggaagaggcaggaccagcttgcagctcccgatcggacagacagagcagcgtgtggggactcacactgtgaacttttgatccaacaactgccacagcaacataccaggtaaactaagagaatccacagaccctctgaaggaactgtatcgccactgcaggctccctgagactctgaaaagatgtgagctgcctgcttgctcagcagggaggctggcggtctggggcaagttctcagccacagtcaccagctgcctggaaacagactccgtgctgctgtgggggcacggtgggagtgagaccagcctttaggactgcgggctgtgtgggagtgggatgaggcctgtgactgctggctttcccccacttctctggcagcctgtgtgacccagcagaagcagccataatcaccctgggaacataactccattagactgaaaaccacatccccatcccaacagcagccgcagcaatccccagccaaggagaatctgagctcagacacacctatccctgccccctggtggtctttctctaccagccctgggtgccaaagacaaaggccataatctcttgggagctctatggccctgcctaccacctaagaaacctgaataggtaaccaggcgaccttagggcaagtttgcttcctccctgtaggaccacagctgatgtgttcctgaaagcaccaactcctggctggaggccaaccaacacaaaaccagcacactaaacaaaaatacaaccaagggcccttgtagagtccacttcacgcccctgctacctccatcagatcacaggactcttagcagtcactccccagtaccagcccagagcccagtacctccactgggtggctagacccagaagagcaaaaacaatcactgcagtttggctcttgggaagctccatccctgggggaggagggagaacaccacatcaagggagaaccccttggaacaaaagtatctgaacagcagcccttgagtcccatgtctcccctctgacacagtcacccaaatgagaaggaaccagaaaaacaattctggtaatatgacaaaacaagctctttaacaccccccaaaagatcacaccggctcaccagcaatggatccaaaccaagataaaatatccggattgcaagaaaaagaattcagaaggttaattattaagctaatcaaggaggcaccagagaaaagtgaactccaacttaaagaaatcgaaaacctgatacagaatatgaaaggaaaattcttcagtgaaatagcataaataaaaaatgatcacaacttctagaaatcaaagaaacacttagagaaatgcaaaatgcactggaaagtctcagcaacagaatcgaacaagcagaaaaaagtacttctgagcttgaagacaagtcttttgagttaacccaatccatcaaagacaaagaaaaaagaatttttaaaaatgagccaagcatccaagaagtttggaactatgttaagcatgcaaatctaagaataattggtgttcccaagacaaaaaaaagaaatctaaaagtttggaaacattatttgagggaataatcaaggaaaacttgtctgaccttgctagagatctagacatccaaatacaagctcaaagaacacctgggaaactcatcacttagacacacagtcaagaggttatccaaagcaaagatgaaggaaagactcttaagagctgtgaggcaaaagcatcaggtagcctataaaagaaaacctatcagagcaacagcagatttctgagcagaaactgtcagaggcatgcatgtgaaccagggcaactctatcttgaataggagctgagttaaatgaggctaagacttactgtgctgcattcccagacagttagggcattctaagtcacaggatgagactggaagtcggcacacaatacaggtcataagtaccctgctgataaaacaggttgcagtaaggaagcctgctaaaactcaccaaaaccaagatagtgataagagtgaccagaggtcactggtggtcctcactgttacactcccatcagtgccatgacagtttacaaatgccatggcaacgtcaggaagttaccctatatggtcaaaaaaggggaggcatggataattcaccccttgtttagcatataatcaagaaataaccataaacatggacaaccagcaggcctcggggctgctctatggagtagccattcttttgttcctttactttcctaataaacttgctttcactttactctatggactcaccctgaattatttcttgcatgatatctatgaaccccctctgtaacaaaaccctataagctagaagggattggggtcctatttttagcctccttaaacaaaacaattatcagccaagaattttgtatgcagcaaaactaagcttcataaatgaagtaagatacagtcttttaagacaaatgctgagagaattcgccactaccaagccagcactacaagaactgccaaaaggaactctaaatcttgaaacaaatcctcgaaatacaccaaaatagaacctccttaaaacagaaatttcacaggacctacataacaataacacaataaaaaaaacacaaggtattcagacaacaaacagcacaatgaatggaatagtacctcacatctcaatactaacattgactgtaaatgacctaaatactccacttaaaagatatggaatggcagaatggataagaattcaccaactaaatttctgctgtcttcaggagactcacctaacacataaggactcacataaacttaaggtaaaggggtggaaaatgacattccatgcaaatgggcaccaaaagtaagcaggagtagctattcttatagacaaaacagactttaaagcaaaagcagttaaacaaaacaaggagggacattatataacaataaaaggactagtccaacagtaaaatatcacaatccaaaatatatatgcacctaacactggagctcccaaatttataaaacaattactaatagacctaagaaatgagatagacggcaacacaataatagtgggggattttattattccactgtcagcactagataggtcatcaagacagaaagtcaacaaagaaacaatggacttaaactataccctagaacaaatggacttaacagatatttacagaacattctactcaacaactgcagaatgtacattctattcatcagcacatggaaaattctccaagatagaacatatgatagggcacaaaacaagtctcagtaaatttaagaaaatcgaaattatatcaagtactctctcagaccacagtggaataaaattggaaattaactccaaaaggaaccctcaaaaccatgcaaatatatggaaattaaataacctgctcctggatgattgttgggtcaacaatgaaatcaagatggaaatttaaaaagtctttgaactgaacaataacagtgacacaacttatcaaaacctctggaatacagcaaaagcggtgctaagcagaaagttcggagcattaaatgcctacatcgaaaagcctgaaggagcacaaatagacaatctaaggctacacctcacaaaactggagaaacaagaacaatccaaacccaaatgcagcagaagaaaagaaataacaaagatcagagaagaactaaatgaaattgaaacaaacaaaaaaaatgcaaaagataaatgaaacaaaaggctggttttgaaaagataaataaaactgatagaccattagcaagattaaccaagaaaagaagagagaagatccaaataagctcaactggaaatgaaatgggaaatattactgataccacagaaatacaaaagtttattcaaggctactatgaacacctttatgtgcctaaactagaaaacctagaggggatggataaattcctggaaatatacaaccctccaaaattaaaccaggaagatatagaaactctgaacagaccaataacaagcagcaagactgaaatagtaattctttaaaaattgccaacaagaaaagtctaggaccataaggattcacagctgaattctgtcagacattcaaagaggaaccagtatcaatcctattgacactattccagaggatagagaaaaagggaatcctccttaaatcattctctgaagccagtatcaccctagtacaaaaaccagggaaggagttaacaaaaaattaaaactacagaccaatattcctgatgacacagatgcaaaattcctcaacaaaatacaagctaactgaatccagcagcacatcaaaaagataattcatcatgatcaagcgggtttcataccagggatgcacggatggcttaacatccataactcaaatgtgatatgccacataaacagaattaaaaacaagaatcacatgatcatctcaatagatgcagaaaaagcatttgacaaaattcagcattcctttatgattaaaaccctcagcaaaatcggcatagaagggatacaccttaaggtaatgaaagctatctaagacaaacccacagccaacattacactgaacagggaaaagttgaaatcattccccctgagaaatgaaatcagacaaggatgcccacttttaccacttctactcaacatagtactggaagtcctagccagagcaatcagacaagagaaagaaatcaaaggtatccaaattagtagaggaagtcaaactgctgctgtttgtttgctgatgatatgattgtatacctagaaagccccaaagactcatccaaaagctcctcgaactagtacatgaattcagcaaagtttcaggatacaaaattgatgtacacaaatcagtagctctgctatacagcaacagcaaccaagctgagaatcaaatcaagaactcaatcccttttacaatagctgcaaaaaaataaaataaaataaaatacttaggaatacacctaactaaggaggtgaagacctctataaggaaaactacaaaacacagatgacacaaacaaatggaaacatgtcccatgctcatggatgggtagaatcaatattgtgaaaatggccatattgccaaaagcaatctacaaattcaatacaattcccatctaaacaccactatcattcttcacaaaactagaaaaaaaaaatcctaaaattcatacggaaccaaaaaagagaccacatagccaaagcaagactaagcaaaaagaacaaatctggaggcatcacattatccaactccaaactatactacaaggccacagtcaccaaaacagcatagtactgttataaaaataggcacaatgaaacagaatagacaacccagaaacaaacccaaatactgacagctaactgatcttcaacaaagcaaacaaaaacataaagtagggaaaggacaccctattcaacaaatagtgctgggacaattggcaagccacctatagaagaatgaaactggatcctcatctctcaccttacacaaaaatcaactcaagatgaatcaaagacttaaatctaagacctgaaaccataaaaattctagaagataacatcggaaaaacctttctagacattggcttaggcaaagacttcataacaaagaacccaaaagcaaacgcaacaaaagcaaacataaatagatgggacttaattaaaccaaaaagtttctgcacagcaaaagaaataatcagcagagttaacagacaaaccacagagtgggagaaaatcttcacaatctatacatccgacaaaggactcatatccagaatctacaaagaactcaaacaaatcagcaagaacaaaacagttccatcaaaaagtgggctaaagacatggacagacaattctcaaaagaagatatacaaatggccaacaagcatatggaaaaatgctcaacatcactaattatcagggaaatgcaaatcaaaaccacaatgtaataccacctcactcctgcaagaatggccataatcaaaaaatcaaaaaaataatcgacgtaggcacagatgcagtgaaaagggaacacttttacactgttggtgggaatgtaaaccagtacaaccactatggaaaacagtggagattcctaaagaactaaaagtaaatctaccatttgattcagcagtcccactactgggtattctaccaaaaggaaaagaagtcattatacaaaaaagatacctgcatacacatttatagcagcacaatttgcaattgcaaaaatatggaaccagcccaaatgcccatcagtcaacaaatggataaagaaaatgtggtatatatatacaccatggaataacactcaaccataaaaaggaacaaaataatggcattcgcagccacctagatggaattggagaccattaatctaagtaaagtaactcaggaatggaaaaccaaacatcgtatgttctcactcatatgtgggagctaagctatgaggatgcaaaggcataggaatgatacactggacatcggggactcaggagaaacgttgggaaggggtgagggataaaagactacacattgggtacagtgtacactgctcaggagatggatacaccaaaatctcagaaatccccactaaagagcttattcatgcaaccaaacaccacctgctccccaaaaacctattgaaattaaaaaagaaaaagaatctcagagaaaaaaataataacgcatggccctggacccatagatctccatgtactacaggagaatgctgtggtacgcacccccagcaccgcccccacaaaaaaatgtcctttttaaaaactttggtagaatatacgtaacataaaattcactattttaaccattttaagtgccctacttcacttcatagatactgatctctccatatcaaattcaaatccagtccataaactggttaaaagtattttatacccttcaaatatacaaattttgtcttaaattatcatatagtttaattatgaatatactcctcctgagaaatggttttaaaattccatttaattcaattactactttagacatgctgagttgagatgctttaactatctcccccaaatcacctgggtgacaaaaaagcagatatttttaaaaacctgaattatagctctccctctccctctccctctccctttcccacggtctccctctccctctccctctccacggtctccctctccctctctttccacggtctccctctgatgccgagccgaagctggactgtactgctgccatctcggctcactgcaacctccctgcctgattctcccgcctcagcctgccaagtgcctgcgattgcaggcgcgcaccgccacgcctgactggttttcgtatttttttggtggagacggggtttcgctgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagccgccatcccatctaggaagtgaggagcgtctctgcccggccgcccatcgtctgagatgtggggagcgcctctgccccaccgccccttctgggaggtgaggagcgtctctgcctggccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggttagcccccgccaggccagccgccccgtccgggagggaggtgggggggtcagccccccgcccggccagccgccccatccgggaggtgaggggcgcctctgcccggccgcccctactgggaagtgaggagcccctctgcccggccaccaccccgtctgggaggtgtacccaacagttcattgagaacgggccatgatgacaatggcggttttgtggaatagaaaagggggaaaggtggggaaaaaactgagaaatcggatggttgccgtgtctgtgtagaaagaagtagacatgggagacttttcattttgttctgtactaagaaaaactcttctgccttgggatcctgttgatctgtgaccttaccccccaaccctgtgctctctgaaacatgtgctgtgtccactcagggttgaatggattaagggctgtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaataaataaataaaaaggaaaaagaaaaaaagagagagaggcaggaggcttagagtcagagaagtcaatgtggtgctgggatctgagaaaaagaacctggaagatggtcagttgctggctttgaagatggaggaagacactgaaccaagggatgcaggacaagctggaaaaggcaaggacacagattttccctggagcttcccagaggaagccaacatctggattttagtcccataagactcatctcagatttgtgagctccaggactgtaaggtaataaatgcgtgtggttgtaagccaaaaaaaaaaaaaaaaacctgaattgtaaaataaaaacaataaatctgatggtaaaattcacagtgacaaggatcagacgggactgtgtatagtttcaaggtggtcaagggctctaaaagtcaacctataatactaacatcaatgacaaaacagaacagctctttctaagcacttctgatatgacaggcacagtacgaagctctttacatctattaactcacactaaatttgaaacagttctgtataaggtaagcagtcttattatgccgactttagagatatttcaatacgttttcaaaagataaaaagtagatggagtagtacacactgctaaggcatcacaccataaagtgaaagtggcaggtgatactgaaaggataaaaacggaatcctatagagaatcagaacttgaatacatcaggtacctcacccctgaaagaacagaagtgagttatgggacgtaaaacatggggagtggttaaaagtctaaataaagcaacatcaaaaaattccatccacccccaagtgcagaactctagcttctaggtatcaatactccagcaacaagccaaacccaaacaatcgggccctagagttcttgattgtaaccacacaccacactaccattcttcagtgaaactggatacaatcaagtcaacacttagctgttcatgagacacacttcaaacaaaaggacatgcaatggtggaatgaaaaggatagttcagacaaatatgaactcaaaaaaagcctgtgtaactacataagtttctgaaaaaaagagacttgaaggttaaaagcattaatagagataaagccaatacacagtgacaaaagacttccatcaccaactgttacatacaaagtaaccaatatacccagtctcaaaatctataaagtatacatcacagatctctaaggaaaaaatgacccatatacaataagttaaagcagggcctggaatacagcaggtaccatataagagttagacattataaattctctttcagaaattcatagatctagaagataaagaataagtagataaagaagataagaataagaccagtctgggcaacatagtgagccctcatttctacaaaaaaaaaaaaaattaaaaaattagccaggcatggtgtcacaagcctgtggtcccagctacttgggaggctgaggtgggaggatggcttgagcccgagagactgaggctacagtgagctgtgatcacaccactgcactccagcctgagcaacagagtgagaccctgtctaaaaaaaaaaaaaaaaaaaaaaaattaggaatataagaatattactcaagattcagtcgggttaaaaacaagggaattctggggaaatgatggcagtgatgtaattttttaatctcctcgactctccccataaaaaaaaagtaggacagtaaaacctaatcaccactccccaccctggaaaacatcaataacaaacctcaaaatatgactgggtggaaaaaactatgagtggttctgagagcagaattaaatcagtatctttattgtaggaaacaaggcaacttaacttccaacagacctgtaaacaaggaggccccaaatcgccaaaagctgtccagcatagaatgccaagccaatctgagaaccgcagccaaaactgggagagggttctttctttagcaaacctctttaagatgaattccccagggctgctctgaaccctgccttccctagacctggctcctcagattttctcacttccctctctcttgtctaagttaatcagaggctatgtctgttggctaaaaataaagatccacaagtacatacaaaatgtttgttcttgattttaaaaaataacgagcagaatcaagatacctaagaagctcaggtgatgaacacctagcaaatatcaatccttcatttcctcctccctcccatagctaccaaaaaaacgctataataaatgttgacacagaagtttggtaaactaactaacaagataattcagagtacttgaataatttatgtgtcatttaaggtgtgatggcaattccttaacatgagttatttaaatgtttgggattgtttttacatattaaatgactaaataaataaatctaaattcttactttcaaaaaaaaggcaagttgagtccaagaaaaaagtgatgtgtgcttgattaaaccaactactgaaactttgatatgttactgcttttctctttggggcatggttcagagcagcagccccctggcaggctcccctgcagagaaaatacttgggcagcagtgagagggaacaggaggtcagcagaaacacagccaccagacagtacgagaaaaccttctttttctcttaaaaaaaaaaaaaagcaagagggccacatctgtaatttcaacctcagtgacacgcttggggagcatagaatcatctcaaaaacaaaattggccaggcacggtagctcacgcctgtaatcccagcactttgaggtgggcggatcacgaggtcaggagtttgagaccagcctgaccatggtgaaaccctgtctctactaaatatacaaaaattagccaggcatggtggtgtgtgcctgtaatcccagctactcaggaggctggggcaagagaatcgcttgaacctgggaggtggaggttgcagtgagccaagatcatgtcattgcactccagcctgggcgacagagcgagactccatctcaaaaaaaaaaaaaaaaaaaaaatcaccacatgtcatttcaaattgaacaacaaagccgtattttttggggaaaaaaagagaaatgtctatgtcaaatcaaaaacataattaattagcagtttatagaaaaaggaccacttattttaggtagcttcagaggctaaaacaagaaatagtgaatggaagttagaggagggcagattttacctaaattgtaacgatttttctggtgacagcaactgttcagaagtctaatgcaatgccttgagaagcgtagggttcccagtgacttgacatgtttaaggagaatctagtagtaagtatatttgctagacatgaggtaagagaatttccagtattgcaaaagagaaggagttagataagttttcttccaactccaaaattatttggttttgtttctcttgtgcaaccaataaatataaactaaatttgaagatgacagaaattgtgcatattttaaggcaaagtatggtggtctcagaaaggtagagaacatgctgtttgcagagtgtttgtctaaaaagtcgatccagaactggagtttctgaatgaaaaaccgcaacctctgcctcccgggttgaagcaattcttatgcctcaacctcctgagtagctgggattacaggcgtgcacaaacacgcccagctaatctttgtattttagtagagatggggtttcactgtgttggccaggctgctctcgaactcctggcctcaagtgatccgcccacctcagcctcccaaagtgctgagattacaggcgtgagccaccatgcccagccaaaaaataatcttaaaaaaataagtgaggaatgtatcagtcagagaaaagtgatttttaccttttttcccttcatttcaaagatgaatattagcattgtaccaccaaataagagaagatattgatattattttttaccaaaataaatgggatcgttagcaacccaccctcttcaaaaaaagcaaaaaggaatcccctatcacttgttcatacaaacctgactctagagaacggagtgtcatatcaaagaaaattcttaggttactcagtgtcccagacacagtggttcatggagcacaagttaagtcctctcttctgggtataggctgggccataattagtttctccaacagcctaagctactgaaatgtaaaaagaaaataaaaactgggcaaaattaattgttcttcagtcttccagtatacaaattaaaaacttagatatgggtatagcaggaacaaccatctctaagaaatttttaagaagtggggcgtgaaattaattgagtcactcaaatctcaactatgggggtactatcttagggaccatctctctatccttcttgggtgtcagagggaaagagtatgtccatgtttagaaactctgtgctaaaaccataaaaccagttaccagacagtaggaaggaagtttcctggaatggatatagaaaacaaaaaaatcctagtgactcccaaattccccccagccctgggacccacagaatccactttaaacttcctatagagaaaaaaattcatctacaacacattcctatataatcaactcattattcagagctccttcctagtaacatgtcttaattacctaaaagtctctgtgatggttaatactgagtgtcaacttgattggattgaaggatgcaacatattgttcctgggtatgtctatgaggttgtggccaaaggagataaacatttgagtcagtggactgggaaaggcagaccccccctcaacctgggtgggcaccatctaatcagctgccagcacagctagaatcaaagcaggcaggagatcgtgaaaaggctagactggcttagtctcccgacctacacctttctcccatgctggatgcttcctgccctcaaacatcaggctccaagttcttcagttttgggactcagactggcttccttgctcctccgcctgcagatgacctatattgggaccttgtaatcatgtgagttaattcttaataaactcatatatacagatagaaagatagatagatattccattagttctgtccttctagagaaatctgactaatacaaccacttagcagctgtgtaatactaagcagtttaacctctcaaaaccactgaactaaaatgagcataaataataataataacattacatgggccctgagatttaaatgaaacttaaaaacttaatatcatgcttggttcacagaagtgctcggtaactattactcattatcatcacagttttactattattttaagatttttaaattgcaaactttcaagatgtttctagatatcatctgaaatatcttagtactaacagattaaacaatactaatatattaactagtttagccactgtacacaaattcagaattttataaacctttgaatgtttataatccttagaatatttttcctagttatttttgggaaaatttcagaatttttaaaaattgaagtgattacacccaccatccacctatcaaatggctattaacacacaccagtagatgtggtcaaaattgtacagactcataggaaaatagaattgatttggattcatttttctttcttttttatttttgagacagggtctcgctctgttacccaggctggagcacaatggcacaaacacagctcactgaagcctctacctcccaggctcaggtgattctcctacctcagcctcccaagtacctgggaccacaggtgcatgccactacacttggctaattttttaaattatttgtagagacagggtctccctatgttgcccaggctagtctcaaacttctggactcaagcaatcctcccacctcagcctcccaaagtgctaagattagaggcgtgattagattagagccactgcacccagcctgggattcctttttctacattccatttcatcttatttcacatttctaacacaaagtataaaacaaaaaaaaaaatgtaatggttagtatttcgaggaaaattaatctatacttcactggcaccataccttcctaggagaaacacaagcaccttaaatccagcactttgggaaaagcacagcaaaatatgtggacccagttagaatccgagaggcagaccagctgcttgagtactccccttccactgtctgcaaccctctaaactaaagctaatatccttgtggagcctgtgccatctgataaacacaaaccccaggtgtgaattcaacaagtgctcagcaaccggccaccatgggcatcatcgcataacgtcccgggtggatgacagtggagagggtaatgcagtcactgcttcttggagatggcaatcaagaaaggcagaccaacacacatcacttgcagaatgaaccataatacaaaaccattttttgagaagtgacacagactatacaggaccccagttcaggtgaaggaaatgtcactttctgatgaataaagagtgagtggcagagaatggtaggactattttgggggacaaggaaataaaaggttttagtagtttagggttcaaaacctgcaatacttactaggggcgtacccttgtaacatcttgtagcctcaatttcctcctctgcaaagtgggaataagtgacttactcacgggactgcaaggcaaactatgagataatctatatggagcgcctgctaacacagcaccaagcaaagtatttagtgcagagttaaaactgaggctgctgggtgtattctcaaattgttcaggatagttttgtccatctctatcagaaaagtttcttctatatcacttccatggttactaaaaacggaaaaaagctacatctacgtgtgtcacaaatgtcgtcatctccacacaggtacacagaccatttattaataccactttttgaaacccacatgtagccagactacttggctctaatttcaaattttgactagtatcctaagtatttgatacctcaatctacattcactgaagtcataagttttaatgtgatcagaataactgacttcaaagtggtctaattcaagaagctccaactttaaagttgtaaaaatgctttttgaaggttgcatttgtagaaatgaaatttgaaaagactattaaatattcaataatattaaaaggcaattacaactcctaacattctgtttgctttaggcaaggtaatgtctgtaacaagctaaggagcaaattaaaacgccagggtccttatgttttataacaacacggttctaaactctcctcatcatactaacagtatttaaaagattatacactgcctgttgtaagtcactcggacagctaatcattggaaataagtgaattaagaatcggtattaaaatacactggcttgtttttcaggtggagcacagtgagtagactggagaaagctgtgaccaagatgaactgcagaaaaggaagttttttctagtaacaacacccgtccctaaataagcaacctcttcagtctagtctagtaacacaactctgatcatctaagagatgtgttcaatttccctaagtcttcttgaaatctaaaataatttttaaaaaatgaggaagaagaaaaaaatctgatttttcccaaagattgaaatcaaacaccctttaggtgtataactattgctagtacaaatatcacagtaaatacatttttaaaaagtaccatgggtaaaatttcaaataaggtataacaatatttgatcaatattttcataacatactatgacgtaagccttcaaaatggcaacagatgcccaccttgagttcagttccagaaaatattttgtcactctagaaaaattctctctcttacttcctccaattagaaaacaacacatcagcaccatgcttccacttcagcttcgggggtgggaaaatcaaaagctaaattcactaattggagtcgtttgttcatttaagaggcctgaagccatcttctccttctgcctgctttaaatatttgctcttctgttttacaattatgtataatactttgtttaacttttaactgtaaattgcctcaagtctccttggaactaagcaatgacaaaatctcaattaattcattctctcttttggaaaataaaatgacactttaagtttataaagaaagactagcatgctgcctagttcctaagtaaagaaaccttcaaagaagaggccttaagagacatggaattaaatgttacagctgcaagtgcactataattaattacaaattctcatcgatttttattaagaggtcaatcatctgctgatagccatggaacgacagttaacgggggttggtgcaagcactttgatgcctgctgaccctcctctagtgagcatgttgtatgcccaagagaaggctctccatggccctaaaataccactcagatatttttcttatcaaacacccatctgagtttgagcatatctttttattctatttttttagcacatgtctgtagcagccagagagtttaagaataccttgagatgaagtatagacatccctctaaaaggctatgactacaagtcatttgcacttagtatgaattaatttattcagataatcttacttcctttttccacttagctgagattttaggaatagagattttgcatagagtaggtacagaaagaggagataacagtgctgaacatttaaaaagcctagaaagaagcctgtaatcccagcactttgggtggcggaagtgggtggatctcttgagggcaggggttagagactagcctggccaacatggcgaaaccccatctctactggccagctgcagtggctcacgcccgtaatccaaggactttgtggggccgaggcaggcgggtcacctgaggtcaggagagaggagaaaatgcagtataacaaaaagggagttagaatgtataagaacatttcattttccataaagtttggagtcaggcccaacatgctctcaagtatgaaatacagaaagtacaaggaggaggaaaaattctaagagaactgaagagaactgtactttaagcctggctgcttcatttactgctctccatctacaggcaatgaataaatgtatccacccctaaaggtattctaatcataataataaaagctacctagaatgtcaaaaggaattttcatatcacatatacattgtaaaattaagttttttcaatgtattaaaaaaaagactgaaaagaaatagaccaaaatattgatttttttctttaaatgatacgaattggggtgatttccccctccttttattttttccatttttcagttttatataacaagattattttacttccatgatcaaataaacataaacattaatgaaaaggaaatatgtattatttaacagccttaaattgtgtctagtctaacgcagggcatagagagaaggacagacagacagataggtatgtcagctttaattacaatttattccaatgtttagaatagtaaacacaaatatatactttattcaaacataatttaaattaaatattctttattaattgaatttatttctaactggcattagctacaaaggatgttatcaaatgaaatatttcttagtttttgataacatgagaagctgacaacttacaataataaaatcagtatcatatgctaaatacaaaaatctaatagttctggatttaatatcttccacaatataaaaagcaatcatttcagaaaagaaaccgttattaaaaagaagaaaagcttttgccatatggaacttgggttgctcagcctttttctgaaaagatgtctcaacttcatctgatggttcatattttatcattttctttgacttatatgaacttgaaggtcacccagataaagtaaaactttattcttttatattaacttttatttgatttggagttagtcaatcaaaacattacttgtttgaaaatatagacatggagaaatctttaacaagcaagatatgacagaaattaaaggctattccacaaaacaaccctgccattcattcactgattcattctttcaacaaaaatatactgacccccttccaaatgccaagcacttaattagaaacacagtgggcactgtccattgtttacccaaaaaccaccccactctttcctagcatgaagaaatactgtgatttgctgatgtagcaaacacagaactcttgatttcagggagaggagattgccagagccggggaataaatcatgattaatctaaacttaaaaaaaaaatgtatccctcatgggcactggccactctaagaacaagccatgtggcccggttttggctaatgacctgtaaacaggtacactcacttctcattattcatatattccatatttgcaaattcacttattcacttatatttatctgtaactccaaaatcaacagtcacagcatgtctgcagtcagttgtggacagaagaggaaaggccaaaaatgtgtgtcgcccaatatgtatgttcccagctgaagtcaaacaagaagacactgccttctcagctctcacagtgtaagcgtcctttttgcagaccacttggtgctctgtttttctcatttttctcgatttgactgtataatatggcccctaagcacagtaccacagtgctgtctcgtgtccctaagcacaagaaagttgtaatatatgcctcacagagaaaatgcatgttttagataagcttcactgaggcataagttatggtgctgctgaccctgagttcaatgttaatgaatcaacaatatatattaaataaggtggccgggcatagtggctcatgcctgtaatcccagcaggagtgtgaggccgaggttggtggatcacttgaggtcaggagttcaagaccagcctggccaacatggcaaaaccccatctctactggccaggcgccgtggctcacgtctgttatcccagcagtttggggggccgaggcaggcggatcacctgaggtcaggagttcaacaccagcctggccaacatggtgaaacctcatctctactaaaaatacaaaaatcagcagggcatggtggctcatgcctgtaattccagctactcgggaggctgaggcagaagaattgcttgaacttgggaggtggaggttgcagtgagccgagatcgcgctgttgcactccagcctgggcaacagagtaagactccgtagcaaaaattaaaaaaaataaaataaggtgtctttaaaaagaaacacataataaaacaaggttatgtactgatcaggtgacaaatatgttgtgactagaggctttcaggaacctaatcctgtatatctactaggaggaatgaatggctcagtattggctaattcagttttcacagtaactttataaaacatacctactggaaataataaaaatgaactacatttctaatgagagactttttttttttttttttttttttttttttttaccaattttcaaccttctcagcacaagacacaacatgagagtaaatgccaccactctgttacatcaaatagccaacttccaatttttggatgagaaaaataagttaactatttgtttaagccactacagtggaagtgtattcacaaagatgtaacaaaatggtgcttcctccttgtcagtaaacagtacagtggtcctgaaagaacacagcgaagatgttctacattctagcataccaagtcttacatatgctgcttattttctagtcaaatagagcagcacgtgttaatacttatatttctgcccttcaaaattaaggtcaaaagatcggcaataatgtgaactggctaaaatctaatttttttattgttgttgtttttgtttttgttttgagacagagtcttgctctgtcactcaggctggagtgcagtggcatgatctcggctcactgcaacctccgccccctgggttgaagcaacaatcctgcctcagcctcccaagtagctgggattacaggtgtgcaccaccacgcctggctcatttttgtatttttagtagagacggggtttcaccatgttggccaggctggtctcaagctcctgaccttaagtggtccaccagcctcagcctcccaaagtgctgggattacaggcatcagccaccacacttggccttaaaatccaattcttaataaagttttggactttattattacttagaaatatgcctagcttctcaaaaaaactattttgacacgtgataaaggaatgtctggaaaacagatatggtctgattaagatataaatatgatggtataaatattacagtattacatatatatacacacacagctctctacgtgtcttgctatttcatattgatagaaccgatcttatgttcatattgatggacattagtgttgataacaatgttttaagctattataaacaagcagggcacagtagctttgggagcccaaatcctagcactttgggaggccgaggtgagcggatcacctgaggtcaggagttcaagaccagcctggccaacatggtgaaaccccatctctactaaaaatacaaaaattagccaggcgtggtggcaggtgcctgtaatcccagctacttgggaggctgaggcaggagaatggtgtgaacccaggaggcaaaggttgcagtgagccaagatcacgccactgcactccagcctgggcaacagtgcgacactccatctaaaaaaaaaaaaaaaaaaaaactaaacataaataaaccagtataaacaacattacaatgaacacatacttgaactgtgcacttatacaattctttccaaaactttctggtctcagtcctgacttaaaaattactgaaggatcttaaagaggctttacttaggtcgacttctctactgatatttaatgtattacagattaaaattaagacgttaaaaaaataacgtattggccgggagtggtgtctcacgcctgtaataccagcactttgggaggctgaggtgggcggatcacctgaggtcaggagttcaagaccagactgggcaacatggtgaaaccccatctctactaaaaatacaaaaattatctgggcatggtggcgcacaactgtaatcccagctactcaggaggttgaggcaggagaatcacttgaacccgagaggcagaggttgcagtaaaccgagatcacaccattgtactccagcctgggcgacagaggctttgtctcaaaataataataataacgtattaattcattcaaaagtaagaatcctattacatgtcaacatattttaataaaaaataactaaatttttcaaaacaaaaataagttagtgaggaaagtggtaatgttttacttttttgataatccttttaatgtctggcttaatagaaagcagctaattttttttatgtttcttcattcaatctactgcaatgtagcttctggaagacccacagtatactcatgagataataagaataaaaaaggcaaataattctttttttttttttttttgagacggagtttcactcttgttgcccaggctggagtgcaatgacgccatctcagctcaccacaaactccgcctcccgggttcaagcgattctcctgcctcagcctcccgagtagctgggagtacaggtacctgccaccacacctggctaattttgtatttttagtagagatagggtttctccatgttggtcaggctagtcttgaactcccaacctcaggtgatctacctgcctcagcctcccaaagtgctgcgattacaggcgtaagccaccatgcccaaccataattctgaattattatcatgaaaatagttttcacttaaatccctgaaagtcccatgggtactcccagaggcctccggactccactctcattccatttctttaaagtatgtattcctagaagtaaaactgctgagttgcaagaaagcacaacttgaacaattttgcatattgacaaacaggtctccaaggcagctggaggaatttacactctcacagccatataatgagagttcccctaaatctgtatctcatcacctcttgataccgtcatttcacattctgccggtctgatgggtgaaaatgttatctcaatgtgctttcccttgacaaatggtcagggtttgagcatcttttcatgtctattcaccatgcataatttcccttttatcaactgcctgttcatagcatttgcatattttctactgagttttcttagtgaatttaatcatttgttgagtgcctgttttacaaactcatttctcacagactgtgtctgtatttcacaactaggcactatgaaagaatataatactgtaattaaatagcttacactagtgccacgtggcctggaattaaaatttagttgaccactgtgatggttgatactgagtgtaaacttgattggattgaaggattgatcctgggtgtgtctgtgagggtgttgccaaaggagatgaacatttgagtcagtggactgggaaaggcagacccacccttaatctgggtgggcaccatctaatcagctgccagcacagctagaataaaagcaggcagaaaaatgtaaaaagagagactggcctagtctcccagcctacatctttctcccatgcaatgcttcctgcccttgaacatcagactccaagttcttcagttttgaaactcggactggctctccttgttcctcagcctgcagatggcctattgtgagaccttgtgattgtgtgagttaatacttaataatctccccttcatatatatatatatacacacacacatatatatatacacatatatatacttaataaactcccctttatatatataatataatatattatatattatatataattatatataatatatttaatatattatatataatttaatatatttaatatattatttttatatattatatataatatatttatatagtatatataattatatataatatatttatatagtatatataaatatattatatatataaagcaatctccctgtttatagctcatttataacaatcctcagaaatggaaatttgtaattgatcaaccttgactaaacaagaagattcccaatggcaataaactataacatctatttccccccagagaaaatgagaaagaaaacaatattttatatatatattattaagtatatatatacttacacacacatacatacacacacacacacacacacacacacacacacatatattccattacttctgtccctctggagaaccctaactaatacaaccatttagcaactgtgtaatactaagcaatttaatctcttgaaaccactgaactaaaatgataataaataataataataacattacatgggtgtaataagaataaaacttttaaaaacttaatatcattcttggctcacaggagtgctcagtaactattactcattatcatcacggttttattattaagatttttaaattgcaaactttcaaaagctgtttctagatattatttgaaatatcttagaactaatagattaaacaatactaatatattaaacagcttagcctttctagaaaatcagaattttataaagctttgaatgtttataactcttgggatgtttttcctggttattttcaggtccttcacatatctaacaatgaaaaattactgaattaacgtaacagttgaagttattcgcagaagtaaccataggtatagctaaacagtaactacttcttagcctgaaagcaaccaaatatgaatacaataacaatgaacctaatgtttctggaaaaatcattaatccaactgacttttaaaagttttgaaaaggccgggtatggtggctcacgcctgtaatcccagcactttgggaggccaaggcggatggatcacttaaggccaggtgttcaagaccagcctggacaacacggtgaaacctcatctccactgaaaatacaaaaattagtcaggcatggtgacacacacctgtaatcccagctactcaagaggctgaggcaggagaatcacttgaacctgggaggtggaggttgcacctcccagggaggtcgagatcacaccactgcactccagcctgaggatcagagcaacactctgtctcaaaaaaaaaaagaaagaaagaaagaaaaaaaaaagttctgaaaagtcaacgtccatacccaaatagatggaaaacttctacacatttttctcatatctcagaaaaatattcagagataatacagtacattaaatacttttatttttctacctagataataaggaaggctgagaaaatcttaatgcatcaccttcatcctctcctatacacactaggctaatacgaatagttttcaatacaggagaaaaaagataattaactcttttcaggtaaactaacccatttcactaaaaagcaatctccctgtttatagctcatttataataatcctcagaaatggaaattcgtaattgatcaaccttgactaagcaaaaagattcccaatggcaataaactataacatctatttccccccagagaaaatgagaaagaaaacaacttttgaaatgtcattacttgaatgctttttaaaaactatgtgatattttaaatggaaaatgttaattatcttttaaagaccttcttctgaatgccatatccttcctattgttgctgttctttcattactggtcccataaatacactaagagtctttttgtaccatggctctggtaggttctggatatataaggatcaataagacagttcctattttcaaggactgttgatgctacgacagaggcagaatagcaggaacagcaataatgctcaccaagcgcctattatgtgatgtcaggttctgtgctagatacctgtaacatgcagttgttgaaaagtaggaatcttgaaattgagatatctgaagtaatagttactgtgctggggtgtggccatgggtatagccatgggctactgtcctaggctatggccatgggaagaggtagctagggtaaggtaaaggcaaagagaattggaagtggggacaaacagcccaggtgtcagatggatgctcaattcgctaagaatgatgttgccagtaatgataaagaaagaaaaagtgagccatgaatgttaaggaataactggaaggtgaggtaatggggagtagaatggcaaatgcttcagaggagctggcaattttgaggaagaggaaaaatggtgtaaatggatgaagaggagcaaaactgacactctctgactctctaggcctctagtcttaaaggacttactctcactggccagaactcagtcacatggccatgtctagaaagtcggaacatttcattctttagctgggcttactgccacctcgaataaaactgaagttcttttattaaagaagtgcccagcgaatatctggtagataaccagcagtttttccataaaaaaataaaaacaaaacctattatgatacctgaaattattttaacaggtataaatgataaacttgggatggcattaaagtgattaaagacactacctggtgagaaacagaggcgaacagagaccaagtttatcgatgcttttgtgtaaagttgcatacacaaaccgcaatcaagtcaaaacagaagacttgaagatgttctcataccatgaaggaagaccaatgaactcagactggtcaatgtactggaggcaacaaggacttccttagaggagtgagtacatccagtacctctttatatcgccatccatgtctcccgcagtgccctgcatattttatacagtgaataaatgtttgctaaagaaacaaatgtgtttacatatggaagtattttcaaccaggccttcaacaccaataactgttgacacttttagaagaaaatcaaagcagcccctgcagcctcagactcctccagctgtcacctatgggatccagcctccaggccaaccgcaggctccaggccagctcctgtagccccagacccctccagctgacacctatgggatccagcctccaggcccaccgcgggctccaggtcagttcctgtagccccagatccctccagctgacacctatgggatccagcctccaggccaaccgcgggctccaggtcagttcctgtagccccaaatccctccagctgacacctatgggatccagcctccaggccaaccgtgggctccaggccagctcctgtagccccagacccctccagctgacacctatgggatccagcctccaggccaaccgcaggctccgggccagttcctatagccccaaacccctccagctgacacctatgggatccagcctccaggcccaacgcaggctccaggccagctcctgtagccccaggattcagactgaaacccaaagactcagcctccgggcccagtccagccccatgtcagccgctacaactctaggttccaggctcactagaatgccaggtcagtcctcacagccctagactccaggccagcacccatggacccacgctccagcaaacccaggacccatgcccactctatagactcagagtccaggcctgcctcagtaaactcagcatccacagccttaggcaccaggctagcacctgtgaacccaggctccagaccaagccccgtggacccaggctcaccccagcaccaggccaatcccaggctctaggctggtccctgtgaccccagactctaatagacccaggatccaagctcattccagcagacccagggtccaagtccaccctggtcaaccctagtgccaggttgccccacagatccaggctctaggattgcccctgtggacccaagatccagacaggtccccacaggcccaagaaccaggtctctttctgcatactcaagctccaggctcaccccagcaccaggctaacccccatggactcaaactcaaggcccatccacatggacccaggcacccagacaatcctagtgccaggctggcccccacagactcaggctcaaggcccactccagggccaggctggccagacttcaggccagcccctacagacacatgctccaggctcgcacccatgagctcagtcaacagactcacccagtggacctcaccaccaggtttcccccatggacccggggtctagtccttcaaacccaagatccagacctgtcccagtgggcccaggctccagacccacccccatggacccaggtcccaggcctgcccacctattgacccaggcacaaggctagcctgcccaagaacttgaggtagccctccttccctcaggaggcggaaagaaggcaaattaccttacaggcatgaaagacaccaaaggaatcatcaacttggcctctgtttacacagcaggatctaccagctgggaatgcatttgaatgagtgttggggatgggtagatcagagatctcaatattcagtaaaaagaatctttctgagaacgttctcctcccaaaagggcagaaggccacaactactgaaacacaaagcctgacttcatttgagagactgactccaccccagaccaatgaatcagaatctacatcttaatcaaatgtctaggtgattcatattgcactaaaggtagaaaagcactggtctaatatacaacaacaacaacaaaaagccatatctgaaatggaattacagacaattattttggatatgaagcctctttggtttaaaaatgcattatcctttaaactgcaggcagcaagaggtaatacatcacatgaaataaaagctgttatgatgctttttggaagatgatcaaaatatcaagatggggtcaggcatggtggctcatgcctgtaatcccagcactttgggaggccgaggtgggttgatcacttgaggtcaagagttctaccaaagttaacaaataactcctttcagcaaaaccctgctcctttttcttaggccagaataaatgccaacatgtttgtttctcctgccatgttaaatatattacaagcttgctagctttcactctgttattgatatcttcaatacatgaagaggaagtgcaagataaacagaaacatttatagtcaagggaaacacaaaggcattaaataaaattaaaagatctggaatggtgagtctgattagtcagggagcagacacctggtgtcttagacaaaacaaccattaaaaaaaaggaggatggaaaatggaatgactcacttttactatatatgtatctcatatgaagtattttcttctgggtaaactagaaaataaaatgcaactattttggagcaatattataatatggaagctgagagataattatccttcagatatctttttctgtcaggctaaataatgtgtttcttcatctttccctaaaatcaggtctcataaaccttcagagtttccatttcatgtataggttgagactaaatttagaaaaatcaggtcccataatgttctaaacagagatggacacacacacaaaaagaaaatgtaaccattgaacaaaattagattatatttagaaacagaattttttttttttgagacagagtctcactctgtcgcccaagctagagtgcagtggtgccatctcggctcactgcaacctccgccacccggattcaagcaattctcctgcctcagcctcccaagaagctgggattacaggtgcccgccaccacgcccggctaattttttgtattcttagtagagacaaggtttcaccatgttggccaggctgttgtcaaactcctcacctcaagtgatctgcccgcctcggcctcccaaagtgctgagattacaggcgtgagccactgcacctggtctaaaaatagaaattttatgtgtgtatatatatcaataaaagtatcacaattactgtccttaaaaagcctaggtttggaagaaaaattataatgggaaacatactgtgacagctcagtaaaagacaactaaggtagttaactgattctcctatttactatctgtcaaaagacattatttgtagtagctgaattgagctgattttcttcatacctcagaaatatttcacccatgggacattacataatattctctaggacttacgcagtgataaatacctgaccaaatttataataaagaaatctttcattcatacatttaaaaaaaatgaaacaaatcaaaatcatgcaggataaagcttaggtattttctgcctaagaattttactgaataaaatcttacaagactaggtttttcctatgtgctcaaatattgaaaatttatcttttgtctccagcatgtctttcaaactgaatttaattggtaaattatttaaactatgtgcataacacaatacttacttgaaaattgatctgagtgaatcatgagcatgtaacatttgagacagagaactacatgcgaattttaagtactaggaataaattgaaatacttcggatatgcccatttcctaagtatacttaggatatacccatttcctaagtatttcaatttattcttaatacttaaaattcacatggcactacgggcttttaaagtattttataaatataaatattttaaaaatattaaaatgttataaatattaagccttactgcatttctgctcccacctcaaatctgtgtatactgcattaagtcatattcctaggagagaaaggacccaccttctgtaacttaaaattaacactagaaatgtttccagtaaaggaaataaaaagaattatctgagtgaaagaattcagtaaagaaccccgtataaatagtactgccctccaaactgtgcattatattgtctatgaacaagaaatgaaatggacatggaccatcaaaagcgggaactgtgtagagcggtgcttttcaaacaaatcacttttttaaaacaaacacaatcactaaaaatgcagattctaactcagtaggtctgaaagtggggcttttctgcacttgtaacaagcttccaggtgatgctgatgcctcctgtccacggaccatactttgagtaggaaggcagtagaacacatacacctttttttttttccgccactctttcgcccaggctggagtgcagtggcacgatctcggctcactgcaagctccacctcttgggttcacaccattctcctgcctcagcctcccaagtagctgggactacaggcacctgccaccacgcccagctaattttttgtatttttagtagagacagggtttcaccgtgctagccaggatggtctcgatctcctgacctcgtgatccatccgcctcaaccttccaaagtactgagattacaggcatgagccaccgcgtctggcctaaaatacatacatgttatctggaggtgcgaaagcccagtgccagaagaccaccagttaggtttatcggcttgctacagtaaaaggagaatgcgtactctaggaaactgggcatttctgcaaaggggagttaaaatgaacttgctatagagattgtgttttctactgggtgatatgggagaaggtaaagaaaacagaagtctgttgtgaattcagtgttgtcaggaaccaaagattactggtagactaaacattttaataatttttatccagggagcaggaggaacaaagaggcgctaaagttgataaaaaagcaattgtcagccaggtgcagtggctcatgcctgtaatcccagcacttttgggaggctgtggcaggaagattgcttgaggccagatgttccagaccatcctggccaatagtgagatttcacctctgttatcttttaattgttaaaaaaaaaaaaaaattgtcagtcactcatgttactgaggagaccatataagaactgagactgacccaagaacaacaaactatgttttacctcttggtctctatagacaatatgacaatgagagaaagggtgggagaaattgaccacttattacatagtttacccctcccgccgtgtatgatgtgaatcctgttatacattataagattgttatacaatcctatgttatacaatgttatactttctgatataaaaaaaaaaaacctttttgtgcacagaatatgaaaaagggactacacaataagcgagagtcttcgaggtataggccagtacattaatatcctttggggaactacctatgttatatgactctcatgaaaaacgcacaagaaaagcagatagagaatacagcaagcagactgctttgcacacggtaaagggcagtgctcagaaatactattaagaaataatattaccatttagaagcttcctttaaatgaaaataactgtggataaatatcccttctaaccaccgcatgaggcaacgtacttagcatatggtatacggtatgagctttagacatggactgagaatcttggcttcacacttaatatttataatatttagaggacaacttagttaacttttctagcttcagacttcttatctataacatggaggcaacactgttaactttgttttaaggagtaaataaaatatgcaaaacatttaatgtattaagtacctcacagttggccctcaacggcatttaaagtgaacatggtaccaaaccagattcaaaatgccagtttaacatttattcatcccacagatatttgttaccatgtgccagacattgtgtttagaaagaaatgtaatattttaaaagtacctggcttcctggagtttacagtctagcataaggacaattaatctgacaatagaaagcacaggatattaccagaacacagagcagagagacctgaagcaaagcagcagtgtgaggcagggaagtctcctcggaggaagaaaacctgaaggaaaagtaagagttctgaaggacttctagttacagctatgtggagaagtcagtaatttgttactatataaaacaactataaaatttggaaaaaattatattaaaaataacatttcagagcactgaaaatagaccaaagcagagaacaaatgaaaaagcattcattcttgaaaatcacctcgaggttgaagtcagtttctggggacctccttgtagaaagcattcattctggaaaatcacctcgaggttgaagtcagtttctggggacatccttgtagaaagcattcattcttgaaaatcacctcgaggttgaagtcagtttctaggggacctccttgtagaaaacattcattcttgaaaatcacctcgaggttgaagtcagtttctaggggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctggggacctccttgtagaaagcattcattcttgaaaatcacctcgaggttgaagtcagtttctagaggacctccttgcctcaggctgcttctaccctacactcagctgccgtggtgaaaactttgacaaacttggggctgtctgcaaaagccagtatctttgctaccagaaggggcagatctgctgcgggatggggggcaaaactccaggtctttatcagctaaagtagcaaatgtggtgggagacaaaaagggaaaaaccttacctttgttccctaacgctatagtccaagttggggcaagtggtaggaggatcccttgagcccaggagttcacggctacagtgagctatgatcatgccactgcactccagcctgggtgacagagcaagattctgtctccaaaaaaaaaaaaaaaaaaaaaaaaaaaagcaaactccataagaaggaatactggaaattgttgatatgtaggtaaatataaaagcctgtatattatatactgtatttttaatttctttacaaatcctaagattggcttaaggtaaaaaccattattcagtggataacatatatagatggacagtacatgacaaaaatagcacaatgcagaatggggagggatgaagctgtatgggaacaaagttaccatacttcactagattaagtaactataaaactttcagattatgctatgttcaagattcatcctgtaatccttaaagcaatgctatccaacagaaatatgagaaccataaatataagtcacatatataatttttaattttctagtaatattttaaaggtttttaaaacatgaaactttaacaacatattttatttaatccaacatatccaaagtattatgacaacatataatcaatacaaaaattatgaatattttacattccctattaagtcattgaaatctgatttgtatttcactttagcacacataaattcagactagccacatttcaagtgcacaacagccacatgtagctagtggctactgcagtgggcagtacagcactagagcaacaacaacaacaacaacagatgacttttaaaaaaatcaacagatgaattaaaacggtacactccaaaaatatttaacgcaaatgtaatagaagaacagaggaagacaaaaaagacatcaaacctatagaaaacaaaaatcaaaatggcagacataaatccaaccatatccaaaattacattaagcatgaatgtaccaaacattcacatcaaaaggaagagaccatcaggctggagttttaaaagcaagcttcagctgggtgcgatggctcatgtctataatttcaacactttgggaggtcaaagtgagaggatcactcgaggccaggagttcaagatcagcctgggcaactaagcgagactctatatctgaaaaaaaaaaaaaaaaggcacagtggcatgcacctatattcctagatacatgggaggcttaagtaggagaactgcttgagcccaggagataaaggctacggtgagctttgattccaccactgcactccagcctgagaaacaaagcgagaccttattgagagagagagagagaaagagagagagagaaagagagagaaaaagagagagagagagagagagaaggagagagggaaaaaggagagggggagagagggagagaaggagagaggaggggaaaggaaaagagaaccaaaaatgcaagactcgaccatattctgtctataggagatatatactagattcaaagatacaaacaagttcaaaagaaaacaaaccagtaatcataagaatgctgcagtgactatattaatatcaaacaaaatacactttaagacacacatattactagagacaaggaggaacatttgataatgaaaagtaacacatttcataatgaaaagctaaatatgtaaaaaggagagagggaagaattttctgagcattaaagatccagaagcaagagaggtgctttcctatttggtactcccgtctccagctgttcatatcacattcccaactcctatcagcacaacccatggcagcatcctataaatctcatcttaccccgaacattcaatgtcttcaaattcctatgcctttgaacatacccttgcactatccataacactgacctcaatatttgcatcagaaactcccactcatccctccagtttcagcttatcaccaaacccttctctgaatacttcaccgaagcttgcaaatacctacaataaagctctcattgctctccaactatcatttgaatttccctccagactttcatcctttttttttccagtttgcagcatcaggttctatcacaaaacatgacacataataggcattcggtaaatgcttgctaaatgaaggataaacgaacaaatgaacaattgaacacatgtaggaaggaccaaggttggtgaaaatgggagttgaagatttttttcacaactcatatcagaggaattaaaatagaatgaccaggaaacatgaaacgcatgaaagaattactttaggcaataataacaataataaccaacatgagaggagcactcactatgtgtcaggtactgtgctaagtatttcacatatatcaattatttcaatcctcataataactccattatgaaggactacttttgagggggtttttagacacaagatctcactgtcttgcccaggctggagtgcagtgtggctcactgcagtctcaatctcctgtgctcaagcgatcctcccaggttcacctcccgaatagctgggactacaagaacacaccaccacatccagctaattattaaattttttgtagagatgtggtctcactctgttgcccaggctggccttgaactccaggcctcaagtcatcctcccacctccaccttcaaaagtgctgggattataggtgtgagcccaccatgcctggccttgaaggtactagtttttagagatggttcaacagcaaaaaaaaaagaaaaagaaaaagaaaaaaaaaaaactcaattagaataaagaaacatttcactaaaagaagatacacaaatagtcaataagcatatagaaacatgttcaacatcatcaatcattatggaaatagaaatcaaaaccacaaagacaggcgacttcaaacacactagaaggctgtagtttaaaaaacagagaatacaggtgttgacaaaaatgagaagaaagatccctcatacttactggtgggaaagtaaaatggtttatcacttaggaaacaacctggtagtcccacaaatcgttaaatactgagtaattatacaatccatataatgagtacaagttttattttagaaagaaggaaaatgttctaaaataggtaatggctaaacaactctgagactatgttaaaaaaaatacacagaactatacaatttaaatgagtgaagtatatgagatgtgaattatatctcaatgaagttctttttttaaaaaactaacttaaaaaatgtttaagcttgaccattataatccagttactcagtgacagaaccagaggctgcctgatcccgtgttcaggattcctacatacatcacaaaatcactaagagaagcatcacaattagctcattttcaaaaaggacttcatctatttctctcaaccaaagcaatacattctaacataagcactttgtgtactgatgtaatatttctcaaaaagttaaacagcatgagaaatttataatattagataaaattacaggctaggcatagaattgcctagtggctcatacctataatcttggcactttgggaggccaaagtaggaggactgtttgaacccaggagtttgggaccagcctgagcaacatagcgtgacccccatctctaaaaaaaaaaaaaaaaaaaaaaaaaaatttaattagccaggcatgctggcaggcacctgttatcccagctacttgggaggctgaggtaggaggactgcttgaccctgggaagtgaggctgccgtgtgccaagatcgcgccactgcactccggcctgtgcaagagagcaagaccctgtctttataaaaaaatctaaaaacaattgtcttatttctaactctgaactactttctatgctttggtgacatctatggtgaaaattgaaaactagcattaacagctagaaagaagcaaaggatttttccacatgaattccatctttcttagctttgcttttatttcacagaaacagaaaataaagaaaacctaatcagttaaattactcctctctggtgtcacatcctaataaataactgttatccttatgtccttcaagaaagaaatgatactagtaggacaatcatgtatgttttctgattactcttatcaataagtacctaaaatattaggcaaactaactcatatatagcacagctatgtagtatgtataactgacaaaacccaagatctctaacacattggaatgtaagtattcatttcctttaagaatagaatccaaacagctgtttctcaccaatatacactgtgagagaactcctgtgtacctccttgccataacgaaaggaagtttaaccccacagtacacaaacctcactgcacacacaagatcctgatgtcagaacaccaatactgaggggcgtacaatgtaaacatacagcaggaacctatggcagaggccgaaccttaatcatttccaccaacctttggaattctgctttggatttcactggaacacaggcttttgacagagaaatcagaatattcgaaaacaagaaatcaccaatatcaggctcttaagtcctattgttgtaaagactgaacaatgaacatagcagcaatcaactcccaaacttagctatgctttattatatgagagcctcccgaactcagctatgctttatgatataagagaggctcccgaacctagctatgccttattatgtgagaggctcccaaacttagctaagctttatgatatttgagaggctcctgaattcagctatgctttatgagataagagagcctcccgaactcagctactctttattatatgagaggctcctgaactcagctatgctttcttatataagacagacccccaaacgtagctatgctttatgatatgagaggctcccgaacttagctacactttattatatgaaaggctcccgaactcagctatactttatgatatgaggctcccaaacttagctatgctttatgatataagagaggctcctgaactcagctacactttatgatataagagaggctcctgaacctagctatgctttatgatataagagaggcaattcggtcacttgttgggtagaacctcctgggacaagcagtcaacagcaagaaagcaattcctgctccctccattttaaaacagaaggctctatttttaccactatccccaagcaaccaaaccagaaccaaatagcatggatcttttggaacgaggaaagctctaaatgccaaagtccaagtgtagaaatatatcttaacattttgctccatccttcaaatgtttcaatgaaatgtttcaatgctgtctgaatagcaacctcaataccaacatctctcatgcagtccaagtggaaatgttccgtttcttctattttccttcagcctgagacaaattgattcttttcaaagagtcatttcaatcatcctcacgggttctcttaaaatagacaaggcaaaaccactggctgttacgtgcctctcacaagttccacctttttcacaagtggacaatgtgcactactactgcgagtggacccccacggtcagacagggaagaggaacccaccatggctggacagggaagacgaacacaccacagtcagacagggaagacgaacccaccacagtcagacagggaagacgaacccaccatggctggacagggaagacgaacacaccagtcagacagggaagacgaacccaccacagtcagacagggaagaggaacccaccatggtcagacagggaagaggaacccaccacggctggacagggaagacgaacccaccactgtcaggggagaggagcccgatcgctgcctctatgctctgccaccacctagtgaataagaacaagaaaatcacatggcaagagcctgcagacgtcaagacacctatgatagacacctaagatgatagggtggcttttaaaacctgattttaagattacaaggttagctaaatatctgaggtagtttaccaggaaaaagaaaaatgtttagaggaagaacttggtcaagagcctttatgagagtgagggtcactatatctcatcatgtaaggggccttaggaacacaccccaaattatcggacagtctagaaaaatactatttactttaggatggaagtatgagttgctcatatataaatgacagaaataaattagcttttgcaaattgggctttataggtatacgtacatcaatatcctactggtacatgtctccatttttcttgatcctatactgtttggaaattttagtgttagcttctcagctagctgattattcattatcaaagcttttttgttcccaacggctcacttactaattatatatcaaaccacaaagctctcgaagtttctgctccctccttagcatcctatctggaccatcagacagcttctggatcagaactggatatacatcatcaacgcacactggactaattcaggataactttcctaagaccaaagaacaaactattatgcaacatcggtttattttgatacttaagataaccagtgctttcatatactcaatgatatggtttggctctgtgtccacacccaaatttcaagctgaattataatccccagtgttgaaggagggcctggtggggcacgactgaatcatggggcacattcccccttgctgttcttgtgacagtacgttctcacgagacctggttgttctcctgccagccatggtgagatgtgcttgcttccgctttgtctttcactatgattgtatgtttcccaaggaagcagaagactgtatggcctacagaatcattagctgatgaaagctcttttctttataaattacccagtctcccatgtgtctttatagcagtgtgagaactaatacactcaacaagtacaaaaactacggcttaaccacagcaacaatatttatttaccaagcatggctgaagatactaaaggagtgtgtcactgtgatgtagaatttctagagattaggaatccttaggatgggtatgctcttcggaaaactgtaccatctctttgcctgttcatggaccactgtcagtctgttgcctgttagaaacctggctgcacgacaggaggtgagtagcgggcaagcaggcattaccacctgagctccacctcctgtcagatcagcggcagcattagattctcatagtagcataaaccctgctatgaactgtgtgtgcgagggatctaggctgcacactccttatgagaatctaataataaatgtaatgtgcttgaatcatcccaaagccatcccctgtcctccagtctgtggaaaaatgatcttccaagaaaccagtccctggtgccaaaaaggttgggactgctggtacatcatatattagctctgtgaccttcttaactatttcagatgataccttttgtgctctcggttgaaaaaccatctccgaagataggagctattttaacacagctatcctaaattccttacttatccatcatggaaaaaaacaaatgtttattattgccaggccctcaagaagtgaatggtctagtaggaaaaatatacctagacagatgtagtcacctgatgggttcttcttgcctgctgcacagatagagctgattcagagacaacagtataaatgacagcagtggagaaagaggttacaaacacagagccagccaagcaaaagaacaggagtttattactcaaatcagcctccccacaagctcggggaccagggcttttcaaggataattcagcaggcagggggacagggaatggggaatgctgactggtttgggatgaaatcataggggtgtagaaaacaggccttgtgtgttgagtcggcctctggggtgggggcacaagactggttgagtcataaaaaaaaaaaaagcaagaaaagaaaagaggagaggggaggggaggggagaaagaacaacaacaacaacaacaagactggttgagtcctgggtcgtgggtctgggtggaatccgtcaatcactagaatgctaaagtctgaaaaacatctcaaaagaccaatcttaggctctacaatagagacgtcatctgtaggagcaattggagaagttacaaatcttgtgatctccggaacaatggctggttatggtctaactatccctacatctcagcagaatttcaggctcttcccatcatcctaatctcatcggctttcattaattttacaaaggcagcttcagtccctgagcaagaagggagttaatttgagggagggactgttttcatccttgctccaaggttaaacgacacactcaattcttcccgtggttagtttggcccacgcccagaaatgggcaaggacagcccgcctgtgagcttagaaggcggagtcagccatgctggacttctctgtcataatcattgcaaagctggtttcatagatgagaatctataataaggtatggtaaaagctaccatagagagatgtacaacatgcagtggtgatgacctctacttgggaatagcttcacaaatgaaatacttagagtggttcttaaagggcaagggttaaaccaggctgacaaggaaaagcatgtacaatggtaaacagtacattcaggggactgtaaatagtatagagtgactgaagcacagagcacaaagagggagacactggggctcaggttagtcagatcagcaggagccaaaaggaggaggagactggaagagaaaaactgagaatgaggtatgcacaatggaggaagataaacaggtgagagcattcacagaacccaaagaaacagaattcaagaactagtgatgagtctgacaagagctatataaaatagacagtatcaaacaacatccaacacccagccctctttctactattaataaaaagactgattgcccagcgtaattagtcataccataaaggagtagatagttgtagattttctcttgagatttcaactgtacacaaatttttcatatattttatttttattttatcttatttatttgttttgagacagagtcttgctctgtctcccaggctgcagtgcagtggcatgatcctggctcactgcaacctccgcctcccaggttcaagcgattctcctgcctcagcctcacaagtagctgggactacaggcatgtgccaccacgcccagctagtttttttgtatttttagtagagacagggtttcaccatgttggccaggctggtcttgaactcatggcctcaaatgatccacctgcctcggcctcccaaagtgctgggattacaggtgtgagccaccttgcccagccccatattttatttttatttatttatttttgaggcacaacctcattctgtcacctgggctggagtgcagtggcatgatcactgctcactgcagactccacctcccaggttcaagcaattctcccgcctcagcctcccaagtagctgggactacagatgtgtgccaccatacctggctaatttttgtattttttttacttctttgtacttttgggtttttccacattgcccaagccggtctcgaactcctgggctcaactgatctgcccgggtcagctttccaatagtgctgggactacaggcgtgagctaccatgcccagcctctcatttttaatagatactattttaaaaagtactgtgaaaaagaaacaaaaatgaaaaagacacatgcctatccttaaggaacttatgtcctaccaaactataaagtaagccataccatttatggatttgtagcaacatgtcatcctgtcaactttattactgaggctatgagatgtattaacattggctttcaaattatttgtattagcaaacataaaattcaagcatagaaattgagtctgatctaaaaatcagcaaattacaattatgaatttgttatattctcactgtatccacgtcctcaaaactctgacattagcaagccattaaacaagaccactaagattacattaattttatactaaagttgtatgctaaaattttcatctttctctgtttcatctttctctgttttcccaaaagaaaaaaaaaggtaaagatcaaaagttatatatttcagatatataatcctaaaaaatgctccattgctaggtgactaattttaagacactgccatcagtttaacaggtcactcgttcatttattcatctaacatttatttacccacatactgtgataggcagtgaggaataagcacagaacagaaacagtgcctgccttcacaaagcttagtctagcaggatagtaacttaagacactgaaacagtatattaagtgccttttacaaatattcttcgcagctataccagctactacttgcatttcaacattttatttcaaagccattatttatttgtttgtttattttttttgaaatggtgtcttgttaggttgcccaggctggtctcaaactcctgggctcaagcagtcctcccgcccgagcctcccaagtaactgggattaccggcacatgccactgtgtctggatccaaaaccatttttttaaaattatttcagtgttaagacaactttaagaaacaatattatgattggtatcggtcattaattgtgctattttatgacttcaatcttttgatgcagtatagtttcctggccatttccaatagaaaattccttgcccctttcaggctactgtagttgagatacaagacttgagatatttttctaagagaaaacaaaacaaacaaagcagccaagagaaacaatatcagccatgtaataaaatacccaatgtactttatttcattatcctaggcaaataaaaaaaaaaccactatgaattatacagtatacaaatatgttttcttcggaaaacactgaaaaacagattcatgtggaaagaaattactttattcctaccactgtctttttcagacacactcaaaattcataaaattcacaaaatctgaagctcataaatcaaaagaaactgttcatacatcatgaacactatactaactttttaaaaagtattcgaggcagctgaacatcatcacagtatcttaagactcatatttccttagattaattcagtgatcactttcaaagcaaagctttttatgaaagctaaaataaaatttctaggtaaccaaggagagtctttcaaatggaaaaaagctgatgatattaaactctaaaaaataaggcccaggcatggtggctcacacctctaaatctcagcactttgggaggccaaggcaggagtatctcttgagcccatgagttcaagaccagcctgggcaacacagcaagaccccatctctatttaaacttttttttttttgagacacagtcttgctctgtggcccaggctggagtgcagtggtgcaatctcggctcactgcaaactctgcccctcagatttaagatatcctcctgcctcagcctaccaagtagctggattacaagcatgtgccaccacacctggctaatttttgtatttttagtagagatagggtttcaccatgttggcgaggctagtcttgaactcctgacctcaggtgatctgcccacctcagcctcccaaagtgctaggatacaggcatgagccaccatgcccagccttaaatttttaaaaataaaaaatagagtatgtaataatcatataaagttctaaaacatccagtagcaatgttcttaaatcccagtaattcaggtgcttttttttttttttgagccagtttcactcttgttgcccagactggagtgcaatggcacgatcttggctcaccacaacctccacctcccaggtccaagcgattcacctgcctcagcctcccgagtagctgggattacaggcatgtgccaccacgcccggctaattttgtatttttagtagagatggggtttctccatgttggtcaggctggtctcgaactcccgacctcaggtgatccgcccatcccagcctcccaaagtgctgggattacaggcgtgggccgccgtgcctggcctcaaatactattttaagattgttcatccataatacattgtagtctgaaagaagaataacctctctaaacagtacctattaccttcatcctctctttttccaatataatggcaaaagacagagttgtgatatttttactgtaatcacagaaacatcaattcaacatatataggattagcatatcacacatttcagcaaatatcaaaatacagatgtttcttcatcctgatgaacaaatttattattaaacttgccaactattttccaaatttataaaagaccataataaaatgtgaggcaaaactgttcaaaccagttaaaatgagtctcgatcagctaaaatgattaacaacgccatcttaaagatgatcccatatctgagcacgtgatacctctgtgatttcagggcacaaatccctctatccatcaaactaaatagaagggttagagaggttaatcgagacagagtgtctgtaacagacttctgcatttcattctccactcaatatacttcaaacatcattgaactatttgttatgttcttatgaatcaatgctcccttcacagtcaagatagaggctagaagccactgtgtgaagtaataaagcttacctttgcaaatcctcatcaagctgatctgatgattaagtctatgtgaggcttcctaaacaactgaagtgtaatcacaactttaattagaagctcaaatggcactgctaaacacctaaataaaacatgagcaagtacaatagccacctgcaacgagcaatgccattttccagcctccatttactataaagagatttttctctattcagctgcacaatcacttgggctacatgatctctggcctagcaatagcagtcaataatttaaaatcatgaaaataaattttcaatctatacttaagttctattatgcactggtggtagtcaaaaatgtcacagactgaataaaaatgaagctcactcatttgctaggctggcaccccattctacccgaactgtccattaagagtcaccattaaaaacaaacaaaactcatatggcaaacttctgataaaccaatttactctatttgtggctgattaagggtgatcctggactacatggcttttttagttcctccctgactaatggaaaattactagaagagtaaggactacacagaactagttgcataaattacagttggccaggtgcagtggttcagcctgttatcccagaaatttgggaggccttggtaggaggactgctttaggccaggagtttgagaccagcctgggcaacatagtaaggccctgtgtcttaaaaaaaaaaaaaatttaattagccagaaatgatggcacatgcctgtagccccaagtactcgggaagttgaggcaagaggattgcttgagcccaggagttaaatcagatggcattagtgatggttgcacataccaagaaaaatatatcccagtttccttctttactccctgttttaaacatatatcctatcttcctagttcatctcctctggtctctccttctatgagatatggataatttattccctatccttgctgccttctaacagtagtataagagaaggtataatcagtggtaagaacatttaactaggaaataacccagaggtccactgacagaaaaactgataaagtgtggtctatgctataccacagaatatcacaaagtggtgaaaattaataactaatgctatgtgcaataacacatacatgctgaaaatgtaatgctgagcatttttaaatttcataagactatattcagcaatgataccatttatagggctcaaaaaacaagaaatatatatccgtgttcaagcacacatacatttgtgacaagcatagaaaacatatacaaagcatgtgaaacgtctcagataccctgattcaaagtcaagggtctcatggaaatttattcaggtttggatgcacacctgacttggcatgtatgctgctctacataggacacacccaacacaaccaacctagtgttgctctaaggccgctaacctttaaaataaataaagccagccagcatatcacccttcattgacctatcttaaattcgaatcacaatgatagctgtaagtggaaattttttgcttttcgttataaaagctttacacataccctggtggccaccgctgctgaggtcagcagcaccacggcagctgtgaaaggttagcagttttgtttttgtgtgttgaggccttggctcaagatcccatctgtgctgacttcagactgaagggaacacatttcctccagcctgaaaactgaaacatatgccgcaataattagagcttccttgagtcagttcagctgaacccaggatgctgagactgataacctgtgagcacactagaagacttcacatacggcacccacctgctagacaaagacagacatgaagacatggccacgaggcctccatatccaaaaagacagaagtcccatcatctatatgtattatgtctatatctgcttgcagactcctgcttctgctaaaaagtacagtgaggagtttgcaagttaaagagacagaactaagtcaacaaaactgcagcatttagaaagcccctgcaagcacttgatctctgcgtcctctttacttgatctctgtgccctctttacgtgatctagacttgtgctctccaatactggccacatttggctagttaatgaaaattcaataaaattgaaaatcaacttcctcggtcacattagccacatttcaagtgatcaataaccacatgtgactactggctgattaccatattggacagagcaagtataaaacctttctttcattacagaaagtgctttgggcagtcctgacttagacactaatccacttttttactcttattatattgactcataataattgtaaacatttatgaggtacagcatgattctttttttagacgggatcttactttgtcactcaggctgaagtgcaatagtgcaatcacggctcactacaacctcaacctcccagactcaagtcatcctcccacctcagcctcccaagtagctgggactacaggtgtgcacgaccacacctggctaatttttatattttttgcagagatggggtttcaacatgttgcccaggctggtctcaaactcctggactcaagtgatctgctcatttcagcctcccaaagttctgggattacagggatgagccaccatgcctggccatacagtatgatatttttacacgtatacacaatgtgtaatgatcaaatcagagtaaagtagcatatccaccacctcaaacatttatcatttatttgtgttggtaacactcaaaatctgcctttctagctactggaaaatatacaatacgttgtggttaatagacactaatccacttttaaaacaaaaccaaaaccgccaccagcatgctgaacatcaaaatcccagagctagccagaaaatgtcaaggattagtcacccagcacaattaatctgagatggtccacaggcttccagggttgaggcttctcttaagtggtgtctttattttatttcattgtttactgtcgcacagcgattaaaagaatggactctgaggccaggtgcagtggttcacgtctgtaatcccagcactttgggaggccgaggcgggcggatcacgaggtcaggagatcgagaccatcctggctaatacgatgaaaccccgtctctactaaaaatacaaaaaaaattagccgggcgtggtggcgggcgcctgtagtcccagctacccgggaggctgaggcaggagaatggcgtgaacccaggaggcagagcttgcagtgagcccagatggcgccactgcactccagcctgggcgacagagcaagactctgtctcaaaaaaaaaaaaaaaagaaagaaagaaagaaaaaagaatggactctagaattagacggtttgagcctgaatcgctgcaacagtctgttaattattcaaactctctcattctcctgtaggttaaatcgctgcaacagtctgttaattattcaaactctctcattctcctgtaggttaaaatgggattttttttttttaaatagagacagcgttttgccatgttgcccaggagcttgaactcccaggctcaagcaatctgcctgcctcagcttcccaaagcgctgggactacaggtgtgagccaccgcgcccagccaaaatggggatactaatagtatctacctcatagatttgtttaaaaattaaatgacacaatgtttgtaaatctattagtaccatgcttggcatagagtaagagctctataattgttagctattaactattattatccttgccaaaaggaaggagaagaaaagcatgaggctgaatttttgaattttgcccattaaaaaatatcggagctctggtaaagatgcactatgagagaaaatcaacacatatgatctgtttcatcttcagccttgtagtttaataatttcctttctcacctttaaaaagcttgtccttgccttttcgctcttcttgtaagtctctcttcagtgcaccgtgtccatagtgctacgtgttaggcactattcaaagcacatgacatgtaccagcttaataaattctcacaacaatcctacaaggtagatactcaatgtgcctatttattttcaagtgaaaaaacggagacacttagaggttaggtaactagtgcaggatcacatagctagtaagtgacagtgtcactggctccaaaagcaggcagtatggatgaagaatctctgctccatcacagccatcgtgcaaaattgcttcgatatgcagcagtcctcccttcaaaacaaacaaacaacacctttcccaagctatcgacctggtaatattattatagtttatttaattagattggcaggacaggcaaggagaagtctcttgggatttggatatgacagcagctctcattgtcctgtcttctgactaaatcccctgggggatgtggatggaataaaactctgctattcagaagggttggcattgccccctgggaggtctggaaatttatgaggatagtttggttttcacaataattggggggtaccatcactctgaaggagacaaaggtgcttatatcccacattatctgtcacaatcacatacaattttcaaatgtccactttagacaatttaggtctagattgtaactgctgattatgtataaggagcaattctcatattgttctagtgtatttaatatagttctaagattgcaaccaccaggtaaaatgaaagaaactggtacttttgtcttcaaaaccttagcaggagttgttcatcatctgagactataaggtcatgctatttgaatcccaaagacaacacagctgtatcagtctccaattagagccgcacattcacagtaaggctgcgccatgaccgctctcctagtgccaaaacatttatataaaacaatgtcctaggcagctgaggctgctataacagaataccacacattgggtggcttatatgcaacaaaaatctatttttcggccagacatggtggctcgtgcccgtaatcccagcactttgggaagcagaggcgggtggatcacctgaggtcaggagttcaagaccagcctggccaacatggtgaaacctcgtctctactacaaatacaaaaattagccaggagtggtggcaagcgcctgtaatcccagctactcaggaggctgaggcaggaaaatcacttgaacctgggaggcagaggttgcagtgagccgagatcacgccactgcactccagcctgggcaacagcaagactccgtctcaaaataaataaataaataaataaataaattatatatatatattcactcttgaggaggctgggaaatccaaaaatcaaaacgtctgcatattcagcgtctgagagctcactgctcattcagtgtaaatgaagaaacctgagggcaggtttcttcatttacagatggtgttgctgtgtgtcctcacttggcagaaggggaagtcagctcccttgggcctcttttatgagggcgctaatcccattcatgaggactctgccttcctgagctaattacctccccgaagcaccacctcttaatattatcaccttaggggttaagatcacacagcatataaattttggaaggacacaaacactctgaccacaacaggtaatagacaccatttgataaataattttccatttatttcttctttatattttcattgggtcattatattgctattttgaaactgtctatataaatagttatatattatctaagactctcccttcaggatagcatttgtgtgtgtgtgcgtgcatgtgcatgtgtgtttcaaaatacatgtttataaaaaggggttttgtgcttaataggggtgatgtcctctgctcggcatctctgggaaagaactggtctacagaataagctgttgctgtttcctatcaatattttactatacaggaaaatcagagctacatgtccttaacaccagctttctggtgagggaattactgataagtaatgagaattactgataaacagagagaaaaatgaaatttatgagttctccatcaagttctggcctctccccatcctaatccctatctcagaagcaagtcttttttttttttttttttttttttgagatggagtctagctctctcacccaggctggaatgtagtggtgctatctcagttcactgcaaactctgcctcccaggttcatgcaattctcctgtctcagcctcctgagtagctggaattacaggtgcctgccaccacacctggctaatttttgtatttttagtagagacagggtttcaccatgttggccaggttggtctcaaactcctgacctcaaatgatctgcccgcttcggtctcccaaagtgttgggattacaggcgtgagccaccgcacccagccaagtctttaaagtataaaaccttaaggttcatatccttcacccactttttgatgggtttttttttcttgtaaatttgtttgagttcattgtagattctggatattagccctttgtcagatgagtaggttgcaaaaattttctcccattctgtaggttgcctgttcattctgatggtggtttcttttgctatgcagaagctctttagttcaattagatcccatttgtcaattttggcttttgttgccattgtttttggtgttttagacatgaagtcttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtgaggtttgtcaaagatgagatagttgtagatatgcagcattatttctgagggctctgttctgttccattggtctatctctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatagcttttttcatgatattgattcttcctacccatgagcatggaatgttcttccatttctttgtatcctcttttatttcattgagcagtggtttatagttctccttgaagaggtccttcacgtcccttgtaagttggattcctaggtattttattctctttgaagcaattgtgaatgggagttcactcatgatttggctctctgtttgtctgttattggtatatatgcttgtgatttttgcatgttgattttgtatcctgagactgctgaagttgcttatcagcttaaggagattttgggctgagatgatcgggttttctagatatacaatcatgtcatctgcaaacagggacaatttgacttcctcttttcctaattgaatgccctttattcccttctcctgcctgactgccctggccagaatttccaacactatattgaataggagtggtgagagagggcatccctctcttttgcccattttcaaaaggaatgcttccagtttttgtccattcagtatgatattggctgtgggtttgtcatagatagctcttattgttttgagatacgtcccatcaatacctaatttattgagagtttttagcatgaagtgttgctgaattttgtcaaaggccttttctgcatctattgagataatcatgtggtttttgtctttggttctgtttatatgctggactacatttattgattttcgtatgttgaaccagccttgcatcccagggatgaagcccacttgatcatggtagataagctttttgatgtattgctggattcagtttgccagtattttattgaggatttttgcatcgatgttcatcaaggatattgggtaaaattctctttttttgttgtgtctctgccaggctttggtatcacgatgatgatggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgagcaatttatccatttcttctagattttctagtttatctgcgtagaggtgtttatagtattctctgatggtagtttgtatttctgtgggatcggtggtgatatcccctttattttttattgcatctatttgattcttctctcttttcttctttattagtcttgctagcagtctatcaattttgttgatcttttcaaaaaaccagctcctggattcattgattttttgaagggttttttgtgtctccatttccttcagttctgctcttctcaaaagaagacatttatgcacccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaagtaggaacacttgtacactgttggtgggactgtaaactagttcaaccattgtggaagtcagtgtggcgattcctcagggatctagaactagaaataccatttgacccagccatcccattactgggtatatacccaaaggattataaatcatgctgctataaagacacacgcacacatatgtttattgtggcactattcacaatagcaaagacttggaacgaagccaaatgtccaacaatgatagactggattaagaaaatgtggcacatatacaccatggaatactatgcagccataaaaaaggatgagttcatgccctttgtagggacatggatgaagctggaaaccatcattctcagcaatctatcccaaggacaaaaaaccaaacaccgcatgttctcgctcataggtgggaattgaacaatgagaacgcatggacacaggaaggggaacatcacacaccagggactgttgtggggttgggggaggggggagggatagcattaggatatatacctaatgctaaatgacgagttaatgggtgcagcacactaacatggcacatgtatacatatgtaacaaacctgcacgttgtgcacacgtaccctaaaacttaaagtataataaaaaaaaaaaaaaaaaacttaaggtacagcagccactatcctgtctcttccccttgtcacctctccctggctgagccaacttgctttgcgttaactacctttctcacacatccccaagagcctacagaaaaggtctatgatcttggcttgttactaccaaatcatctcaaacctctcagcatctttacctactcagttaagtaaggaaactcacaattccttgagtagttcctgtagccctctcccagcctgaatggctcttcctggtgttgccgatgctaatcaatgactgaacacaggactgctgtctctctcatttctctgaactagctggcatatctttactttcttccctcttggcttctaatgaagacaaaactgcattgcctaattatcctttagaaagaaaaccttaacattctttaatacttgatctcttttcaatgccttctatttgtttctgtaattcagctaaaaatagttcagccattgaaaaaaatagattccaataaaacatattgaatgacaactatttaatgtgttaaaaagaatactacctgatttttttttttcagtaaactaaaaagcttcctgaatttgcagcattcttaaattgaagtaagaagtggagagacactttgggcagccgaggcaggcggatcatgaggtcaggagttcaagaccagcctggccaacattgtgaaactccatctctactaaaagtacaaaaaattagctgggtgtggtggccggtgcctgtaatcccagctacttgggaggctgatgcaggagaatggcttgaactcgggaggcggaggttgctgtgagccgagatcgcaccattgcactccagcctcagcaacaagagtgagactccgtctcaaaaaaaaaaaaaaaaagaagtgggaagaaagggagaagagattaatatagtagcagtttttaaatgttggtatgtaccagatcttcctaattacctgataaggaaggttacccataatttataggttgaagaaatcaaggcagagaggttaaacagtttgctcaaggtcatgtatagacacctccaccctcaccctcaaccagtgctaggattacaacccaatttgtctaattctattacatcatgctaccactctacagtaattataattagtgctaacttcataccaagaactgtgctaagtatctcatttagtctttataataaccctatgacgtaggtaccaaatttagcttcattttacaaatgagaaaattgggcacagaaagaaagtcaggttgcccaaagtcacacagtaaatagtccagcttatattcaaatccaggaacctgactccagaacctatgcccttaatcattaggcggcactctcggatagaattaaaatccaccaggcaaaaaatgagtaaatagctaatttttatcagtaaagattactgaggaaatcacaacagcgctattcccaacagaatgatttaacaatagctatgttcatgaggatgcatgatatagtttgaatatacgtccccaccaaatctcacgctgaattgtaatccccagggttggaggtggggcctgcagggaggtgtctgggtcatgggggaggatctctcgtggcccagtgctgtgctcatgataagatacgctcatttcaaagtgtatgatgccccacccccacacactagctcctgcttcctccatgtgacgggccagctccgctttgccttctaccatgattgtaagctcccagaggcctcatcagaaaccaagcagatgccaggtgccacacatgcttcctacacaggctgcagaagtgtgagccaaggaaacctcttatctttataaattgcccagcctcaggtacttctttatagcaacacaacagcagcctaatacaatgcactagcaaatcaaagtgggatttttgtttagtccacaagtgattaaaactccgaaaaaacaaaaccattaaccttacgaattaaatatcttcttttgatgggctaatgtaatattgaatatgaagtgattagaaagtaattccccaaaatttctgtctgtgggtggaaagaggggtggtatataacagcacaacacagaaatgtatccctacatgtgcctggttgaaaattcattttctctttggaatccaggctcctcctacccctagagcagtcagagagacatagctaccaaatgcaaaacagaatgcagtctttagagagagaccaccagggctgagatatcacccactgttatttacaaataaagccagcagtgagagatgggacagacatattagaggaaatcaaaagagtcatttttaaatgttaaagatttttcttggaaaatatgaaaggaaaaactaagaacattatcttggtaagttagcaaagccctgaagcaagcattggacatcccaaatcagccacatgggacacagaggagggtccacatagaaccaaagcctgtctcttctctacaaggttaaggtttgagtttcctagaggaagaaacaagagatttagaatgcatggtgtcatgtaaatcactctcactgtcattatttttaaggcttttacgtatatattttaactgcatactatatgtgtaaaatatatatattcatatacacataaatgcacacacacacacaaatacatatgtaaaaataaatgtacagctgattcaggtaaatcataccaggaaactgaagccagttttggtttttttgctggttttttttttttttttttgagatagagtcttgctctgtcgcccagaccagagtgcagtggcatgctatcggctcacagcaacctctgcctcctgagttcaagtgattctcctgcctcagcctctgagtagctggaattacaggcacacaccaccaggcccagctaatttttgtatttttagtagagacgacgtttcaccatgttggccaggccagtctcgaactcctgacctcaggtgatccacctgcctcggcctcccaaagtcctgggattacaggtgtgagccaccgcgcccggctggagccaggtttttgacatccacattgggtaaatcctggtgagcagaacagcacccatcacaaaatactgccttaatttaaagctattccagctaggtctgtttcatattactgtaatgaagataatagccaaaacatgataataaaactaacaaacccctggaattgttaacacagatacactgtcaacaatttttctacaaaaactgccatgtcagcttaagtgatcttttcttctctgaacagttacagcatttaccttctctaggcttaggacccagagatgcaaagggaaaggcaagtgttgtgggctcaccccccacttctaatataacagcaataataatagataaaatgtatatcgtacttaccacgtcccagactgtttttaaatgctttaactactccattatttttaatcctcacaacaatcccattattagtccatgtactaacaaggaaattgacccagagttgaggtaaatagtcccaggtcataaagctagttcatagaactagatctagaaccctggcctccagcactaaaaattacataaataaataaataatctttgctcacttatttttttaaagaccagtgaactatgctcagcccaggctagactcaaactattgggctcaagtgatcctcctgcctcagcctcccaagtagccaggactacaggcacacaccatcatgcccggctttcaccattttttcactcttttggttcagtttaagatttcatttagagaaaaaaggttttataccatttaaaataaaaacattgagcaccactagtctatatagtttatttatctattgccactcaaactctgatgtcatttttatggtgttctggttgcactgtttaattctgttagttaactttccgtatgttatgccttgaactgcatacatgtacgtagaaactcccacacgtaagtacactagactggaagttcttagagaacttatattctttgtattaggttggtgcaaaaggaactgtgggttttgccattaaaagtaattaatatctcctatgttgcatacagtacaatgcattcacaaataaattttttgagaaataaacttgatttaactgttcaaataaatttttatcctggggtaaatagttttagtttaaactatgctactggtaataataaacaatccttaagaacatcatatgagacagcagttctgcccaacccactcccaatttcttacccatgcggtgtcactaatcaatttataggttggaacaagaaaaaagttttacattacagaactaataaagcatactttccctgcagagggaccactactgtgacttaaaggttctaattaagtttttttctttgaagcttagtattcaaatctgcattcttacttgattagtattcaccaccattatttttatgcagatcacatgaaaaatgaaccctatgtgccagaataacttgcaagaaattactattcatcagcatgaatcaacaagcccacaattagaacagtgtccactgggaaaagtaaaaaaaaaaaaaaaaaacttttactaaggtcatataaaatgaaagtaaagggggaaaataaagaattcatttttgcattgaaaatcatacaaacgttttcagcagaaaattactatgactattattggggctcagaaaatgatatcctgaagtatggtgctttcatatgctgggcacttccgaattttaaaaaaacagaagaccttagaagctgcctcagaaccaaggactctgtaaccttctcctgtatctctccaactcccaaagcacagagaggggctctctctggaatttccttatcagactaaggaaactttttccttaagaaatacaattctcttaaacctcctccccagaaatctcattaaattaccaggaaagattaacctgagaagaaaagaatctataataagtcattgccaagaccagacagactgttcgtctgttcttcagagggcagctttgagacattacccgagagacttcaactgcataatacaacaacctctgttcaccctacagttcctccctcaacttcccataacttgtgggtcccattcagtttccaaagagaaccatttacaaactactgtctgctccttggatccattaaactctcctaaaatcactatcccccaaaattgcctatattcccccatctccctgactgctagaaagagagtgccatttaagctgtggctatctggcctttctgttacagcccaacaggttcttcttacctgctgcccagaaaagccaatacacggagaacagtaggggtgttgcagcagagaaagagtttaattactgcaaggcagctgagcagaaggaggggaggtatctctcaaatccacctc

SEQ ID NO: 2232 - DNA, 758004 bp, Homo sapiens
agatggcatcctcaaccaaatgttttgaatttattataatcgtgcttctctacaactaatgattcttgtggtttgcaaaccatgtctgcctttatttacctacacaaacacggaacagaatttccaataggagaggttcacacagctaacaaagcatagagtgtgtgacctcaataaggcattcaacaaagacacacgccgtatttccctctgactgcgttcccttaggatgctctgatgttggcgtcgcattcttctaaaagtagaatcaaatcttcaatcaggctgtgttctctgccatgtgtcactctcataatatcaaaagcctaaagagaaaggacggaagagagattagaccccaaaataggtgagctcaggccattccccacctttaccccatgatgccaggggcctggtgaaccccacaggtttacagggtgaacagtctttaacaggcttacagcactgtggttctcccagctggaaagtcacatgaaaagggtgatttctgaatgtggtatttggaaagcagactcactattcgagtcatgctggggcccagtgacaatcgatgatcttcaaagactgtcagtgcacaggtttggtgggtagtcacagggataagaagagttaccaaaatgattgagtcatatgaaagaccatgctgctaccaccttaaaatttttctttattgcacactccattcaattctcatctatatgcaccaggattattatatacatgtattctcacattttttttcatatcatattatagcactggcatttcaacagtcctctccttcactgctcatatttggtccattattaaatcttgtcaactcttatcttcaaaatatttctgaaatctgtgtgggcttatgagtacttcaataatagagtataatagaagtaaagcaactgacttgtgagactaggtcaaaaaggcctctgtgttgtttactggtcagtatgtttgctcccagaaccaagagactccatgctgcaaggaagcccaagccacatagagggaggccgtgtacaggcactctggctggcagtcttagccaagctcatctttcaagtcattctagacaaggcaccagacatgtacataaataaaccttcagacgattccagcacccagctgaagactgccagatctgtcttcccagatgaaacaccagacattgtagaaaagaagaaagccattcttatgctgtgtgccaattcctgacacacagcatttgtgcaataattttgccgttgtttactccattcagttttgggatggttatggaacaacaaacaaccagagtatccttgaaaatatttttgtaataaataagagataagcaatattatcctgccctgcccaaatgggggggtggggtggggtggggtggactggggagaagggagggacaccagaaccactgcatttgatgtaaatgtgcccaggagacttgtaaagatatgactctggtggctgttatgcacccaaagtacctggaagtggcactgaggctctcagccttagctacacagcaggatcaaccagggagcttcaaaagagacaccgagggccagaccctgcacatcaacagctgaagcctgctctccaggaatgaggcctaggccccaggagattccaacatgttctcaaggttgaaaacaactgatagagcaaactctcaacaaataacatcaactactcatgattcagtgttaatttatagccagaagaattaccattttaattgttgtatataatgaatgccatcatgcttataaaccattatttactaagctactcctggaaatttagatcacctccaattgtttattaggatatgatgcagaccttccagaatagattttttgcctttcttggatatttaagagcaattgctaggggtggaattcttgagcatgaacatcttgaaaaccacagagatttcagaccttggtggtcatgtggtgagacgcctgcattttgcaattctgcatgcaggaaaactttccattctacgttggaaaaacgctgaagcttcgagaaacaaagcatttcagggggatgggtaatttcaacctctgtttctggcttcttttttcacctcttgaatgttccctttaggctggaaggaaaacaggcagacagagggggtctagatttgctgctgagagagagagaaagagagagaaagagagagagagacagagagacagagagaaagagaaagagagagagagagaaagagagagagagaaagagagagagaaaaagagagagagagagaaagggccagcgcctcagaccctggcctctcagcctggaagacagctctgctctgagtccagttgtgaccccgcactggcagtctggcccctcaccctgtgacactccagctgcaaagcccagaaggtggctggagctgagatgctggcggtgggaattgacttcctattcatgcgagcaagtctgctctgtgggtgcacagcatctgccagcaaatccctaggcagggggctgtccggagtgcaggggaggagttgggaccagcccccaccttgcaagcagcccagctctatgagattcccctgggcagaagattaaaaacaaatgtttgatggcattcatggagcacatgcctcgtgttttattctcttttctccacactgccctggatcctccgctgctctggacatcttgaggtctgaggcagagacctgtgtgacagcacgattgcggaaagagaaggtttctcagatcagagagccttcatgggaaattttcttacttgaaagcactcttagatgttctcttcccttttactcaacaaagagccagagtgcttgtgatctggcaaaggaagatgaatggggcagaatcactgcctggaaagatctttgcagagagggacgtaaccctccgtcctgaaaaaggccagacctaacctgctcggcctcgcctccctccctgccctcacagaggccctcggctgggtgagggcctggccttgttgctcagaatttccagaccagcctcttttttgccctcctggttacattccccaggttccccatctgaagaatgatctgtgcttctctctgacttgactcagaggctaaatgacaaagccatcttcttgtcacttcaacaacataagttcactggcatgctttgaacatactacaggctccaggcttccttcctcgctcttttcttccagttccagtggtgagtttcactttctcctcttttgcagctttaagagtaaggtctactccccactgatccagtatattcctgttcatggaaggggcagacctgcccatcccacagtacggtaactacttccagttcttcagccattctggaattagagccacagccaggaagggggagtttcctggccttcctccagcttcacatccacacctcacagcctgcttccttgaggaaagaccagaaggatcatctagtccaataccctcatgttatggaaggaagtgcttcctgaggtcacctggcttgagagttagactaaggatgacctctcggctctcaggactcaacccagtgtgtccattccatgactgcattgtgcagcctccccgtatgaacagactgcagtgaccaaggagaggagcagaggctctcctggacatggctgcagagataccctgaggggacacaggtgccttccttgtcaagatgctgctggtcatgttctgtgttctcttacttgatgctgaatgcatcaccagtagcaaaggggaacaggggcaaccctcaggaatgtgtgtgtagagtctgagatactaagtttagaggatctcgtccatagggtggctagaaacagagaggaaatgggtatgggtaggggcagagaactaatctgaagcaactgaaaaaaaaaaaaaagaaactacatcatctgtctagaaagtaaaacgccatatagatttgattaattcacaagcaaacatacttttctctgaaagatgggcagatgtagatgagaaagggagagaaaaacgagaagaaagaagtaggattcagtaatgtgcaaaatatgttagtgactgtgtgtgcggatgtgtgcgtggatgaatggtgtgacacaggtcagcaggaagctgcaattcacacctggtgatgaggacatctggtccttgtcttgaacatcacctgggcctatgggtgagctggggcagacagtcctcaacaatgtacggagagggccctgtgtggccctgggcacagcccttcagcactgggtgagctggggcagacagtcctcaacgatgtacggagagggccctgtgtggccctgggcacagcccttcagtacagcaggaagatgaggagggcttcccctcacattaccatcccccaaaaaagttacaataaatttctgacaaacgagagcaattgtttcaagtagctctgtgtctcccttctcctaccactcccatctgtcacccatgcgcatgtcagagaggacaattctggtttaatttcctgcagtagcatataaaacagattaaggaaatataaaattggagcaggctggtgttgggaaaagcttatctctttccattaaattttattttttttaatggtagcatttaaaaagagcctgcacataatctttcacagagcactcatttgaagcctccaaggagggtgcctgctacacccacatccagactcgaaatgtcacatgagaaaagcagcatagcttgtctgccacattacaggcatacagttaactcagtaatagagaaagggtccccagaattgatttcaatctcatctgtttttttaagtaattttagaattgtggtcatatattaaataaaatgaatttaaatcaaatcataaagttggaaacaatatacctctcctattaattttaatatgaatatattaagcttatcaaggatctcaaacagtttctaccatgagcttgaggaatctagtaagtgacttcccaagtatgatttaaatatggatataaaatcagagggaaaagaaatgtatgcatgataagaacccctggaatcaaatcacgacgggaaaaaataaagcaggttttcttattctgcccaactcagaatgaaagaaaagcagagggtggggcacagggaggaggaagctggtctggggcattcaaaggaggaaatgcaagaagcaagaggtacaacacattaagcagctctggaggcacaaaaagccctttgcaaggacagcagagaatcccaaagactttgatgatccacctcagctcagcagcacccctggagaccccactccactctacatcttggataacttcaagtgtgtattccgctggaggaatatgtccttttgggaggcagaatttccttagagataacatctacccattcattcactcaatactgtctgagcagctttaatgaataaaacttggcccttgccctgggagaagctctggcatagtcagagggacagaatgtaaataccagatcattgcagtggaacagtgtgtgttcaacagagatgcaaagtgctggggcgcccagaggaaggaggaaccaggtggccccacggcaccctcaggaggggttacagatgtggtgagctcaggtctgtgctttccagtggtagtagccattccagaaaaagcatggctgttgtatcactgtttaatcaatcaatcagtacatattaattgaactctgagagactctgaagaagttatgtttcctcagctaaataatgagactggacaatataaattctaagggcaacccaagtcccaatgtgttgtacaatgtgccatgccagacacagctacaaggcgtggatttggttttgtttccaaatattgttactgatttctaatttaattccattgtggtcagataatttactttgtattaacttgaatctttttatgtttattgatatctgttttgtggcataaaatggtctcttttggtattatagttacttaaaaatgtgcattctgttattgctgggtgaagtgttttctaaatgtcaggtcccattggttgatggtgttatggaattattttgtatccctcctcagtttctgtctagttgttctaccaactgttgacagaggaggtctgatgttcccagctgtgcttgtctatttgctcatttctcctttcagttctatcagtttttgtttctcatgttttgcaactgtgttgtttggtgcatacatatttagtactactatgtctttttggtagactgacctttttttcattatacaatgtccctctctgtctctcataacattttctttgctctgaagtctactttacttaatattgatatagctactccagctttcttttgattgtgtttttataatgtatctttttccatcattttgctttcaacctatttgtatcattctatttaaaaagaattcttacagacaacatatgcttgagtcatttgttaaaaatctgttctactaatctctgtcttttaattggtatatttaggcaatttacatcttttacatagactactgacataatttacaatgttattattaatacatcagggcttaaatctgccatttaattttttgttttctgtttgctctctttttctttctttttcctgcctttctgtgggttaaacttttttttagaatttcattctctagtgcttttgagtgtattactttatatagttttgtggttgctccacgtcttattatttatatatattttatatatatatacacacacatatatatgtatatataacttgtatataatatacatgtgtatgcatattatatatgtatatatacagatatatatgtatataacttatcatactttactagtgtcatcattttacccattgaactcaagtgtagaaaccttccctttacattttaccctcccccactcccccatttgtaatacaattgccctaaatatttctactacatacatttagaatcatatcagatagtgttataatttttgcttcaactatcaaacaatctagaaaactcaaggggagaaggaaagatcattttacttacccacacttttgctgaccatattctttcttctttcctgatgttccaagagctttcttttatcattttctttctgtttagagaacttctttagccattcttttacagtaagtctgctagcgataagttcttttagttttccttcatctgaaaatgtcttgatttcttcttcattcctgaaggatattcttgctggacaacatacattctaagggcaacccaagctttgggttaacagttcttttctttcagtacttgaaaaaaatatgctactttcatctggcttctgtggtttctgatgagaaaatcactgtcattcaaattgtttttcctgtacaggtaagttgtcatttttctcttgctgcttttaggactttttttttttttgtctttagttttcagaagtttgagtatgatccacagtcttggtgtgaactgctttcggtttatactgttcggggtttgcttagcttcttaaatctacaggtttatgtcgcctgccaaatttgcaaagttttccactattaattctttttttaaaaacaatatggtaaagtacacaaaacactaatagttaccattttaactatttttaactcttgagtagcattaagtacattcacattgttgtgcaaccattactactatccatatagccataacttttgcatcatcttgtactgaaactgtgtacccattaaacaatagcttcccatcccctcctcccttcacactctggtaaccactgttctacttctgtctctaggtatttcactattctaggtacctcatataagtggaataatatgatatttgttcttctctgtcaggcttatttcactttgcataatgccttcaaggttcatttatgtgtagcatgtgtcacaattttattcctttttaaggctgaataatattcccttgtatgtatatatcccattctatgggttgctttttattttgttgatggtatcctttgatgcccaaaagtgtttaattttggtgaagtccaatttgtttatattttcttttgttgcctgtagctttggtgccatatccaagaaatcatcactatgcccaatgtcatgaggctttttccttaatgtgttcttctaagagtctagtagaagcttttgctcatatgtttaggtctttgatccattttgagttactttatatggtgttaagaaagggtctaactttattcttttgcatgtggatatgcagcttccccaacactatttgttgaagagactgtcatttttccattgagtggtcttggcatccatgttgaaaatcatttgatcatatatgcgagggtttatttctgggctctctattctattccattggtctatatgtccatctattccagtatcaccctgttttgactactgtagctttctcgtaaattttaaaatcaagaactgtgagttctccatatttcttcttctttttcaagactgcttttggctatttgggattccttgaggttccatatatatttcaagatgtatttttctacttcttccccaaaaaagccattgggattttgatagagattgcattgaatctgaagattattttgggtaatattgacatcttaataatactaagtcttcgaacctatgaacatgagatgtcattctccttatttatgccttcttcatggagaataacttattcagttattctcagataataacttacttggttttgtgttattgcaaatagcattattctcttaattttgtttttgaattgttcatttttagcgtttagaaatacaactgatttttgtgtgttgatctgtatcctgctaccttgcttaattcacttattagttctaacattttttggtgtgtgtgtgtaatcttcagagctttctccatatgagatcatgtcatctgtatatagagataattttatttcttcctttccaatttggatgcctccaccattatttcttcaagcactttttccacctcaccctctttttcttttctttctgggactccaatgttagatcttttgttactgattcataggtcccctgaggcactgttcaattttactttttcttcagtatttttttctgtttttcagcttgggcagtttcaattgtcttatcttcacattcaccaattcattcctctgtttcctccattctgttgtggagctcccttctgtttattttgattattatatttatcagttgttaaatttctatttgtgtcttctttacggcttctacttcttaactgagattttctattttttccatttattttgagggtgtttgtaattccttgatgaagcatttttatcatggctgctttaaaatctgtcagactattctaacatctctgttatcttggaattggcatctactgattgcttttattttcattaagattgagatattcctggttcttggcatagtgagtgatttttaactgaagcacaaacattttgagtattctgttatgagactctgaattttacctcaacctgctttagccggctttctctgacatcactccagcaagagaatgaagtgatgacaccctgttactgccaggcgggagtacaagttcaggttccctatctggctccttgttactactgaactcatacttcctggaaggtaaatttctgcttatttcccataatacgacttaatcactgtgtttgcattttatccattattttcttatcttttctcttttttggttcaaaaacacactcttggaactattattctctatttggaggtcagtaggaatcactcataaatattagagccaggggcttccaaacaactctttgaaggtattagtgacaattacgggacatccttccgcatgccctcttactccccctctttccctcccacctccccacacggtaacgtatgatgttaagtgtttagaggagggctttttaacctaggcaccatggatactaagtccatggaagggcttcagggagcctctgaagctgccatccccaccaaatatacaaaaggttgtgtatatttaacttttctctggttagtcagtggccctcatcagattcctaaatagggacacaaccaaagaggttaagaatcactgtagcggattaagacatgggaacaacagaactgcatgctctaaatcagccattgctggggctgaaaatcagggcagccgatgcaggaatacaaggagcaatctctaggacttgcggcctggtgctgtctgttgagatgcagaaaaagctaaaaagatgctcaatgggtaaaatactgcaataaaatcaaatgagaagggaaaaattgtaatacaaaaagtttaaatacagatttttttaaaaaaatggatgccgaggggaaagaagtctaacttttgcaaccagatttttgctgaaaagcaactacactagggccagggtgagggagcctgcagcatgcagggttcacaggaaaaaaaacaactctgattaacaagacagcccagatgggttgtccttgaggtccaagaagtcaaattagtagcaaacaaaagccttctaagaaataaatggaaagaaataaaagtagattagtgacaggagagggcaggagggaagcactgggaagggaccccaggactgtcctgtggcagcaatcacaagaatttcagctgagcccagtggaaatggaagactaaaccaaatcagagctgggctaagtggattcctttcctggaggaggctggagcctaactgaatctgtaataaatttctgtttctgaagctcctctgatttctattcaaactcagtcttcaaaaaccttattcaagtgatttcattccattatttccagggtttctaagacaagaaagagcatcccgagggtgcccgtctgaagatgacatcagtttcaaaaggcaaagagtatagcctcccttttccctctccaggttacccgagtcctgagaaagctcaggaaagaaagactttcttcaggaagaaactgacctgcttctagactcacaggtcacgtgagctttcctagggatggatacattcaggccatccctctgctagcaaatgctcagcaaaggtcatgagaagatctggtccattaactgtaaacagctaaccagcaggcccagggggaggcttttaaagacttctatccattaaaaaaatccattcattcaagcatgtatttaacagaacttgccgtattgggggcatgtgtgtctatgttaggtggcaccagaagacacaaaaggaatgtaaggtcccttgagggattcccactcaccttggggagcaaaacactgctggggagcagtcatagaacataattgttcaccagaggaaccaccgtgtaccccaaactacaaacacaagtactgaacagaccagctagtgggagagtgatcagaacaagagttcctgtaacaatacccatctttaatagtttcagaatgcttgagattggcaagcacactctcccgcattgcctcgcttactcctcaaaacaagtctatgggatagctatcagcttccttttacaaatgaaattatattcagagattaacgcaaatggtgggactggaacctgaacctactgactctaaatccttgcactctttctacaactctgccaggagtgcatgtttgctccttggttgatcatcagaccttggcaagagactcaatgacttttgtagagacacacagcaagtttgggtaaggccaccatttaaccccaggcctcatgacagataatctgatgctgctcccagaatacctttcatttggcatctatcagggtgtatgcctgagcttcaccttggtaccaagaataggaaaagctaacatgattacgaagagaagcttctgaaagaggcgatgcaacctcatcagaagggtgtgagggcagcagaacagacctgggcatgagggatgtaaagggcagtaagagggtcatctgaagggctggtgatggtcagtaccatcagcccaggccacattatcctgaaaatccatagcgagatgtctgtctgggtttgttcaggcttgtccttatagttgagggtattagatgtctccttcagaagttctgtatgcaatagcaatgactaaagcttcacataagaagcaatctaaatcttctctgatttctctcccatatttttccctgagttggcatcatgggttcggttagatcttaagggatttctgcacactgatcttactagagagcctcatctatttaactggaccagtctagaggaaaagagcagagccttggtttctggcctggatttaatgacttgtacatgtctatctcctccattaaattgtacacaccatattgagtctttttttttttttttttttgagacagtctcactctgtcgcccaggctggagtgcaatggtgcaatcttggctcactgtaacctctgccgcctgggttaaagcgattctctcacctcagcctcctgagcagctaggatttcaggcacccgttatcatgctcagctaatttttgtatttttgtagagacgggatttcaccatgttggccagactggtcttgaacccctgacctcaggtgatcctcctgcctcagcctcccaaagtgctgggattatagatgtgagccaccgcgcccagcctgagtcttattcaaagtagtagaagtatttgatcaccatgttgaattaaattgaacaaatacacctggctctgcctctgtgcgactttaggtgagctcttgcatgtctccaaacctgagcgccttcactttccaaataggaatgaaaatgcctgtcccattgacctcacacagctgtcacctgtcatggggactgagtatgatcacggatcacgtacgtacgagcagtattcatagtttctagtcccatataaacacaaaggtctagtctgatcacttacgaacatctacttgcaggtgaccctgtgttgggtgcatcgcacattaggaaatttcctgcacgttgtttttctgtcaggactttcacacagtaggcccttgataaggatttgctgtaccttgctgattcgactggctgacaagtacccccagaccagaaaaggaaagttctccctgaggctgcaacagacggtgcggtgttcttcccccgcctgggtaaacatgccagacatgataaaaagaacagaatagctgagtgccctcagggaatcctagtgttactcccgttggccacacgctgactttatttagagatcaagtaaaggcgctatggctagcattcggcgaaaatgagcactgtggaatctggcttttaagaatcccttcggcatttgtcatttctcttaggtccatgtgggcggctgccagtgttttgggatcagccggcccctggacacgccctgagcaaccctgacgcccgatccttccaccgtcactcttctgcacacaagggcatggcggcccagagggtcctgttaaagtgtcaagcgcttcctatgatacccgcacgccaggtctccatacaacccaccagtgcctggccaggtgagcatgtgagctctcctttggaagggtcacggactagaggagaggaagttctgctgaggtgggaaggcctgggccagacagcagagagccctgggctcctccgggcagaggagactccctgagcgggtgaaactaaccatcgtgttttaacaagctattccaaccctaaaccagttctcccaattagtttcttgacacttattgccagaaccgtattcactgacctccttcgcttcctccctcctccttccctcaataatgaatacttcctaagttccagatcccttgcatggcactgagctggttgccaagataaccacgaagccctcacactctcctgggggcaggggtaagggtggtcatcgggtatgcctactgcaatgtgaaaagggctctcctggcagggtgggcagagagctgtaggggtaggaccacaaagtaacactggaattgggccttaaaggatcagcagagtcctgccaagcccagggggttgtgatgcggagagcacttaaggcagaggaaaaaatagctgtgtgaagatggaggagtgagaagttcagggtcacagtgggtcctggtgaacagcagtgatcactgggtgggtggaaaggaagagaggaagggcggggagaagtggctgcaaaggtgaactgccacacagatggtcaagggcttgccacgcgagggacacggactgtgttccgtgggcaatggggaggaggcacaaacaaggtcaacttgctaaacgtggagagggcacaggagcagtggtgttctcagactggtttgtaccagtggcaagagtaattgttaatattatttttataagaaggttgattttacatttaaaatcagccatggtgggcatgcctgcatcacagaaataggcaaatgtcatgaagcaggttttttccagagtggttgttaaacatttaccagcacacactgggcatgcgtgtgtatgcgtgcacacatacatagagctgctaacaaatcacaaagaggcccagcaacagcagaaaaaaaggatgccaggcagaactatgtgagatcttggcacactcaccagtctcagattcttcattgcttggggaaacatgccttgatgtagctgcagtttgccaactttcatcacttgaacccctctgacgggatggcttcctgggaaaaaaatcctggaagaaaccaaacggcaaacagtgtcagcagccctcacctttgcagtcagcatttcatcaggagactacgaaagtggaagcagacactagctgtgaatgttaatgagctactgaaaggaaatcagctttgcaatccaggagaatgcagtactgaggggaattgacacaggactggtctccagctcctcagaatgtgttttgtgttagggaaaaaaaatgacaggactagaaggtctccctcataaacactagagaagagaaacaaaagtttggagctctgcgttgatatttgggaggggtggggcggggagaacaggtgctaatctcctcctccaagctcttccatgaagcatcagcatcagcactagcacagccctggaacagcagattgcctctcaatatatatttgttgaataaacaaagttttcatcatcccccaactagatcctaccacaccccccttttaaccgcaaagccctttgattgaatctcagctgtggagtccatcatggtacacctttcttatgagcacgtgtgtatttatttatcatctcactggattatagtgctttttattcaggcaccccatctgcgttctccatgatgtctgacatgcaggaggaactcaatccatactggaccctttcacatagaacagaatagaatacggtgttgtcgtggaccaaagaaagaggacgcacacgactccggctatgggctgtttcagaccctgtgaagagctgtattacttcaattcaacaagaatttaccatattggatttaaccaaatatgagcagtttggcctcttctggccccaataccccctacccctactcttagagaatactgagcccccgctgtatatgcagaattgtctctggtggaaatgcctacacacacacacacacacacacacacacacacaaaaccacagtttaaatgagcttttcaggacaggtgcgatggctcacacctgtaatcccagcactttggaggccgaggcaggcggattgcttgagcttaggagtttgagaccaccctgggtaacaaggcaaaaccctttctctattaaaaaaaaaaaaaaaatacaaaaatgagccaggtgtagtggagcatgcctgtagtcccagctacctaggacgctgaggtgggaggatcacttgagccctggaggctgaggctgcagtttcacaccactgcactccaccctgggtgacagagtgagaccctgtttcaaaaaaaaaaaaagttttttccttgaggctgaatcatcccattagacacaagataaacattcctgcaggagttaaaacaatgttacaggacggagcatgatttagcgcccaaataaggcataacttagtataccctagatgtccagttcaagtttgttgaattgaactgagaaaatgatacaagtattgtgaagacaaagaggtgactgatggttggttggactggggaaggcttcctggaggtgggaaattggacttacactggctcccaaggatttggagaggcttggctgggtaggagaagggaagcatatcccaaccgtcagagagaacgagcaagggcacactctaaatgctgcttctccagggacggaggtgcctgcccacagacatcactaagatgacctagaatccatcactcacgcagggcctgccatgtgccaggcgctgttccaactgcttttcatccatgaacccagagaaccccatctaagctctattatataacagtgatgaggcggatttaccaggagagacaggtatgttctctgaaaatgcacacatatctgcaaaccattccctctcgctgaatcttaactcttcctcccatgaaatgtgatatagaaacactttttttttcattcatgctcttaagaagtagaaagcagtacctgggaggaaagtatttaaaccgacagaaagttgggcatgcctcttttaaaaagctgaaaaggggctgggcgcggcggctcacacctgtaatcccagcactttgggagggcgaggtgggcagatcacaaggtcaggagtttgagaccagcttggtgaatatggtgaaaccccgcctctactaaaaatacaaaatttagctggacgtggtggcaggcgcctgtagtcccagctactcgggaggctgaggcagaaatgcttgaatccaggaggcagaggctgcagtgagccgagattgcagcactgcactccagcctgggcaacaagagcgagactctgtcttaaaaaaaaaaaaaaaaaaaaaaaggctgaaaagggagcggaagggggaacaacaaaggagacactgggtcctggatttttcttcatctcttcagtatgccaaggggtcaatcactttacctctcaccccttacgaaatgaacatcattatctatttgtgtagaaatgactttaagatccccagacaaaaggcataagggcaggacgccatcatcagagggtaactgccctggacactttccttgaaaagcacgcctggatttggggtgttatattattactacgaatgtagcatcattaaacttaaaggccaaaaagtgatcttacactaatcatcactccactaagtagatgtctgtcatgtcagttagcagaaggaaagacaatcttcagttctacgatggcagagaaagcggtgtgtcattacgccatgacaggtacctgccccggtagctcagatatttcaaaatgaagtagagcttacaaaggagagcatgaggaagcgcttgtccaggggcacttccaaataaatatttccagggcagcctcacagctctatggggctgctgattgcgggcctggttggtttctggaggcctcccagctgacatagagaataaaaatcatgattccttgctggagtataactccaaggaaagctggtcaagctcactcctgctgggagacattcttcaaaggtgtggccttccatccacttcatggtgtagagcagggatggggagagaagagggcctggaggtagtagtcttgacaggacaaaaagacggtcatcttttgataggattgtcaaaaataaagaccgggattaagagtccaaagtgaagcagcaatcaggtgtgtccaaggaccgtgaggactaaagcaggagtctgagtgagaaggtgaggggaagatgcacctacaagatactggattccgggtccggccccataagcaatctgcagaagtccaaagtgagtccctgcccttggttagcatgtagtttgcaggtgaggcaaatgaaatcatgatatagaaaggcatgtgacagccacctgaccagggcacagtcctggtcaatatggtgaaaccccgtcaatatgtgtgaaaccacacaatgtgtgctctgggagcagccgggaccacagtgatcaggggagtggcagagcctgagtgtgtttccactggagatgatgatgggatcctgggacaagggaagggatggatggttgctctggtgatgggataggaagctgaatgccaaagggcagtgagcatgctggtccggccagcagaggaggggagtgggaagggaggtgcactcaaggccaggctgtgcagaggcacacacacgtgcaaagctaggaactctggacttctcttgccagcagtgaggccaggctgtgcagacacacacgcgcaaagctaggaactctggacttaccttgccagcagtgaggcactaccaaagggggctgaagatattttatcacaatagaaaaccaagaaaattggaaaacagaccctagaggcaaaaatacttgaggtaggatagcagcaatatcaacagaaaagaaggacttggtacaagaaaggttatgcagctgatttaacagaatctggggatccaagggggtgcagtggagtctgagttgactccatgattcagaaatagaaacgcttccacaaaaacatacaagcaaactacataacaacaaaatcattcaacaaggcagtttacttgtttgggtgatataaattttcctttcacaggtataatgctagcaatcacatgttccagaatgcttggcctagattggaaaaaaatgtttttggtgtttctatggtgaataagtgcataagaagaaatgggtttaaacaagcagagaaaagaaggaaatgtacacaccagctttaactcagacccacaagcaccaagatcttactgatatattttacagggaggctgaaagtcagggaactgggatctgaagtcaaaaggacatggagaagaaatatctgatgccaggatctctatcagtctggctgaggttgctgatctctattggtcctacgtgacacaattaccaatcacattattccgttacagatggcagctttggcattcacagggtaggaaaaggcctttgttattcagggctactgctttggtttgaatgtgttccctccaaaattcagatgctgaaacttaatggccaatgtggtagtgtttggaggtccggcctttaagaggtgattaggtcatcaaggctcctccccttgtgaatgggattaaagcccttataacacaggtttcacgaagtgttcagcttgtttgccttccactgtgtaaggacacagtgttccttccctccagaggatgtagcaacaagacatcatgttggaaatggaaagcagccctcaccagacaacctgctggcaccttcatcttggatttcatgacttgaacttcccagcctccggaactgtgagaaaaaaaaaaattctgttcttggtgaattaccgtctatggtattttggtgtagcagcacaaactaagttaatacaattattttttaaaaactgatgcaaaacatattactgaacctgaaaggagaacttaacctgcctatttaaattgtatcttagagtaactaaatagctccagttgtatgaattttagctgataaatgtggaatgatgacagaattagaaaaatcattttgcaactcctggagaattattggactgaggggagaaaatatcacttgatgaaaccattagataaaaggatggtaaagaattttacagtgggtggattaacttgtcaccatctaaatccactgatcaatcttagcaccaccgaaggaggacaactagacactaagtgccatccgacgcagaaggaattatttttgaccacccctcaacgatccttgtgaaacaaaacagaaccccacacactgaagctgaatctaaccaaggctgcaaagtcaaatcccatttcatgcaaaaaacaagggacagagggacaagtagagcagtcagctgaatctggggtacgggaaattctacaaaagcccggacccgggatcttcaacaagtcaatcacatcgaaagaaaaagatggtagcgggagaagaatactgtagattaaaagagatgtaagagatgtaacagccaaatacgaggtgcagaccttgtgtatccttactcagccaagacaactgtaaaaacatatttctgggataatccaggaaatctgagcatgaaatggcattgcgcatggaagaaaaaatgtcctcatttttcagagatacaaaactgaggtacgtatgaattaaatgacctaatatctgagatttcacttaaatatagtcagtcctctgtatgcacaagacgttagttccaggatccccacaaataccaacatctgtggatgtttaagtctcttacagtcagcccatggtatcgctgggttataaatccccaggtccagcatctgcaggttccaacaactgcagatcaaaaacacagctggccctgcatatccacatgttctgcatccagttcaatccagcagagatcactcaacgcagaagccatgaatttagagggccaactgtatcttcagcagattttcagcttccagcaatggtggagtagcttatttcagaccaagcagcttatctgctgctgaaaacacgaaatgctgtaaacaggaaaacatagacaaaaaagtatttttaagaatctgtttgaaggtatcaaggagccactgaggcagcaagatcttgaaaagtcaagatcatggaaagagtggaaggtgaaccttgtattcattggtacttttccctttgatgatcttagagacagagaggctcaccagctgagcaatatttttggcagtctcatagaaaaggagacacagaaactggaattcagggatcaacaatgataacaaggagctccagtaaacattcctggctttcgactctgaccaccaaaggactacaatctatctaggtatagtaaattagaaataaagcagccattacaaagaatgaatcacttcaaatcctgattggattaaggtacgaactctttctatcctgattcccagaagcaaaagtaaacatgtctgaaggagataacatcatcctcagcctcaacttatctcaaattttctgtataatgttctgcatttggtaaaattataacccggcatacaaaaagacaagaactctctgaaaaccaagaagaacaatatagacagtgacataagacctacaggtactgaaatggtaaggttctcatacacagactttaaaatagctcataaatatgtttgagaacttaaataatatgtaagaattttagcagaaaaatcagaaattatgtaaaaaataaccagtggaaattttagaactgaaaaatagaaaactaaaattaagaacttaacagtctaacattagattagtcagagctgaggaaagaattagtgaactgcaaggtaggtcaaatgaacatatccatcaaagatacagagacaatgtaacagaaataaacaggagcagaggtctcatatgtgtcaactggaatctcaaatgagagaaaggagagaatggggcagaagctatatatatacacacacacacacatacacacatatacatacatacatatatatacccacatatatacatacatatatacacatacatatatatacatgtatatatacatacatacatacatacatatggctgtaatggcggaacattttcaaaactaaagacagcaagtcacagattaaaaaatgctaagaattgcacagaaactacaataattcagcaaagggaaaaagaagaaggatgagggataaggtaggcgtggcaaaatcttgataagaattactgaagctggatgatagacatatgaaagttcatattattctatttttgtgtacatttgaaaattttcataatcagggcactggattttactttttcacttttagaaatgatggacttcaggagatagcctcaagtttcaaaagatttggaattttactaaattttgagccttctgtagaaataaaatgatacattcaatgaacagtatataacagccttccaatgctgtttcaagacattagacagacatagacttgatagctagaataatagcagagggagcaacagcccacagtgaacattaaaaggcttcgctttaggtcttaaagcaaatgtagaaactcagtgtcatatgccaggagtaaacgggacaaagaggcatgaagaggcacatagagtcagtcttctgatgttccttaggctctgtttaatttaaagcagctgttttatggaagttatttatgcctttgtggtaggataactttattagtaatatgatatatttttgttgctgggagggaaaaaaaaggtcctaacatcaggaaacaaaaccaaaggggaaaaaaaaagatgggccccacagtcatgaaaccacctcagaacacggagaactacttcttaccatgaccttaattcacccaggctgctactctggagaggtgctgtttcccaagtgggtgatgaatcactgcttctccatcacctctactgctgtgctttgttggtgacagggagatcagggccgtgaattcttgtttccaaaagaaaaagaacttgggttccagcccagactgaaccctcagctcttgtttggtttctgatatgtactattggcctcatatcattaagatggatctgcactcccccatctctatgtgagtaacagaaagaaaattcgtggtgtcacacaggatttgacaacatcacagtgagattttatctaatgcaatgaaatttttcttgcatttcttttacttcataaactgagatacatttctacttctcttaaaaccttccaccaaataggtccttcactcaaaaggtggggtttaggccaggcgccatggctcacacccttaatcccagtgctttgggaggccaaggagagaagactgctccagggcaggagttcaagtgcagcctgggtaacatagtgagatgccatctctacaaaaggaaaaaaaaacaatttaactagtcagccatgcttggtgttgcacagctgtggtcccagctgcttgggaggctgaggtgggaggatcacttgagctcaggagtttgaggctgtagtgagctatgatggtgctactgtacttcagcctaagtgacagacaagactatctctacaaataaatacatattttttttagaagtagggttttcttactcttattagtttgacaattaagagttactttgcacatgatccattattagaatctttaatcagataagaataaaagagactttcaattatctgaaatgtccatgttattcagactcaggagcacagagggtaggaaagcagtagataaattagaatgaaggagatacaagatttgggctgaagacatggctcttccagttagttgaatgactatttcacaactaatgtgataagagattggagagcatctggaaatgtatacaactccatacgaacacaaactagtattattaagtttccagggctagtaaatgtatggtaattagtggaatgcactgttgcacccacatggagattacacactgggttgggggtggggagaatcactaaaaaaaaaaaaaaaaaaaagcatgatagcatcaaaatggtcattttccacagccaaaaacaaacaaacaaaaaaacagaaaaccacttgaactactgctacatttgcctgtttcttttaaaatacaaggggcttgggcagcaacacacaggaaagcctggagtagttgagatgattctgggtgagtgtcctcattaagggaaagacttatgttgcagataggactaagcatccaataatgaaccaaactggggttttggtctttccttctagaaaacacactgagaaactcttgcctatatttgtaacttttatattaagtgtgttcaattattttcacttcacactggacttaaaaatttcctcactctcatgcccgcgagcagcctggctggcagcagggaaacctcaggggctgtgtggatggccctcagtgtggcgcaggggtgaggactggccagcatcttccaggcaggcaggacagtcctccacttcatgtaaacagtttcctcttgaagactcctaacagtgataatgctgtccttttgcctgtctcatatatgacagcactatttttttagagtgtgaaacatttgatgacatcttgaaggatttcaaaaaggctggctagcacaactgaagtataaaataaccataatttagtttaatacatccttgagaaaaaatggtaatgagatattccctacaaaaactgcatttattctgtatagtctatccttgtgtgggataaagttctgaatgtacacactcaagccctccaaagatggtcatatcattcagatcattcctcaagaaacttaacagcagaaagtttaaaattttcagaaaattttaaatttatttgaacgttttagttcaagtttataaaagttggtttatattctactcctagaaatgcagcaggcatggtagctataccgattcaatgggagcatactgaaaacaatgtagaacgctcgatgaaatattctaaaaagcagtaagatgctggcaagataggaaggcattgtcaggccagaatgtgagtgaagaaggactcctgacaaataagcagaatagctgaactgctggtctgctggagtctctgtcctcctctgctctgtgggacttgggggacaaaagagcaagcccactgtctccccagcaggatggggtctagtaggaaatccttcctttcgttcaacttatttggaatggtaagtaagacatgattgccggtaacagaaggaaacagattacatgcaagagtcccagagagctgacaagcagttgcagagtggaagctgaaagaaagccagtggaatgacatcttccatgttctgaggaaaacaaactcctcctctagaattctacatcccaaaagacatctttcaagaataagattgaagagctgaagggtgcagggcttctgatgatgatgaaaatcttctgaaattgactgtagtcatggttgcacatatattaaaatatattgaaaaccactgaagtatacactttaaatggataaatccctctccctctccccacagtctccctctccctctctttccaccgtctccctctccctttcccacggtctccctctccctctccacggtctccctctccctctctttccacggtctccctctgatgctgagccgaagctggactgtactgctgccatctcggctcactgcaacctccctgcctgattctcctgcctcagcctgccgagtgcctgcgattgcaggggtgcaccgccacgcctgacgggttttcgtatttttttggtggagacggggtttcactgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctggctacaacctccacctcccagccgcctgccttggcctcccaaagagccgagattgcagcctctgccccgccgccccgtctgggaggtgaggagcatctccgcccggcagccgccccctccaagaggtgggggacacccccacccggccagccgccctgtccgggaggtgtacgcagcaggtcattgagaacgggccatgatgacgatggcggttttgtcgagtggaaggggggaagtgtggggaaaggaaagagaaatcagattgttgctgtgtctgtgtagaaagtagacatgggagactccagtttgttctgtactaagaaaaattcttctgccttgggatcctgttgatctgtgaccttacccccaaccctgtgctctctgaaacatgtgctgtgtcaactcagggttaaatggattaagggcggtgcaagatgtgctttgttaaacagatgcttgaaggcagcaggctcgttaagagtcatcaccactccctaatctcaagtacccagggacacaaacactgcggaaggccgcagggtcctctgcctaggaaaaccagagacctttgttcacctgtttatctgccgaccttccctccactattgtcctatgaccctgccaaatccccctctccgagaaacacccaagaatgatcaataaatactaaaaaaaaaaaaaaataaaaaaaataaatggataaattgtaagctgtataaactgtctctcaataaatctcttaaaaaggataaagatgaaataaaaatatctttagacaaagaaaaattgaaaatttgtcaccagatcttcacaaaaggaatttctaacattttagttgaaaggaaaatcatcccagatggatggtctaagatacaagaaaaaatggacaaagagaatgcttaatatgggcaaatctatgaatactgacaaaataatttttgtgggttaaaatatggtaaaaattaaaatacacaacaattatagcatatgtatcagtaggagaaacagtagtattcaagcgttttaaagcctctctacatccacgaagaccgtaagaaagtaacatactttctttacaattctttaaacagttcatctgtgacttatatatccttcacaatatgtgatttatttaataattttaaaagtcttaattaagactttttaatgttctgtttaatgtaactgatttaatgttctgttttaatttctgagtacaaagccagtttgcggagagcagtcaggttaataggtaatctagggatttaacgatctcaaagattgagtgttacatcagtaagaaaggagcattgtcgttaaaaaaaacccataccttttccttgtttggaaagaaaagaggagagtcataaaaattaaatatgaataaaaagctgcacaatttactttaaaatagaagatgaaatatagtttggcatcaatgagcttaccaagccgtatgtatctgtatctacaatgttgtttaacaaccctatactcatgtgatgttgttgacatagatttcagtagtgttactggtactttattgaaatcaatcactacagatgccaagtactcagagcccacagaccttgaagaagtcataggatgggtttccatagcacaggtgttggaaggtgccgtattgtggtgctgggaagcagagatgttctcttctttgaagattttcaaagaaaaaatatagcctgttgtagcagagcagctagcactgcttagatgcagaatcatgagaaagtgaggcgatagcagaggctggtaaactccacctcacaagccaaatcccatgagcaacatgcttttgtaaataaggtttcgttgggacacagccgtgtctattcatttacatattgtccacagctgctttcaagctacaagagcagaattaagtaggaggatgtatggcttgcaaagctgaaaatatttactacctggctcttcacagaacagttgctgacacttgctctacgacaaaggagttactaaaaataagaggccaggaagaggatcccttaaaaaaatgatcgtaatggacaaccatgaataggtctgggaggtggggctgcctagttgtctgcatcactagtaagaataatggtaattacagtaacagcagttcatacagttagtgcctttgcctcatgtcaggcactgtcctaaggactttgagttgaatttattctaaaaaaaaaatcttattcaagcagactctggtaatgatggtgtaaagtaattagtagttcttgtccatagaaaatgagtacaaaactagtcaaaattgccaaaggcaaccactttagggcatcagaaattgatctaaggtagacaaaaaattgagaagtgtttatttttttaaaaataactatattttaaggtaagaaaatcaggattctatggtcttcttgcctgaggctattcccatctaccattcacccccaagtcagccttagaaggaatgagaccaactctccgtatcacctggataactgggaaattgcatgtacacaagggagacccaaaagaacctcatcaaaagtaaaaatcagaggagatttgaggaccttaaatgtatcttctcacacacaagtgaccagcagagtggaagccttataggctcaaggtatttcctagaggtccccctgtgtcttctgcatagcttaatggtctgcccacatcacaaaaaagaagaaaaagaataagacactaagcaaagacaatactgatgagctccactgcgtactccacactctgcagctgaagtccaagcaagttacaaaacaatacaccacaaaatgctcaccaactactctcagaacaaaacagaatgcagttataacacattatttaaaatgttcagttcccaaaccaaaaccaccagatatactgtctctacaccctgcccccaccccccaaagaaataaagacagagggcaggaaaatgatacaaagtgtcaaaagaaacaaactattaaccgagatacctatatccggagaaactaccatttaaaaatgaaggtgaatatagtaaagatgatgagtctctttaaattgacttagtgaaactgtaataaaaatccaagcttgatatttgtagatatagacaaactgtttccaaaatttatatggaaacacaaaggaattacaagagtctaagcaattctaaaaaataataaaattggagggctcacacaatccaattttcagatttactagaaagccacagtaatcaagacagtgtggcactggcaaagagatagacacaaaatgaatggagcacaatagaaattcaagaaattgattcacacaaatgtagccaattattttttttttcccaaaggcataagaacaattcaatggagtaaggatggcatttttaaccatcttcaacaacacctgttatctaccttttctattatatccatcccagtgggtgtgaagtgctatctcactgtggttttgatttgcatttccctaatggttaataatgttgaacatcttttcatgtgtttatcagccatttgtatatcttctttggaaaatgtatagtctagtctaggaagaaaaacgaacttcaacctgaacttcataacttatatatcaaggtcaatgatgaggccatgaactcaaatagatcattgacctaaatacaaactcgtaaaaattttagaagacgtaggggaaaatcttcatgaccctgagttaggcaagagttcttaaatatgacaccaaaaatatgattcataaaagaaaaaaatggaaaaatttcatcaaaattaaaaacatctactctgtaaaagatacatttaaaaaatggaggcctggcgtggtggctcacacctgtaatcccagcactttgggaggccgaggcgggtcgatcacttgaggccaggagttcgagaccagcctggccaacatggtgaaatcctgtctctactaaaaatacaaatattagctgggtgtggtggcatgcgcttgtagtcccagctaattgagaggatgaagcacaagaatcacttgaacccagaaggaggagggtgcaatgagccaagattgggccactgcactccagcttgggtgacagagtgagacactgtcccaaggggaaaaaaaaaaaaaaaagaaaaagaaaaagaaaatggaaagacagcttacagagtgaaattatttgcaaaatatacatcagattgaaggcttgtatccaaaatatatcaagaactcaataaaacaaagccaaaaagaaaaggaaaagaaaaaatggtcaagagacttgaatagacatttctacagagacaatatatgaatgccaaatatgtacaggaaaaaatgatcaacataattaggtaccaggaaaatgttttccaatgagcaccaccacgtaccctttaccacaggtcaacaggctagttctccatcctccctctaaaccaaatatatatgacttctcccagattgtggaagtatatatgcatttcctatgcttaattagataatcaaatccctacttagagctcaaattactcaaattactcaaattacaagttcctttagtcttgttcctagaggtgcctctgcagctatgaatcttgttttatacttatcaacttatcaacttgtaagattttgacagtttttggctaaaatcaaacaaactatcaatactattcttttgtgtttgtgaagatgtggaagaactggaaccctcatatattgttaataggaatataaaatggtaaagcactttggaaaacattttggcaattacctaaaaagttaaacagaagactcgagtgagatggtcaaaagatctgactagatatttttccaaagaagatacacaaatggctcataaacacctgaaacgatgctcaacatgattagccatcagggaaacgtgactcgaagccagtgtagtaccacctcacacccactaggatggggataaccaaaaagacagataataacaagtgttggtgagcatgtggagaaatgagaaccctcataccctgctggtgggagtgtaaaatagtacagccactttggaaaatgatctgtcagttcctcaaaacattaaacgacagagttatcatatgacctagcaattctacctctaggtgtgttcccatgaaaaatgaaaacacaagtccatgcaaaaacatgtatacgaatgtttatagcagtgctattcataatggcccagaaatggaaacaatccaaatgcctatcattttataaataaacaaagttgatatctccgtatggtggaatattattcagccatgaaaaggaatgaagtgtttatacatgctacaacatggatgaactttaaaaacattatgctaagtaaaagaagccagacacacaaggccacaaattatatgattccatttatgtgaaatggtatatgacaaatcccgaataggcaaatccacagagacacaaactagattagtagtttccatgggatgtggccaaagggggttggagatgactgctaacaagcatgaggctttttttttgcatgaggcaatgttctggaattaaattatggtgatggttgtacaaccttgtaaatatgctaaaaaacccactgaaatgtacacttttaaagtggattttatggtatgcaagcgctatctcaatttttttaaagattaaacattatgcccctgaattccattattaggaatcaatctacttatgagaaataaaaatatatgtccatacaaggtcttatatgtgaatgtttacagcagcattactcatcatagccaaaaaagtggaaataacccaaataatcaactgggagtagataaatatgatgtactatatccatacaatgtaaactactcagcaataaaaagtaacaaagtactaatacatgttacaacatgaatgaaccttagtaacatgctgagtgaaagaaagcagtaaagtaaggctacatatatgattccattgataggaaatttgtagaaaaagctgaactatggagacagtaagcagaaatgtggttacctggagctgggtatgggtatgaactgactgcaaacaggcctcaggaaaactttggagatactagaaatattctaaaaatggattgtgagaatttttgcacaaccataaaaacttctaaaactcagaactgtacaacttataatggttgaattttatgatatgtaaattatgcttcaataaagctgttaaaaattaaacaaccttatgagacagatactattattgttgccattttagcaatcaggaaactgaagcatagacagattaagtaacttgctagaaaatggcagagctattatttgattccaggcaaaatgattacggaattcttaaccactaaatcaaatccagtgtaatttgctaactataaagtatagtactgggaaaattgagaaaaatgccaccttcttccaagagtcaaagaatgatcacacattgagggcactatttatatacctaactctctgcaagtaaccccatttccatcctctcttattagcacaccaatttgcaaggtagttgctattacattaaaaatatacaatttaaaacagttcagcacatgtgtcttataatggtctcctccaaattccatagcgaccattaaagaaaatatgtctgggccaggtgcgctggctcacacctgtaatcccagcactttgggaggccgagcactggggtcaggaggtggagacaatcctggctaatacggtgaaaccccgtctccactaaaagtccaaatttagctgagcgtggtggcatgcatctgtaatcccagctacttgggaagctgaagcaggagaatcacttgaacctgggaggcagaagttatagcgagacaagattgtgccactgcactctggcctggatgacagagtgagactatgtctcaaaaaaaaaatattaactaatcaaaattttttttaaaaaagaaactatgtctgatacctacgcattcagagctttctttgctcaggcaccctctcctctcacagtctctgaaggccaggcaaaaaggctagttctttaccctccctctaaaccaaatatgtatcactccttctacattgtggaagggtatatgcatttcctatgcttaattagagaatcaaatccctacttagaggtcaaattactgtagttcctttaatcttgtctccagaggagcccctgcagccatgaataatcttattccattcatacttatcaacttgtaagattttgacagtttttggtaaagcacaaacacatagccataagtactgctcaagcagtatttttcaaagggaggaagaaagggaaaaagatgagggaagagtaaacgttcatgaaaagaaagatttctcccctttgggaatctgtttattttgccattgtcaaagtgaggcaggaattcaaacacctgacggcatggaagtggcaaaaccatgtgggtttgacttgatggtcctgagaagctgctggcaatgctttttaaattctgcaaatataattaatggcttgtttgctattttggcaacttaaagcaggggctatgactgcctgtgacaaaatcagtaattgaatgattaaactagatactcacagtcaaaacggcatctaacaatttacctctaatacaacattcccaattaatttttaaatacctattaagatataaaaagatttaaatataaaaaaattaaattcaacttaaaacactttaaaactagggccaatgcctgagtctagaaagagactacctaatgccagagtctaggagttcttctgagccacaattttgctgagggcaatgcatagtgaaacgctatgagggtaagactgcctggctgaaaagagtgacaaggacccttcacactgtcagaatcatggatcagaaatcaagtctgcaccaagcaagaatctgcacaactgtctgtgcaccatgtggggctggcttctacagcagacatacgcagtcattttggtccctctctcctcagccaatatgtttattccatatacagactttaacttctgggaaaatgcagggtagagagtggagagaagtggcaggaatggtgtcacattgaatacgggcataagcaggtatcatacataacgtgataagagaaggctgagatatgaggagccttcacagaagtacattctacagtattcagttttcaaggtactttgtttcatgtaccagaaaagcaagctaagagaagatgccatttcagtcaaccagttcccaatagataaaaatacactggattgtgagaaccagctgtagactgagcatatccatctgttgtccagttacagatctgatgagggaatccaaagagcactaagccaagggcaacttgtgtaccatttccaccagcaaacattaatgctgaatgctttcacactaaaatgggagaaaaagcaaggatggctgtcatccatactcatattgaacataatagtggaagtactagccagtgtaataaggcaaaaaaaaaataacaggatatagaatagaaaggaaaaaataagctgcccctatttacaggtaacatgattgcctatgtagaaaatcccaaggaattttcaaaaacatttctagatctaataagtgaattaagtaaagcagcaggacaaactcaacccacgtaaattaattatatatctacagactagcaagacatacatgaaaaccaaaataaaaaacacagtaacacaaaattacttaggtatgaatgtaaaattgaatacttagatacacacctaaaaataccatgtacagtatctgtatgctaaaacatacgaaacacagatgaaagatctaaataaataaagagccacactgtgttcatgcattggaagactcaacacagtgaagttgtcaattctctccaaattgatatataggccaaacaatttctatcaaaaccccaggaagagtttttgtagctatagacaagagtattgtaaaattagcatgcaaaggcaaaggaactagagcagctagcacaattttggaaaaggagcaaaactagaggattgatgtgatctgatttcaaatgtttctagagaagtacactactgaagaccagaagtagcaagcactagttctcatgctaattctgcgatgttcacttaccacactgctgccctgtttccagttttccactgtactttggaaaagctagtttggaagtgttgcaggagaggtatctaagcatctatgtatggcaaatggttgttctagtcatctactgctgtgtaagaaaccaccccaaaatgtagtggtataaaataataaccattttcttatggtcacatattctgtgggtcagaaattcacgaaggatacagcagggatatctcccctctgttctattatatctgggcctcagctaggatgacttaaatggccaagggtgtctcaaaacagctgcagctcaaagatctatttccaagatggcttcttcattttcacctctggcacctgagctcaagtgaccaaaaaatgaactcaagcagggactatcaacaagagtacttaagtggcctctccttttaggttctcaaaacatggcagcttggttctaagagggaatgtcacaagaatgacctttctggaaagccaagtgttgccaaggaccaaggcagaagctgcaggggttcatccaccctagccttggaagtcgcattgattcacttctgctgcattctagcagttacaagagcttcatttagggaaaaccagattcaaggggagggaatttagactgaatttttttttttttttttttttttgagatggagtcttactcttgttgcccaggctggagtgtagtggcacaattttggctcactgcaacctccgcctcccgggttcaagggatcctctggcctcagtctcctgagtagctgggattacaggcatgtaccatcgtgcccagctaattgttttgggttttagtaaagatggggtttcactatgttggccaggctgacctcaaggttggatcgggtggatcacttgaggctcaaactcctgacctcaagtgatccacccgcctcggcctcccaaagtgctggaattacaggcatgagccattacgccaggccagactcaattttttgatggggaaatggtaatgttacattacggagaatgtggaggaggagatattgtagtggacatcttttgaaaataccaattgtcacaatggttacagtaaaaaaatacaggagcatttaaaaaaaatcctccactaaagtaatttccactttatccaggtattatgttataacctcagaggctctctaagtcctttcaatcaacagactaagtttttatcactcacatggaaggttctattatacttgcagatgcaatactgtgcctttcacatgctgcccgctaggtgctcaaaaggccaaagaagcattaatttacactcacttgcctactcccaccttttgggtgggtgattcctcaccataaggatccctttgcccaacccctccccatccccttggtgttttctttcaagagacagggcacctctcccccagagagagagcgagcgagagagagagagagagtgcgtgagagagtgagaaagcgagcaagagagagagcaagagagagcgagagacaggcagacaaggtcttgctctgccaccggctgcagtgtagtgctgtgactatagctccctgtaacctcaaactccttggctcaagagatcctcctgcctcatcctcccaagtagctaggactacaggtgtatgccaccatgcctggctaattttattttttttattttttgtagagatggagtctccctatattgcccaggctggtctcaaattcctggcctcaagcaatcctcccatcttggtcttccaaagtactgagattacaggtgtgagccatggtgcccagccagaattttctaagagccttttaggatgcagctataccacggttacatttattttaacttgtagaagttttgctttttttttttttttttaaaaagcaatcactcttggagatactagatactacaactattacctaaaaacttaccatgataactagttgagaacaaagctttgtaaggataagcactgagttgagttggggtgtggacgggggggggatggtggcaacagaatattaagaagaaaaagaagcctacggaaacctgggtatgatatcaaaacaacaaagattatactacctaataaatgtaagtacagtaagtatggcatctttatacaccacaagccaaattcacatccactacttcattgattaaaactgtacagtttatcatgttgctaacgcaatgtagaacccaaagttccaagaggcgaggtgatttggccaagtcttcacggcgtgaaagggctgagatcggaactcagcctgtgcttcctgaacccagctctctccagccatctcattgcctcactgaacctcacctaacagtcatgtacgttgttaacttcttaactgaaatatttccaatcaatgcaagaaccctaacacactctgagaccactgagtacaaacaagctggcagcccagcatcacccgtcccacagcgcccaccaggagttcacacgtgaagcctaattcatcccttaaaaaaaaaaaaaaagtgttagaaaaatgtgaaaccaatgaatctgccagcatggttgtttcacatagaaaatctggaatccagcatctaaataaacggtagaatactgttgctaccagctgtgattccatttaagacaccatttgtggaaaatatttattatggtcttccattttctcagcacaaaatcaaagaaaattgagaaatatgaaattacattgtcttcaaaaatcctgtcatagagtaactcagctctcacagctatcctctgaagatgttattgatgttctaccaagttgatggagtaatataatttgctagcaggaaaaaatgctggcaaacagaattgtgttcattagagcggtatctttacaacgccttcttccactttcattacttttcaagatcacacatcatgtcacagggccgaaccacagccttgctatgccctggatatttcagtatttttttacagttggaagcagattcttaacgcttgtgcaaattacagctatttttgctaaaatgggctcatttatgctgctggggaaaagaagcctctctgtctccctctctctgaaggtctatgaggcagctctttacatgtagctcccattacttcaggctcgtaagttcccgcgggggcagtctcttccataaccaatcatcagacctagcgctggaccagttcacatccacactgtgaagtaagcatcgtttgtctttactccctttccatccctcttagttctgacaagttttctctttcacttgggctgaaggactcaccaacggccttcttagtgtggcctcacaaatgctgccttctccagagcagctttctccagaagttccctctttacccagtcaaaacttccaagcctcctttagaaaagtctgatcccatcagggtgttaaaaaaaaaaaaaggcaaccttattagatgaaattacaggtgttaatgattaataatttcatagatgagtttagattttgagggagaaattcttatcaactcaaaacaatttttaataggtaaaatttgaaacaacacaactacgtgctgcattttcatccgtgggaaggaaaaggatttttgggcacaagcgactcccagattcctcaaaagcaaaccacggagagttgagcttcatgtgtgtggtagaggttcaagcacggtatagggagtcgactttcgaactgggcattgtactggtcacatgctcaaccttgctgctgaagtgtcctttaaatcacttagtcctgggaagcaaatgcaagatgcatggatgggacctgaccagattagcacagggaacagggcaaggagaatggtgagcagattaacacagggaacagcgcaaggagaatggagtctagattagcacagggaacagggcaaggagaatggagtccagattaacacagggaacagggcaaggggaatggtgaccagactagcacagggaacagggcaaggagaatggtgaccagattaacacagggaacagggcaaggagaatggagtccagattagcacagggaacagggcaagaagaatggtgaccagattagcacagggaacagggcgaggagaatggtgtccagggcacctatgaagcattgcttctactttctgagctgctggaatagactacaagctttgtggtctgcattcctctacttctactaagcgttcacatgactcgggaggccagatgttattcctggctcatgcctactaggttaaaggagtgggggatgctttacttccaattattgaaatgaatcacagactgtttagagccagaaggaagcagagatcacctgcttcaaccctgtcaccttaaagatgatgaaatagcctagaaaagttgccctaggcccactcaggccatgcagcaagctctaagcccctcagctctatcaagttgggtacacaaaaggtgcttaataagtgttggctagcctagtggctggattcctgaggtctgcttcctagttccatgctcctttcattataactccctcccatgcccaccatccccactcccacattcttcgttccagtctctggtggaaaacaatcacagaccatgccagagtccagaataagaccccaaagtgagttaggggacggtccacttactcagttacttatgactctaattatgtgccaagtggtgccagtgtgccactgctaattattactacacaggcttcagaaactgggccaattctttcttccttccaggaggaggtttggactaggggaccgagaaggtggctctcaggaaagcattccgaaagtttctctatcacggagtatcctttgaaggtgaagtcaagaactcctcttggaacacggcaccaggagcttttggagtcccggatgcttgcggatgactccccttaatgaaatgtaggtatgacaaggtgtacgtggcactaggttcagaccatgataatgtgccatttcggggacctgaattcctattatgatgtaagtcctttcagagagactttcataggcagctccctaatgaggcaaaggtctccgtagctcctcacgtataaatggaaagttgttgcacagaggaacagggccctttctaaccaagctagcagggacaggaatggcactagaacccagtatatttctgcacagactcaggatttttaatagtctgcaatacggcaagctgtaagcaaggaaatattccaataaaaaaataaaatacagactaagaagaaagccacagtcaatatttgattatagaattcaatgaatgattggggtaatataaacaggggatgacccccaaattcttgatgttggcctgaaagtattgtttttatttatatttaagtacaattgtgtggtctgtattctggaaatttccttgaaactaaatattggtgccaaatgaagtccacagagaattttataagctctatattttacctatttccaccattttccaattctcctcaacacgaatagctgacttctttcactgctcccaaaacattgttgggacaaagatggtctatgggttaatggatttccctgctcaggctttgtactttctagctggcaattatagctccttacatactattgattaaagaaaaattccatctctggtgttgcatccacctttggaaaagtgaaactagaattcattgaccagtttgttcatttatttgttcattcattcattcatgcattcacattacagattccacatttactgagcacccattatgggccagacactacagggataagctgggaaataagggagaccacggttcctgtcctcatggatcttacatcactgtggaagggccagatactggaaagtattaacaagtctggtgagtactgggcaggcttcaaaagggacctacagtagtcagagctgctctagagagtcaggaaaaacttagaagagacactttcattgggggctggtagatgagtaaaaattaggctgatgaaaaaacagtaggtggaaaacccccaggggcacaaaacagcaacactgagaattcaacgaactgatggaaagtcaagagtgtcccaactatagaaggagagctgcagtgaggaatgaatgaatgaatgaccctacttgctagattagtggaatcaaccccagtgatgaatggggcaacacgggcagagcccactcttatctacccactggggcactaggtccaagtgaggggagaacccccagagtcagggtcggcaaagcttttcgagggcagcatctgcaccttgagggcaattgtactttctatacttggctccaaaccaggcacacagtcagcacctaaaaaatgtggatgcttttagaaaagacagagtcacaagcacataattagagaaagcctcttttggtcagagggagagcctcatttctgaagcaggaatttctgccacagataagccacaatgggggatgagtgtactctgtgattctttggctaactgaaccatttgcatggacactgctaattttgggaaagatgactgaacagctttatgggtcaaatttgagactgagttgtagagccagatttgaatccaagactggatgactctgttccatctaatcatcaggctcattcatttccagataaaatgattttttttctgcttactctgctttcctgagcaaactgtacttttcagttgcaaaatattacatttacctcaaagcccagggaaaataaaggtaggtgatacaaatgacccttttttgtgactgtggatgtgaatttggtctctgtcctaagaaatgatgtgcaggaactggggagaaaggaggaggccatggtgaagctcaccacccaggctgcatgtcttcaataagctacaccatgaaaaagctacatccctaccagacaagcaattcctcccctggtatccaaggtctcagtgatttcatcaagctggccactttcttcttcatccacatgggatacctatactaaactactctgggcatcttatggggaataaaatcagttgggggaaagagagcctattatgttacctaggaaaagagatctggcaagtatgagatgctttccaaattcctcttgggcactaaagtactacttgcaacacttattaatgcaacggatcagtttatcctgctaacaccatgaggataaattgcaaaacagcatatggaaatggcaggagtctcaaactcagggcatggtgacactgtgtctctgctagtaatcaaggtttacgtgctcactgtctgtgtttttcttgaacagagctgtggagcacgggtcagccagacagattatcattttctgtaagtaacaagtttatctacctcttaggaaaggaatggggggagaggacgggagaaagagagaggggggcagacagggggcctgtgcatgctcatgagtacatcagtcggtatttgttctgtagaaattcaatttattcaacaaaaattctggtctttttagccttcagctagattgtgtctgatacgcagaggtcacatgtgtttggaagccactgaaaacctcctcctcttgccttctctgatttctgtctctagaattatcgctgcctttcttttctctgggccactcccttccccattatcagctctcctctcatgctttctggtagttctcactgtcatgccaatgacagaccatctgattagactgttttaaacattctaattttaaacttgtgtgtgtgtgtgtgtgtgtgtgtgtgtgtgtaagcggtatacgtattcccaaaaggctgttcgatgaaatttgatttatgtcctctttctgggcttactctcaaatatatatgaaagagtgctgactttgtacctagagggtttacaactgagccaactcattcattcattcactcattcatttattcattctcttcaaggaatatttattgagaacccacaatcagccaagcactcttctagatgctgggtaccgctctagatgagtgttacctcaattaatcctcacagtaaggtaaacattattactctcattttacagatgacaaaattgcatctcacagaacttaaatataataattggcctaagccacatagctagtacactgcaaaactgctctgtatctaacttggatctttttaagatgctctcaactgctagcagatagggattctcttggtaatcagattttgtaaattaccatgcctaattctttatgccacaatagactccaaaaacagacttattaatgatgacagactatgggcaagattctgatcactttgagaaaaagacagaaaaaaaatttttttattccacaacttctcagttagcatggaattctgacattccatttgtttatccactttgggggtgtcatgataatggggaacatagtccatcaacatatctgtaagctaggacttcattaatatttgttacaatgaacagataaagttgtctatcgctaacatatagcttctttacaaacagtagctctaatcacagttaagggtgcagacatgatctgcagggtttgggtggacgaagggagagggcatgagggacgacgtcgaagttcaaagacaacgaagtctcctcgggattttatgctggctcagctcggtcatctcagtggctgctgccatccagtaccataatgatgacaaaatatgctctcctaagttataaaacactgtgctgaaagtaagaatctctgataaagccttgagtttcagaagacttgcctcctgccccttactgcatttctagttagaaatatcttccatataggccaggcacagtggctcatgcctgtaatcccagcactttgggaggccgaggcgggtgatcacgaaatcaggagatcaagaccatcctggctaacacggtgaaaccccgtctctactaaaaatacaaaaaatgagccgggcatggtggcgggtgcctgtagtcccagctactcgggaggctgaggcaggagaatcgcttgaacccaggagacggagcttgaagtgagccgagatcgtgccactgcactccagcttgggcgagactccgtcccaaaaaaaaaaacaacaaaaaaagaaatatcttccatttaaagtttcacttgcatacttgcatgttttcccgctggcagacagagtgtaacaacactaatttgaccatgctttccagagcatggcggggcaggaatgaaaaccgttgtagccacttcctccctactgccaaggctccggcttgcttcgtctctcaaatctccacctgtcactctgtaatgaatgccacccagaggtccacatctcattttacccatcagtagcacacactactgtttaccatcactttcttcaaaacaggcccctcttggtctctcaatccctgccctcccctgctctgcccagtgcccccccaactgccctcacctctatgctgtacccgccacacctctcaaaccttgccctcccatccatatagctattttctgcagggaccaaccatattagcttaggctaacgtgcaaatccctgaccatggcccacagccccacatgacctggttcatgctttcctctcttttataaagagttttatctccacaaatgcttcatctgccctaaagtctatattgtttgataatgacagttaacccagctttcctctgattaatgtggtcttgatatatctctatttcatctcattatttttaaccccttggtgcagttttcttcttaagcagcatgcaactgggcttaaaaaaaaccaaacaaaaaacctgtctcttaatatttaaatttcatcttaatcatttacatgtatggtgatatatgtggatttatactctccttatcatttttacctagtattttagtttcatctttcagtctcaacacagggaaagcagttgtgttcacattcattagtaaattctattttctgacatttcagcaatttctatactcaacactgttctacgcattctacaacttctctctgggtttacttttcttgtaatacacattctttttaaaaaattattttaacaagattccttgtacctcttaaaatatctttatttcattttcacttttgagagacagtttaactatagacagaattcttgacaattctttgctttcgcacattgaagacattccacgtgacctgacgtcactggctgttgagatgttctctcaatcaaattgaaatcaggttgtaagattctctgccagcgatgttctgaagattcactagtgtgtgtgtatttacatttctttgtattgataccactcagtacttgggggtatgctttgaatttgagggttcatgccttttaaaaactctgtcaaattgaaaatttgctggtcattcgttctactctttcttaaagaacttcttattagaaacttattggatagtctcaaaatatccctcctgcctcagctgcttttgcataattttaaaaaatgtctttttcctctgagctgcattctgggtaaattcctcaccactatctcttaattcaatgtatctttgtgggtttttttatttcaatgactatagttttcatttctgagatttctgattggttctgttcctattctcctgttcttgtttcacatatgtttgtcccccaatcccagtggatattatccatttttttctctttaaggatttggaataaattgaaaacttttattctataattttatttccatatggagtgaatttctgattgtgaatctcagtggttctctttttgatgctctatttctttatgtgttttggcatttaggtgtgcatgttcatttcagtggcaggttctctcccatctgtctctgtccctgtctccatttgcatcctacccccacaagtgcctacgccctcatcttgaacaggatcttaaatgctagctcaaggatcctatccccagtgatagggacattgcaaatccagtcactgaaccagcaggtggcttggctcaggccctggtcaggatcctgtgtctgggatcttatacctccatagactcacaagcttcatgtcgaccatcattccaggcataggtcagcagttacttttatcagcctcccatcatagtgaggatgtcctctctcatttatcaacatccccggttttcagtagtgagcctgactccacttcccatttcacagagtacatatctagtccctgttacattccaggagccaaattcccagccattttgcctcctttatccgagagccaggtagccagtggcttcagctccatcacttctttgcatttctcttctttttcagattcactcgctttgagcctagctatatctttttaatttcccattgttatattttgtctcttgtggcctaaagcatgatctaaccatgccagctcaccaaggagttccctgactttctctacaacctcacctcatgccacgggcccatgcgctccagtcacctcctttgctatctcttcagttctctggtcaatcaagatttctcccacctcaagaccagacacatgcatgaagagaaagagccaagcactgaacgctcttgtcccctctctccctaaatactattctcggccttttaatttcagcttaaatacagtctctctccctaaatactattctcagccttttaatttcagcttaaatacagtctcagaaggcacttttctgatcactctatcttagtaaccctatctcccaattgtttattaattggatccagttagttgtcttcagagcaaagttgcaaacagtcacaagatcgcccaaaccacagcttacaggccacacttctttttggtaagatgtacctacaccactaacattgacagtggtgctgcctacaaatataaaggtcaaggatatgtacaggtatggcccaatgtgaaagacagcagacttcttgggttgggaagtctgagtttcttttcaggactcagatgatgaaattacctggaacttaaggtattatgtccaataatcaaatagtctcttgtttcaatattttatcaaaaataaaatataataaaaccttattgggacgaattgggatgatgaaacatccaaattaatggagatttggaattctagattttttttttaataaaatggagactgatttcttgtaaccctgtacaacagcacagagtaatggtttacaggacactgccaaatagagaccctgccaggacctactttaatgaacagtaaagaactgtctatgatcaactatctttttagcggggatagcatgctgtaaaggcagcatgaatgggctagcatttcccctataatttcctacatatttatgattttcacaggaaacaatttttttccatctacagacactggaaatgtgagtatcagctctctctctacagtaccataaattcaaaatcagtgaggccagatcaatgaaatttgatacgcacaaaactcttgcatattctcatgtgagtgtggaggagagcagagtgtcatcaagactccactccacagccatagtctccgcatctgcagttagctcttttaggacagctagatcactgctccattctattagctccaaacatactgcaaccacctgttgaagctgggaaggctcagcatttttttctctttctcccactggctctgcagaaagcatcacaattccaattagtctgtcaaaaacgaaaggccatgacttaaggtgcaaaacacctatgaaataatgaatttggaaggacaggaggagacatatctgtaccggttagtgtactcaagaatcaggctatagaggaaattgcttctttggtagtgtaaatacaaagttttcaagaatagttactacaaggcactttctattcaagtaccaaattgtgagatacagaatatgaggggatttggtgaatgttttcctttgaacagggctttacttcaggtccatacccaaaggaatatcaatcatgctgctataaagacacatgcacacgtatgtttattgcagcagtactcacaatagcaaagacttggaaccaacccaaatgtccaacaatgatagactggattaagaaaatgtggcatatatacaccatggaatactatgcagccacaaaaaaggatatttcatgtcctttgtagggacatggatgaagctggaaaccatcattctcaacaaactatcacaaggacaaaaaaccaaacaccacatgttctcactgataggtgggaactgaacaatgagaacgcttggacacaggaaggggaacatcacacactggggcctgtggtggggtggggggagggggtaggatagcattaggagatatacctaatgtaaatgacaagttaatgggtgcagcacaccaacatggcacatgtatacatatgtaacaaacctgcacgttgtgcacatgtaccctagaacttaaagtataattatatatagatagatagatagatataaagaaaagaaaagaaaagaaaaagaaacggccaactctaaggagatttcaggtccactgcagacgccccctactggccggttttcaaagctatgccaagacatgtcctctcaattgcttccgggttccaaaaaaaaaaaaaaaaaaaaggtggatcaagacaccagcgaggctcattgcttgtggtctgcttcttatgtgttctagggaattttattttcaaaagctacaaagcttttcacaatatgggtttgaggatgctcagtacgtgagaattttgggttgaggtacagaaaccagataaagccttgttcatttgctcattcggcatcaacgtccagtgtgtcccaatgtaaatgaatcactgtctagaaagtagaaacattcttatttttttttttaaaatatgcaactcttggctattactggctatttcatattccaggaaagcacagaggattctgcactgagctgctgcaggcgagctcactcctacccagctccttagcctggcctgcgccatcacccagtagtgcctgtgtcgagctggtctgcagtccctgagccccttccctaccctcaaaagaggaagcaatttccagtgggagccagagcggccccggcccatggggaagggcagactgagaagccttctgagggaaggatcttgacctgtcaacacacacacgcgcacacacacacacacatacacacacatacacacccccacacacatacacacacataaaaatatgcacacacatacacacacatacacaacacaccacacacacacacacacacaccttgagccttccccatgcttaagagccacccagcttcttaatctgcccaccccagaaccaggaagaaagagggaaatttcaagagccttgggctccattctttgtgatgcccagatgtgttttctcaggctgggcttgtactggacgaggctgaacaggagcggggcagctacccctccgctaccactgctggcttttcctgtgcctcctgttgctcccttattagatgaccactcaaagcttaattcctctcttatgttgtttgaatctcttcagatcacccttctggccttcactacctattttcttcttcctcccactttctctcattcttttccccctagaacaccatcaacccctcagcccagccttgctcaggcccctcagaccatgccttagtgttcccggcaggccctgcttccaactggactcactgcagcctgatgatgtccttgttactttttcacacagcaaatatccatccaacaggcactcttctcttttcactcctgtctgcaccctcgatactcttcacagaacaagctctagccctctccatagcagagaacctgcctactcctctgagagatgataaatgctcccagagaggaatcagagctataggtgacagctccttattcctattaggtacagagaggttgaagggagagggctgggcatccagccttccctggtcctcctacacagctgtgcaaggagcacagcaacaagagcaacatcacagagagagaggggccgaggggaggggttgcagcagctcagcaggaaggtctgccatgtcccaccatgtctgatgcactcagttctctcaattctgattcctacactcagccctgctctcaactgtgtaggaccccaaaaactgggttctctaaagggtctgaaaacagccaatccaccacaatcaccagcaagtgctgttatagtccctctcttctcctttccaattaaatgaacactaaatggactcgaatgcgtgaagtctgagatatcatgacaagaagtaaatttagttactctgaagcaagctaggcaatgtgtgagtttatgcaaacaaacatttttatgttttattataaagtgtaacgaatgttagtcatgtgagtaaactgggtacagcacattgttctctttgtattttggctgctgacgctggtagaggaggcatctgtctgccctggattaacttctctgtggtatctgctaatgaatcagtgaggcagagaagcttcctgcaggatctcccgacctcggcacacctgtccacctgtccatctgcccacctcatgctgcagcgctggaattcacaccaatgaaccagtaaggcagagaagcttcctgcaggatctcccgacctaggcacacctgtccacctgtccatctgcccacctcatgctgcagcactggaattcacaccaatgtgcaaacagttggcatcactttgaagccactccaaggtggcatctgcacttaataacaaacaccctgcaaaaaccgctgtgcagccgtgggcctaaggtatgtgcccacttcatcagcctcattctgggccacttgtcctgtcccgcttccttcatctccccatgcctgtcaccaccctagctgttgtgcaggttcttgagtgtggtattttccctcctgctaccgggtcagggagagctcttctctgaggctggccagcccctccggtagttcactttactctcacaactgggctcccttcccatcacctcctgtttctacctaaaagcaggtccttccatcggaagctcttctaacagtgtatctttccttcctagctcttcatgcagttcataactatacactatattttggtaatgatgtcattgtctctcatgctagagtgtaaactgtctagtgatagggttatatatgctgggttttttttttaaataatgctatatctaatagtgcttggcacataggaggtactcaatacatatttaaatatttgtgacattaatgaacaaatggtattaaggatacagaccaagagagctcaagcagaaaacagaacacagccctgtcatgcagatgtccctacgtaaataagccattaacttctctagatcaagctggttgggaaaaatgacatctgtggataacaaatgatgaaaactttgttcttaaagactgttttgtacaaatgcataagaaaagactaagttttttttcctaaagcaagtagtggacatcccaacaccatccatgggagaatgagagacatctgtcacagggccccaggaacttggggaaggattcgggctggctgacaatgactcttttcttggccagtgtggctaaagagtaataccaccttcctgatgacaaagaaacagaaactaatagcagggcatactcatggttagttggacataattgtgtagaatgaattttatacagttttcattacagaatgtggggtgtagtaattctctgcaaattctttgttcattacataaaatcctgggttgaaacagccctctagatactattatgcaggggggccagaactgactacgtcttatttgacttttaaagtcaagtttctggtggacaagccaaataaacagccccacttaagagaattcaatcctaaagaagtttatttttgtctgggtgtgctacgtattatactagagccaattacaaatgtttaaaatagctaaacttttaaaaatgtgtttgatgcttttatatgcaaaagtgttttcaaaaacaataatagtgtcaataaacagagtatcggatttgacaaggtggattgttaagtggttgcaaactgttcccacaagacgctgatgagtgcatccctctggcctggagggcatggaatcaggccatcatttctagccacggtaactaaacttacttcttgtcataaatatctcagacttcaggcattcaagtctaagtccatgatttagatgaagatatttaagacatgtttatcaaacctgcagctgctacgaagctcagaggaagggataagagctcttataatcttggccatggtagttaatccagcagactctccatttcttcatctataaagtgtgacaatgatttcgattttgtagggttattgtaaagaattaatgagccaaggtatataaagtgaaccagtaaagttagttatcttcttttacacaaagaatagcagaatcaggatttgttaaaaaaaaaaaaaaaatcacaaaaactcaagttggaaaaatgggctaaagctaataattgtatcaataaaaaagggaaacccagcatgtagctttaaaaaaacaaaacaaaacaaaactctgtggaaggatctacaaaaacaacgacacatgaataaaacaagtaagttgtttaaaaaaacaccaaaacaccaaaaaaaaaaacctttgagtaatgtcaccaaatcgtgttcttccaaaatataataacgccatttgtagactcttaagacttgttatatataatcaatcagtcctactgattaaaggaaggttgcatgttttacaaccttagggcagagattcctggtggactgacgttaggaatgcgtaaacaacattgtcaccaatgtattccactgagttctattttataattacttatttaaaataatttgagttgctctcatagtaaacctgcatttaagcaacaaaattactgaatacccacagaatggggagatttgacttggtagtgttcctggcatggagttctagaagttctcagtggccacaagctcagcaggagacaactgctgtgaagccattgaagtcttcacctcaactacactagtcctagggccagagagccaaacgctgacctccccctctccccaagtcataagacaactctctttttcctttactacaaattatgaaaatagctacttgatatcaaggtcacaactaatttcattttattcaacttaatctcttgaaaaatgattggttttttaaaaagatacattttgcattgcatacctccccaaagcaggagtattgcagtactagagatggaatcaaccatgcttcagctacccctggttagtggcttcaggctatagcctagggcctggctttgggctccagagctttctggataataaggtggctccagtttccaatgttccctcatggtgcctgttggtggcctaaaattctgtgatttcttttaaaacaacaaaagtcaagctatgaagagagtgaggaatgaatctgccaggccagcattgctcttcaagataatggaataatcggaagacagaaccagactggaaaccttgggcctcgtcttaagctcttatcttgggcaaatctcttaagtcattgagacttgttgaggggctgccatcagatcacctttaaagtcttctctagttctgaaattctatcagctgccaactgccttggcacacaggcaacattggcctttatgaatctgtggacaccacttgcctctcaaaactgccagaaatgagttaaaaagcatgaatgttcaagactcacagggctggcagagaagctctacagcttctaaaaatacttcttctctttcttcattatctgattcacaggacctaatttaatggtgaaattccggaatggcgtgccgaaacctctgactgtgacatgaaagatggtcatcttgcacctgggattcagttatgaatggcttgccgtatgtgcaagcactctgtcatttgcctccagctgtttattcgtcacactggggcacaggagaggtgctaggagcaaaccaacagcaaaataaaaacattaatttatgcaaagctttctagacacaactgctgttgctgagaaacaattaccactacaaacctggtgttttaggttgaaccatatgaactggccaatttcacgtatgaactggccaatttcacaggtcaacaatggtgactgtcaacagtttcatatggttaaatacacacaaagccccccagtggctggggaaagtggtattctacaggtttttctctgagtgcaatgatggtgggaagaagatggacgacaactcaaatgcaaaccccagccacgtggaggctaaaaagttattatgtaacaaaacgacattatagaaatgccttctggaactactagaattaggtgggaattcttaaggaaaggaaaatcattatttctagagttaacaaaagctggaaggaaaatgacaaacacacaaacctatcagcttaagaaaatttctaaaatttgatgtgcctgattttgaagccaacagaagagggaacagagagatgcagagaaacaatgtcctattggatcctttgagccctggatccaaccaggcttgaggccagatatccctggactttccagttacgtaagtcagtattttttttttttttttttgagacagagtctctctctgtcgcccaggctggagtggagtggcacaatctcggctcactgcaacctccgcctcccgggttcaaggattctcctgcctcagacttccaagcagctgggaccacaggcgcccaccaccacactcgggtaatttttgtatttttagtagagacagggtttcaacatattggccaggctggtcttgaactcctgtccttgtgatctgcccatctcggcctcccaaagtgttgggattacaggcgtgaggcaccgcgcccagctgagtcagtatctttcttattaaagcacatactcatgcatacacacacaatagcactcactgccgtggtctggatgttctcccaaattaatgtgttaaaacttaattcccggccgggcgcagtggcactttgggaggccaaggcaggcggatcacgaagtcaggagatccagaccatcctggctaatgtggtgaaaccccatctctactaaaaatacgggcgcctgtagtcccagctactcgggaggctgaggcaggagaatggcatggacctgggaggcggagcttgcattgagctgagattgcaccactgcactccagcctgggtgacaaagcgagactccgtctcaaaacaaaaacaaaaacaaaaaaacttaattcccactgtagtggtagtaagagtggggcctttgggaactgattaagccatgagggctctgctcttataaatgaattagtaccttataaaagagctagagggaactaacttaggccccttttttgcccttttgcattctgccacgtgaggacacagagttcatcccctctggaggccacagcaacaaggaaccatcttgaagttggagcgagcagccctcaccaggcgctgaacctgccagtgcctggatcttggtgtctcagcctctccaactgtgctgagtaactttctgttgtttataaattacccagtctgtggtattttgttgtggcagcacaaagatacccaccacatacacaaaagcttatgatgctggaccaacccatctcaaaatgttgaactgaatcacaacaagcaagacccatttcatatcaaaacttcaaaaaagctttggcttctagtctgattcacaagtacatgcgttcaaggcccaagcagttaaaaccctgcacagataaattgtaagagcctgggtaaaagaaaatagaatttcctggtaagtgagaatgaaaaaaaaaaaaaaagtttaccacatgtgtagatttaaccagtacgttactaatgcagagaagggaagaatcaggctatttcataatcaaatgttgataatataagagaggggcaagtttattatgtcctcatcagaagcaagaagctggatgtcaggtatactgtgaaaaattgcacaagccaagacctaagactggattaaaattatcaaattgttattagatgaaagttactagaatattgtcagattatcctaaccataagagtagcagaacagtactcaatgtttctaatcagttttgtctattttctgagctggttaaacatttgctgatgtgcaatttgtaaagtcacagccatctgttcatttgtgtcttaagtcttcctgcataaattctgctcttttacctgttttggggaaataaaagtttattttaatttactgccaaaatttgtggcacaggaaagggataggttgaaaccaaaaactattttgcttttttaccatctattagtcatcctttgaaaaatcaatattcagtgctcaccccgtctgtggctccaggcaatcaaaagaaaattgtgtactgtccccattcagactgatgatgcattgtgccattatcctgtgagctaatatgagattcagtatctgctgtcttacctgacaaataagccttcagaatccaggcttgggcacattatttgaagaatctgcagctttaatataatttatattcccaagttccttctactgcttcagtatatgcagcatatgacttgagatagaaggataaagaaaccagaatgattctcttctttcctaccccatcatctgatcaattctggacattcctttcaaccctgtggccatctattacaagttgagtgcctactatgtgtcagagaatatgttagctgctgggaagacagttatgaagaagacggggtctttccagttgttcaactttttttgctactcataaagaggataaaagaaagagaaagaagagaaagaattccagtctgttaggaaatattataaaattactccaaagtggggatgcagaattaaaatataccagaagtaaaaaagagaaatgctgatgttctatttcatgatcaataataaaaacagtaacagcttatatttgttgaatgcttattttttgccatccatattgctaggatttgtcttacttaatccttatcacaacgctgtgaggtaggtactgtaaataaatccattttagaaatgggaaaactgaggctcagggaagttaaattccatgtctacaataaaatatctcaaagcaatggagttgccgcagaaacctacctgcctccgatacctgaacccttccttgctatgctatattgcaggaacttggccctaaactgacaccttgccaacttgggatacgtgttatttctaaagatgaactttcaaagtgggttaaaagagggagaaggccgggcgcggtggctcacgcctgtaatcccagcactttgggaggccgaggcgggtggatcatgaggtcaggagatggagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagatcgcgccactgcagtccgcaatccggcctgggcgacagagcgagactccgtctcaaaaaaaaaaaaaaaaaaaaaaaaaaaaagagggagaaaaatggtaagacatatcttcctaacagttagaaatgaacagagaaatgagtcaggattgaggacagggctgaaggtgtcttctgggaccagtcaagagtggggtgtggtcaggctgctgctgctcactcctcctcccacgcagcacccacaggctgcatggtgcaactgggaggcttgctggaaaatggcaagtcctgctgcaggcgggctacagtgggcagccctcacctccactcctggccaaactgaccagggccactctccttacacagagaccatgctgctgaccaggtctctctggggccatcagcctcaggtcagcaaaaggtcttacaaaagtcaagaaattgcttatgattacagctctgcaatgcaaacgcgtttttaccaacaaagaaaaaaaaaaggttggagaggaagaagaagagagaaaaagaaacatttggccaaggccagaaagggtccaccgaagtcagcctccgaacttccggtccaatgttgacaccttgttcactggtgacaactcaggactgtaccccaaattacacaatgctacttgagggaagcaggcctggcagcagagagagaattaccggcacacattagtgagagcaatcgcagccaactcaaaaccgcactcgaaaacggccttgcattcatggactggtagttacttcctggtttctaagaaaccaaataaaattaaaactcaccattaataacaaaacaacactttacagtccccccttccctttcagagacgcatcaagtgacggcacctgatcaaagctgaattattaaaagtctatagattaatcctgtaactctcaagagcccagagtttgtaatttcccagggaaaaaaaaaaaaaacaaaaaacaaaaaaacagaagcaatctacaccgtgaaaaatttaattgcactttaattaccagttaagctgaatagcatgagatatgggtgcctttaatttttaatagtcgttatgattccaagagaattttaaagggaaataatttaatctcttgagagtattctcctcttctgccactgccaaaatcaaaatgaggacagaaaaaaatgtaaagggcgattcaaattcttccagatcataacccaggacggcccccagcaataataaactggctgttcccaggcagctgcactgcacattttcatgatatgctaatatagaaatgggtttcctgcagttgagttctggtacattaagcagataaacgcccttggctggggtgtttcttttttaaaatcagatctaaagatggcatacttgtttctttgtctctcagagcctggcaccaatatgggcatgcatacccccacctacgtaacacacatacacaaacctgggcacccatatacacatactcttccacatgctgccatgatgccccaaaacatccttttgaaaggaaaaagggaagagggtaacacaatcacacaaggctccaacaaaaatggaaatcagcaggtctgagaattcaaaaggaaataagcgtagcctccactttcactttatctgagaaccacctgactcaggaaggagctggcctcttgagagctggtgcaggagggagccgcctggaccgggtgaggctggccactttcccctttctcaagcacacactggccttctcaacttgctgaggctcttgaggtttgcctgttgtgcaggtgtagttgtctccattgaggctgcagtgtgcctcagcctcttcttggggatgctgtcccatcccaggacagtgcttttttttggaaataaattaggttgtgatttcttttttttttagtttttatttgtgagacagagtctcattttgttgcccaggctggagtgcaatggcacgatctcagctcattggaaccactacctcctgggttcaagcgattctcgtgcctcagcctcccgaacagctgagattacaggcatgcaccaccacacctggctaatgtttgtatttttagaagagatggggtttcaccatgttggccaggctggtcttggactcctgacctccgcccgcctcggcctcccaaagtgctgggattacaggcgtgagccactgctcctggccggttgtgattttaagaagtcagactgggctcaaaaggcttttcatgaggtctccaaataactcagggctctgtactgcctctggttcctgctgctcactactatcaaacacataacaagtatgggccttgttattagtgatcatttggtaaatcaattacaatttcatctgtcaggcaaataagagaagaaaaaacctgcagaaccatctgccacttttctcttctccaactgtgcacccatttcctttctccaaccctctgtatgaaacctgcactgacagacagtgctatgccaggctttcggggatttgtctgtgtctccctcagggaccaatagcacccacctcagttgggacccacagagaaagcaggagaggcgctttcttcccaagcccagtgagttcaaaaggaggaaggagtagagttctaactttgtgaaccaaagaagtgcccctccctgagaaccctgctgttgttcctttgtgtggcagctggtcatacagacaaaaacactcaggtgagagagaacaaggagtgcaacgtcaggaaggcattgtttagattcccaagtaaaggctgaaagcttggcgtggttaggaggcaagacgcagaaaacatcctagtgcgggcacaattgtgcctgaccaggacaaaaaggggacaatgaaaagaggatcctggccaggccagcacagaggagcttcccagggccacactgctcagggacaattccctagtgagacagaactgcagactggtggcagaagtttctctgtattatccttgacaacttattattgtaaagatttggaattagctgtactgagtcttcatcatagatgacaggttctctctcattgtcattttcacaaagtcccaagataaagagaccctccaggtagctgaaatgcaggtacccaatttaccactggagccaagattttggtttcagaggggacaaacgaggtaagtagtactcattgggtaccatccatttcaccaccagaaaccaatttcaccaagtttaacagttcttcctgctgcctgggcaggaggcggccttgtctctttccgcagtactctgggagtctaccacaaggcagcagagccttcgagttagagcagctctttggaacaaacatcacctctcttgctaggtgaggcctctcacccaacaggctgggagaggctgtcacagaactcagaactaagagcctacaactcattctgcagctcaagtatgagacaggctcactgtacagcaatttgtactggtgatccctcccctggggatgacccccatgactctggcgccctgaggcagggcacctgtttcagaatcccccgctaatcctccttactcccttcccagaactctaagcatccttgtacagatggcattggtactggcaagactgtggtctgtgagtagtcaggaagccagtcgacagcacctactctgttattcacccaaagcctctgtctccactgcagccacggagttgaaggctggtgggggcagggtttggggagtgattcaagaactgatcatccctctgacctgcgctatggacctgagcagcagtttcaggtgtgaggagcgtggaaaagggaaagcctcttagagcttatgtgtctagcctgggtaagccccaggaccagcatcagaattctgtaatttgaatgagaactgagctgagaactgcagagaaagacgcacttttcaaagaattccccaacagcaaattgaaatatgggcacgatgctgaaaagagatgaggctgccaaagccacgtggccgagcagacggagggagtgcagtctccacactgaggctgactgaaaacataaataactaggcaagatttttcagtagctagtgaggttatcacatactctggacaaaatccctagtgctcattacacttctgatatgattttctcacctctctccaggctcactgatgcatcttccaattcaacatggcttcttgcctctgaaaggagagctagtccctcctggaatttgtaagtgtgaaggctgtgtttcagctgtcacgtctggtgtatcactgatgcctattcctgtggcctttccagtttcccagggtgatgcaaatgaacaccgtgcagcaggtaaacagagcgctgaagtgcaaagtacagctcttatttatagatcaaacacctgccatcaatttaaacagtagttatctctaacttgaaagtttagcaagatactgaatgcccccttgaagcaaataattttgaagcagttcaggtatacagatgtgtttccagcctacttaagaatgctataattatcatcaaaaagacagattccattaactatctgttatgctttctgtatgtgtactcccagacagatttgaaatgttgaaagtcttgggtttcttagcactatacttttaacattatttttttaaaggactgggcttaggatcttctgaatttggaaaaacatctgatgagaggtttttggaacagttaatgatctaatgtggccgttcttgtcattttgcctttacaaccacagttccatttccaccctctctctaccagacacataaaaatttcatatttggaaaaagctatcttcctaaacacagatcagtgaggagtgaacacatctctaatcacaaatggccaataaccactatttcttgaaagttaaaaatcaggtgatgtgctgtacaggtgctctatggatactgttccattaatctttttgatgaattcttgaaaggttatcttcattttactgatgatataaactgaggctctgaaaggttaagcatgctgcctgaaatcacccacctagtaaatggaagaatttacatttgaacatgggtctgtgtccactccgaagcccgttcttcctactgcatacaacacactagcacagaagatggtcctctttctttgcttagattgtttcaaaattgattttccattttcagggatatggaatgtcattctggaagtaggtgataattatgttcggtggcttgagattggcatgatctccgggatacgagtctgcaggccacatcagccagtcacgtgtgtgggcaactcactttacctcggtggacctttttctctcccagaaaaccataaggatggattgaaggactaaagtccaacagttaaaactgttccttttaattctaaaatcctctgagtgtatgaactgcttcacctttgcatagaggacaagcttgtgctcaggagggcctgaattatttcagttccctgaatgtgctggccctcctcatgcaggagctgccccagggtttgtaaaccttcccctactaccaggcaccaccactgctatctgatggccgcacaaaggaatgagtgaacaccgtcaggaagacattggtcctgtgctctacgagagggtgtgcccaaccaccactgtcctctcagcatcctccattgtgaccaacgtcaccagggctgcccgaggaaaccctaagagagggaggggtattttccgtgaaaacacacctggatgcaggtctaggaaaccaacccctggtcagagtagcccaagagagaacaggcccatgcccagtgctttggtaagaatgacaaattcttacttctaaacaacagttccaaaaaaaaaaaaaaagagaaagagcgagcgagagagacagagaaactcactcagtagcaggaactgagaagaaaggggtcactcactcactcagagtgggctgggagggaaggcttcatcatttatcaggatatagtcatgaatacctctttttcttctttggaaaaatacagactactgtgggtgagtaaatctcatctagtgggcaagccggagtttgatttgagcaaagaatagaggggtagttggggtgaggaggtgaggaggagaggaaggcatggagccatggtcatgagacagcttctttttttttttttttttttttttttttgagacggagtctcgctctgttgcccaggctggagtgcagtggcgcgatctcagctcattgtaacctccgcctcccaggttcaagtgattctcctgcctcagcctcccaagtagctgggactacaggcgcccgccaccacgcccggctaatttttgtatttttaggagagacggcgtttcactatgttggccagcctggtctcgaactcctgactttgggatccacctgcctgggtctctcaaagtgctgggattacaggcatgagccaccgcaccaggcctagacagcttctttcatttgaaaatgttctcttagataaaatgtataagggtcaacatgcagcacacaagcaaacctccttcccccaggtgcaagcacagcagctggcctgaagataagagttaaatgaatccagccccctgaaaggaaggttgtctatgctacagaatcaaatcaggaagaaaggaagctattctctcacctaagggcattgagaaaggtacatgaatagtaattatctaaaaagagataatcaacaaggagtcagaagggcaaaaccctgtctaactaatctacttcacctttacagcaaggctgaagactaggtgggcaacagcgctgcatgtcaaagggtttactgtgatttcacaaagctccatagaaagcctccaaatgaagactggcaggctgggaaagtctctgaaaccatgaagaaaagggactagtggaggagctgccctcaagagaaaggcaagatgttgagtttagatggcctcagaatattaagcacctaacctgctctgtcatttaggttaattcatggagccctatatatatatatatatatatatatatatatatatatatatatacagatgaatcactggcatgagatcagctaaaatattcattgtagttgcttttaggtgattgtagatttcttcattgtttcaccttttccgtatatttttaaatgacagcaaaattttataataaagtttttataataaatttatttttataataaagaaaaataaacagaaggcaaattgatatcctcacataatgtgggagctacaaaagggatcctaagtcaaagttagtgcccttcctgtctagcctgggaggaaaacgtgactattaaattaattactgaatatgatgtgaactgcagttctgaggacaaggacctgcatttctggtctactcctgttttgaaggtaaacaatttaataatttcagtgtatagctacctccaattatccaaaccactgtcttcataggaatataagaaaattaaggtagatacctgaagcagcaccaggaatcaggacagatagagctcagttttttaaaagaagattctttcctggtcttcttcaactgggggcaaaaaaaaaataaaaacgaaaaaataaacaataaaaataaataaataaaataaaaagaatgctactgttacaccacatacttgttttaaagtcttgcccttctagtactgactacacgcggccccagggacctgtgaaatggatgctgctgcaagattttatttaaacaacatcttgatcttctgtgccatgtgactggcattgcggagaagctgctctttctaaaggcttcaaggtcacttaagcttgtgccggctctgctaagagctccgatgaggaataaactttaagatcttctactagacagaattttggaattcccagcagacctgtttcccttggcttccagatcctctcaaatgaccttatcccttatcccaccatgcacacacacacacgcacgcacacacgcacacacatgcacgcacacacacgcaagcacacacacacgcacgcacacacgcatgcacacacacacactctatcttcactgaaggctcccaagacatcttcctcacaaaacacacaaaacaaagacagctgtccattggtgctcaaaataaatgaagggtaaactaagcccacagacaccatgaggtgaggtgatatcagaaagccagagcaggacaatggtcttgatccatccgctaaatctttaggtacaacctccaaggaaaatgactttcagtcaagccaggcaactattgctaccaacaataaaacagaagatgcttttacactcatggccccagcattgtttctcacaactaaaagaggccaaacatcccaaccagaaaaaaacacaaacacacacaggaagcaactgttaacaaatggaacgtgatagtggcagagcccagaagagctgttggttaactcaacacgaaggagtccttgcctctcattcaggggtgcacacagacatgaccctaccatgcttttccttccatcccaatctccatggtcatctagtccaagctgtacgctctagtttttctcaaagtggagcttatgggtaacctccatcagaatagctggggagctaatgacacatggatcccagatcaaccaaggggattttagagacatggggcctagcccccaagtgactctgatgcatattaagacttgagcatcacaggtcaagaagtacacagatcccagttatcaacatagccagatggctggtggtagaagcaaccctgtccctgtagcacctctctgtgtcctgctcaaaagcattaaaacatcattcttagataagaacagagacaaaggatatgtctttaacactttacagtctataaagtttttccacagccactgtctcactgaatcaacccctaagagacagaaatgaaaatcgctgtttttacaaactgagaaattacgggcctttgaagtgtttcacagccttcacagcctgctggtaagaagcagagatcaggccttggacctgggtcttgtgattccaaagcccatgatccttcggattcatcaaagctccactccaagtgcctactgggactgccttgcagcactcaccttctgtaggtgagtaggtaagttgcggcatgccattctttcaaaagaacagtgcacctctgtgaccgaatatgggccacagtatctcaaggatattttggtcaaagccctggggtgtggggcagaagataatgtattcaatgaagcttctagagaaaagcataataaataaagaagctcctacctgtcgctagccttcctaaatatcccaagaaatcaagaattttctcccaatggattacagctgagcatctactcagaagagaaaatcaagtccatttcagtttagacggcagcagcaaactccccacagagagtactcccggggtggctagggggtggacagtgccattactgtatcaatcaggccaaggagtggggcttgcactactgtttgctagaatggagcttggctctaaaacaggattctcagacacatttcagaataggacgactggaacaatgcaatactcatctaagcaactgcaaaagccagctacaacccaactcaaggtgccatctattatgagaggtccccttcatctatgtaaaaaaaaaaaaaaaaaaaaaagaggagccaagatggccgaataggaacagctccagtctacagctcccagcgtgagtgacatagaagacggtgatttctgcatttccatctgaggtaccgggttcatctcactagggagtgccagacagtgggcacaggtcagtgggtgcgcgcaccgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcgcttttcggaccggcctaaaaaacggcgcaccacgagattatatcccgcatctggctcggagggtcctacccgacggagtctcgctgattgccagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaacacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagccctgcagctgagggtcctgcctgttagaaggaaaactaacaaacagaaagcacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgatgacctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagccgatgtgatcaactggaagaaagggtatcagtgatggaagatgaaatgaatgaaatgaagtgagaagggaagtttagagaaaaaagaataaaaagaaatgagcaacgcctccaagaaatatgggactatgtgaaaagaccaaatctacgtctgattggtgtacctgaaagtgatggggagaatggaaacaagttggaaagcactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaagatcgggttaccctcaaagggaagcccatcagactaacagcggatctctcagcagaaaccctacaagccagaagagagtggggagcaatattcaacattcttaaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatcgaaaggaacaaccggtaccagccactgcaaaatcatgccaaaatgtaaagaccattgagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtgctgtattcaggaaacccatctcacgagcagagacacacataggctcaaaataaaaggatggaggaagatctaccaagcaaatggaaaacaaaaaaaaggcaggggttgcaatcctagtctgataaaacagactttaaaccaacaaagatcaaaagagacaaagaaggccattacataatggtaaagggatgaattcaacaagaagagctaactatcctaaatatatatgcatccaatacaggagcacccagattcataaagcaagtcctgagtgacctgcaaagagacttagactcccacacattaataatgggagactttaacaccccactgtcaacatcagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgatcacatagttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactggatacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacaaatccagcagcacatcaaaaagcttatccaccatgatcaagtgggtttcatccctgggatgcaaggctggttcaatatacgcaaatcaataaatgtaatccagcatataaacagagccaaagacaaaaaccaaatgactatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacaagtcaaattgtccctgtttgcagacgacatgattgtatatctagaaaaccccatcgtctgagcccaaaatctccttaagctgataagcaacttcagcaaagtctcagggtacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgcctttcttcacagaattggaaaaaaactactttaaagttcatatggaaccaaaaaagagcctgcatctccaagtcaatcctaagccaaaagaacaaagctggaggcatcatgctacctgacttcaaactatactacaaggctacagtaaccaaaacagcatggtactggtaccaaaacagagatatagatcaatggaacagaacagagtcctcagaaataacgccacatatctacaactatctgatctttgacaaacctgacaaaagaagcaatggggaaaggattccctatttaataaatggtgctgcgaaaactggctagccatatgtagaaagctgaaactggatccctttcttacaccttatagaaaaatcaattcaagattgattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaacaccatcaaaaagtgggcaaaggacatgaacagacacttctcaaaagaagacatttatgcagccaaaagacacatgaaaacatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctcgaactagaaataccatttgacccagtcatgccattactgggtatatacccaaaggattataaatcatgctgctataaagacacatgcacacgtatgtttattgcggcattattcacaatagcaaagacttggaaccaacccaaatgtccaacaatgatagatcggattaagaaaatgtggcacatatacaccatggaatactatgcagccatacaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtagggggaggggggagggatagcactgggagatatacctaatgctagatgacgagttagtgggtgcagcacaccagcatggcacatgtatacatatgtaactaacctgcacaatgtgcacatgtaccctaaaacttaaagtataataataaaagaaaaaaaaaaaaagccaccgccagcatgcctctagttgctgcctcagtctgaggagctcggctgttttactgctgacaccatcttatggtatcctttgcacgatgctaacttcctccgctgagggtgaagcctcacttaccattctctgcagcaatcccaccaacctctcatccagtgactctagtggggccctttcactgggcccactttgtacttggctctccatagttcctcttaactccgtgatcaaaagacatttttacatgtgttataagcctcttttaaaaaaatcttcctaggaaagactctcttcaaatctctactagaacagggctgcatccaagtgagtccttaataaatagaatttgatcatggtaagaagacatgtcccctgctcgtgttcttgtcagtcctgaatgggtgaggcaaagtgctcagacactgtgctagcaaagggattttcagtctctgcctccctaattatgacattctttttctgcctcccacaggcacaagggccctgacgagggagtgctcagttctttggtgtgaaatatagtaagatagaggccattggcttcagaggaatagagctggataaaaaagtacaaaaggaatgtgaccagtaacaggaatggcatttagaggacctgattcatctcttctacattgttcaggacgattgcaaaatccatttctccttctctgtccctgcttctctgcccttcccccaagctttcttgctctctgccacacgtgcgtgtgcacacacacacgcgcgctcgtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatttcctgggccaaatgcattgttcaggcaaagctcccattcatgtcaacagtctcagcaggatttaccaaattcagccatatggacaatattcacagatactcattcaagaagctctcacagttccaacttccaccttgttgactctctctcatctgtttttcccacaagtcgttcaattcagttgttgggcaaccgttcagggaagcctttaagtagagatttctgctctctcattgggcagaagagaggacaggcaaaacagtgagaccgccaaatgaggaaagaaaattggaagcacttctctgatttagtaccaaacttgctccaggataaaactgcactataccaaaaactctggcagggtatcaggtactatggggtgggcaaagttcccaggttttacttccagagctgactgcaccagggagacccacgtgctcccgaaggcaccgcacgcagggcagggcatggccagaatgacagcagatgtcagctctggactcttaaggacccaaaggtccagggtcacattttttgttacataccagcttcctcccctactcacgactggagagttgtggcttctgcccccttcagtcacagctacttggggtgtctgaaagcatcagggccatgccatctagcaatcttccccaaagtagggaaacagcggtaccctgcacaagcttggcatagaggtgttccctcaaaattatctttgcacacagttggaggatgaccaaaatataggttgccatttaggcaaatgacacgaaggaagagatgctttgtagctaagtatcttttccatactgggcacccactaaaggttagctgtatacatgaatggatcgatgattggatgaaacgacacatgaaaggaaggcattgttttctcaaccaagccaagtactaagtaatctttgaaaatgaaaactcaggccgggcgcagtggctcacgcctgtaatcccagcactttgggaggccaaggcgggtggatcacttgaggtcaggagttcgagaccagcctggccaacatggtgaaacccccaactctactaaaaatataaaaattagcagccaggcacgttggctcacgcctgtaatcccagcactttgggacgtcaaggcaggcggatcacctgaggttgggagttggagaccagcctgatcaacatggagaaaccctgtttctactaaaaatacaaaaattagccaggtgtggtggtgcatgcctgtagtcccagctacttgggcggctgaggcgggagaattgcttgaacccaggagatggaggttgcagtgggccgagatcgcaccattgcactccagcctgggcaacaagaacgaaactccgtctcaaaaaaaaaaaaacaaaaaaaaaaattagtcgggtgtggcggcgtgtacctgcaatcccagctactcaggaggctgaagcaggaaaattgcttgaacccgagaggcagaggttgcagtcagccgagatcgtgccactgcactccagcctgggcaacagaacaagactctgtctcaaaagaaaaaaaccaaaacaaaacaggaaaatgtaaactcgccaagagctcagcaggaatggacgtgttactctcagagtagaccccataacagccacccagacacgtgagaatgcagctttgccttaagacagacattaaaggaagaaattccaccacctctccctgtaatctttgccagcgtgtgtcagccatcactcttgggaagctttttccatctccctacgttctcttagatttggaaacccacaacggctcccaacaagctcctctagatggctccacaccttcggcttgtggtttaagtccctcttcagttgttcctgagtctcatatctagaggaaactactacgggggaagttactgggatgagattggcaagcggcccctccacctgggatgagattgacaggcggcccctctatctggcctgcttctctgtcttcaggctggaaaggggctcactaggtgggcggagggcttctgtgtcttcaggctggaaggggctcactaggcgggccgaggccatgcgtggccctccctgggcatcttgtccccctctctgttcagcttttaaaaatgcctttgtgggctttgttgtgggtagggctttctcctacctgttccatgagtctggaagcccctgtgagagaggaattgatgagcacagcaagaaacagaacttcactgagcatgctgaacatgtgtcattattctaaatacatttttctttaattcctatgacaatctgtgagacagatactaattattcctattttacatctacagaaatctaaagtttagaagaattaagtaacttgcccaaggtcactgcctgagtaatgacgtatctgggtctagaattgaagtcactctacgaaaactccacgtcattttctcctaaacgaccttcctatgaaggcaaagacctcctctgccttaatcatctatctctgctcctacatctagtacctagcatctgctttctatgttgtatttaattaaatatttgttaaataaaaatggaagaatatgcatcatgtatttgtgccactaggttttaaggtgtacagttcagtactattaagtatattcacactgttgtataacagtcatccagaactttttcatcttgcaaaactgaaactctatacccattgaacaattccccatttctcctccctccagtctctggcaaccacctttttacgttgaatttgcctgctttagatacttcatataactggaatcaaatagtgtttatctttttgtggctgacttcacttagcgtagtgtctgcaagcttcatccatgttgtagcatgtgacaggatttccttgtttttgttttgttttggtttttaaatagagaaggggtctcactatgttgcccaggctggtctcaaactcctgggctcaagcgatcctcctgcctcagcctcccaaagtgctaggattacagccatgagccgctgcatccagccaaaatttccttgtttattaaggctggaaacactacattttatttcccacgccaagtttcttaaatgacccatttcatcaagttgcttccttaaaactctctccttatattagttcgttttcacactgctatgaagaactgcctgagactgtgtaatttataagggaaaggggtttaattgactcacagttccgcatggctggggaggcctcaggaaacttaagatcacggcaaaggtgaaggcgaagtggaagcaaggcagcttcctcacagggcggcaggaaggagaatgaatgcaggaggaactaccaaacgcttacaaaaccatcagatctcaagagaactcactcactatcatgagaagagcatggagcaaactgcccccatgatccaactaccaccacccagtctcttccttgacacatggggattatggggattataattcaagatgagatttgggtggggacacaaaacctaaccatatcactcctttaattcagcttcactctcggaagagctttaatacaatgacagccaccgctgctacctgttgagcactcacactgcgctaacggagcctctcacacgttttcacagaaacttcagggttatgactgtgatctgtagatgagaaagttgaggcccagggagattaaacggcacgttcaaggccacactgcttccaagtgcagcaatctggacctctgaccttccccagctccctctgactctacagcctgttgtcagtcactaatctttactgccttccagtgagccttagagatgatcaacacaacagagagcgacactgaggcccagatacatgaggtgacacctgtggctgcgctgcccattagctacagagctggggtgatgcctcgaactcacgatgcctggcccagggctctctgctccattccacttgcctccggcccacgtgacctctcccccaatccacatcccatggtttcctcaagatgcagctcaaggctcacttcttccagacagtaaaatcctcccacacgcactcccggtatttcgcttctcctttgctctgctggctgaattcggttggacacacactctcatagcagcatcatgtcctactctatgatcttccaaggaggaaagtgtgttccccttcccatcccaccacctaagagtgtcctggaatttggcagggcacttgatgaatgctttttgactggctatgccataaatttatgcaatctaagagctgggtgggccctgccttatcacacttattttccaggtgagaaactgagacccagagatgtgaggtcactcatgtggttacagagctaattaatgaggagccgagtccagaacccagtcttctgtcttctaatctgtcctctcctgctgctgagcccatctaaccaggattctttatcattttgcagcacagagttgtgccctaaagcctgaagtgggcagacacgaggaaagaaaggttaaattctacatttagtcattttaaggagatatgaaagtactacctttttatttccatagggaaaaaaagatgaaaaggaatactgaacagaaagaaaggaataaaaagcaatgcaaattcctagtctttatccacatattaaataaagacactctgtccttctccctctgtcccctcccacctcaatattgcttgctccttaagacgggccagggaaaatgcaattctctccagagtaaagtgtgaaagactagagaggtgcattaacattttataacctcaaaattcttcaataaattaacattattaaaggatatctggttcttcagtaccttgaaaatgaaatgacaccttctagaaaatatagattcacctcatttgcaggtttgctgtattgttagagccatctacatgtccctttccaataaaaagaaaggaagtcatacacctctgaagcattttatagttaatgaaacacttgaacacattatttttttttgatgataggtcattatgtgcttattttttgacattttaaaagttttattgtatgtttaatagacaaataataattgtacaaatttatagggcatggtgtaatgtttgggtacatgtacacatttttatcccagtaagatgtaaatctttggagaaaacctgatgcagatagaagaggcttctgatacatattaggacatggatgtcagtttttctgatttttttttttttgagacagggtctcatgtcgcccaggctggagtgcagtggcatgatctcgggctcactgcaacctccgcttcccgggttcaagcatttcttgtgcctcagcctcccaagtaactgggattacaggcatgagcccccacgcccagctaatctttgtatttttagtagagatggggtttcgccatgttggccaggctggtctcgaactcctgaccccaggtgatctgcctgactcggcctcccaaagtgctggggttagaggcatgagccaccacgcccggccagtttttctgattctacttactaactcacacttacccaagagttgtcctcttcaccttcttagcctggcttttttttttttttttctgtactgccctccagaaggaagacaatcacttttttttttttaagataggtcaacagattttaatgtgagatagtatgaaaagttcacttatatggtttcagaacaccttataactaacctataagaagctaacttaattctagggattaaataatggaagtattgaatatttaatcaatcaacaagtatttattgggagcctattgtacactgggcactattctaggccctagggatataagattaaacacagcagggggagtttccattctcctgaggttccacactagggccctttcacggatgagacaacaggcaaattcaaattgaaaccacagtgagatactaccgcccatccactaaaatggctaaaatcaagaagacatgtaataacaagtggtagcaaagatatggagaggtactctccgtattactctcatatattactggtgggaatgtaaaattatgcacccactttggaaagcagtttggcagttcctcaaaatattaattgcatacttaccatatgatctggtaattccactctagatatacacttgaaaaaaattaaaatatatttctatataaaaacttgtgcacacatgttcacagcattattcttaatagctaaaaagtagaaagagcccaaatgtccatcacttgatagataaatatgcaacattcataaaatattacttggcaaaaaaagaaaatactgatacatgccacaacatgcatgaaccttgaaactatgctaagtgaaataagtcagccacaaaaaagcaaatattttataattccatttatataaactgtctagaataggcaaatctagataaatagcagattaatggttatctagggactggggggctggggagatggggtatgactaatgagtatggggtttctttgggggtgataaaaatgttctaaaattgattgtggtgatgattgcagaactctgtaaatatgctaaaagccactgagtagtacactttaaatgagtaattatatgttatatgaattacatgtcaaaaaagattgtacataacatagtatgaagatatactgagaactagtggaagatgatctcagcagtttgttctcatgctgctaataaagacatacctgagactgggtaatttttaaaggaaagaagtttaatggactcagttccacatggctggggaggcctcacaatcatggcggaaggcaaaggagaagcaaaggcacgtcctacatggcggcaggcaagggagcttgttgaggtgaactcccacttataaaaccattagatcttgtgaaacttattcacttccaggagaacagtatgggggaaactgcctccatgattcaattatctccacctggccctgcccttgacatgtggggattattataattcaaggtgagatttgggtggggacacaaccaaaccttatcagtgtgtgggtaggcaactggcctgggcaccatgttgctgtttttcttctgtaactctatagagaatacccctctggggaagtttctgggccaaaaattggtgacagatagtaatcaacagatattgctcagactactgtaggaagtagaaagcttagcgataacagattttcctggcaacacccacccactaataagatttacagtttgctagagtggcaccagctgtatgaagattcactaaaatctcacttgagataggcaacacctatctctaaaccagaagagacaggtatttctttcttcttcctctcctcatgtcacctcctaacctccacagtgcccatgttgagttttagaattggcatttagagcaagacatagattcttggtgggtggcctcttgccagctggtcctgcccccctcctcgctacagatcacaagtgttggcctggtttctctcaccacaaacagcagtatcaacaacctcatccaaacttcacgtacctctttaccaaactagagctaatcccaagtaaacagcatttggacttcagaaatccggttccacgtttgtgtgaatgacagattccccaatattttagcagggcctcaccctcagttattcttttccatgatgacagttctgtatcttactgagactaataaattactgtccttcacaacagaggtacacaaaaggcctcaaacgatgagctggctaaaatgtagctgctctgttaacaatgatggaatgctagccatgacatatgcatagcaagcaatttttcctcatcttcaccaatgggaaggagctagcatttggccaagacctttgataagtgccatgggtcctctcacaccctcagacatgaatatttcggggtaaaccaggtacctgggtaactttctcatgtgctattctgccacagcaggggcaactgcccttacagtcttgtcccagaagaaccactaacaacttgaagtttccatcagtgagaaacgcacctgccacacagaccactttctagcatcactcacacaaaggttgtcgatgtttggaccaagttcgccagagtattttttcatttggttgaagttgttttcaatgttttccagtgactggaggtcaagtctggagcagtggcttgtattaatagatcctttgtgagggcagccgctgaaacgacacttcaactcatcactgacaagggaacagaaaacacggccaagtcaggttttgtggccacccctcaaactggccctgaaaatggcactgattctggagatggccaaatgatttaagtgtgcatgcacgtgtgtgagggataatcttggttcctaatttgggcgttttgaattggaaactttgccggacattgcctaaatcaacggtcaaagagtacagtttgttttttctctgagtaacagatatcagtttcctaaagctcactgcctttcttggaggagggaggggaggcctttgccaactttgtctacctccacgctttttgggcttactttctaatgaatgggcaggtctggggcatcttttaccacattcagtccagaaaggatctgtctgtctcatctaacctaaagcctggctcaataatgcctggtcaagaggctgggtctcacccttcggggctcgtttatataatgagtgtctctgggttcagatcttctcaataaaagatgtctgcctagcacaatccttctgaaatttaatggctgcaaccctgacagccttcaggctgggaatttatccgacatcaaatgaacaggcagcaaacaggatggagcaatctttcccaaagtgtgttccatggaactccagggttccatgggcagttaagtttgggacaatgcattccacccctgtcttatttctaagattctaagacatcatcagttttaagctcctcatcgatttaatgttttttttgtttttttttttttgagagttgaggagaagacgacacctgattataagtaatatagttttgtttttaacacacagtaagagcctacatttatctagatgagcactcaggatttcttctttagtatctcagttacagtttgcatctaatcactctttgccatctgagtctaagggttcactgagtcacttttgaccattagaagttatatggaatcttagagggacaagttgcttttcataaacttatgatcttggtctcctttgtatccttagaataaacaacataatgttgaatcctgtaaagaaatattcaagtttcatgtgcctttttttataagcttattgtttcatattttccttaattgaataacgtgactgaaaggtattgactttgctaagtgtcagctggaagctcttgacagattcttggagatggagtgatagttcttcataatgggggaatcagcattccaagaactgtcaaaccaccttctccgcacagtgaagcttccacgatccattcctagacatttggcaatctctgttgcctttaattactgcccggaatatgtgacaaaaaaaaaaaaaaaacctgcttttataatgctgattcataacaatgtttttaaaatacacattttggaataattttagatttacagaaaagttgcaaagatagtagagtgttcctatacaccctttacccagtcctctgttgctaacatcttacattaccaaggaacatttgtcaaaactaagaagcaaatgttggtatgtgactattaactaaaccccaggctttacttagatttcacccgtgcatctacccacgtctcttttatgttctgttctgacaacaatgcattcagttgtcatgttgcctcagtctcctctgctctgtggcagtttctcaatcttttcttgacagtcttgaagcgtcctggccaaatgtactgtacaatgtactctgatctgtgtttctctcttgcttttctcaagactaaatggaggtatttttgtaaaaaatgccacagaagtaaagtacccttctcattacatcctatcacaggggacgtggcagccacatggcctcacttgtgaagctaacctgatcccttagttaaggtagtgtttgccaagtttttccactgcaaggtgtagcaaatgaagggatctaagttaaattcaactttggtggactccctattttaagaactcacctgaggtgccatcaaatgggcaagcatgtacaaagactggctaggtccctgcatcttgtgcaggcagggacaacctcagcgtcctggccagggccgggagctcattggcgtgagaagccagacacactcactctcagggtctcacccgcatgaatcttgcaccccatgcacctcatttaacttgctctatgcccatccccgcttctgacactgattccaaagtttactctaattttagaaacattgaagtataaaaacatgggctttttattttagaatcaagtgtactgtaaaggttctgggacatcctgcagtaaccttatttaacctacagtttcccaaactaatttgatcacagagtcctcttttcacttaaggccctttcttcacctgaacctatgaatagaggggaaggaacagggctgagccagctgaatctgctttgagtcccagctgcctgactgtggcaagcttcctcataaaggaatgctcttcagagcctctgacatcctcagtcacaattctgatgcatttaaatgcatttctttgacctctcatacacccctgggaaggctctgcttgcacgtctgtgagctatgcacggatatactgacagtcctatggaagtggctgacctttgtcacgatatccgggagtaaaaatggtccagacaggcaggtaagcatgcgaacactgagttccaaaatcgtatcagagctgcctgctcattggaccactgtgaatgaggatgggctcaccccagccccctactaacctttgcatcctttaactgccaggactcatacctgactctaatagaatgaacttctgttctctgatactacatcttaacgtcctctgaggaacactgtagtggcaggtgggtaagctgaaaatttaggaagcaaattataatagacatcctagccaacctcatttcacagttctgagcagccccagtggagcaatcttcctgttcggaggatcacggcaacacagggagtaatcaccatttcagcccgtacatgggaggccagaaagggagatcctagtgtcatttaggcccaggctctgccttggctattgacaaggtcttttagggtatggggttacatttttgtcccactaaatgacagcagcatttggtgggtaacatgcatacataagcgcatagggccatccatcaaatcaacaattcatatagtgagtctcttggggaagacattcccacgttataggaacatgggccttttccattatatgagaaagtgaacttacagatacataagggcaactattcctttcatttttaaaaatttgtcaccttttaccaaaagaagagtggcacggtagaaaatgcatgagacttggagttggatatgcttgggctcaaatcctagttcctggggcaggtttccttttttttttttttttgagagggagtcttgctctgtcaccaggctagagtgcaacagcgcaatcttggctcactgcaacctctgcctcccaggttcaagtgattctcctgcctcagcctcctgagtagctgggaccacagacttgcgccaccacacccagctaatttttgtatttttagtagagacggagtttcaccatgttggccaagatggtctcgatctcttgacctcgtgatctgcccacctcagcctcccaaagtgctgggattacaggcgtgagccaccgtgcccggcccctgaggcaggtttcttaatttctctgagcttcagttttctcatgggtaaaatggggataaaaatacatacttgacaaggatattatagagctcaaatgagacaatctgctgaaatatttttagcctggcacagagaaaattagtaacaaacatggaattccctttcactccaagctccctttacactagggactgtctcatggttgataccagatggcccggtctcgattctgcacaagcttggtactctaacaccccagttttaggaaggcctcaagaacaatctgcaggggcaggggacctttctaatgatcccacacactctctggactgtatgggatcattaggaaaaacaggtatcagcgccctgatgcaagtccttctgaacaatccagggtttagcaggaggccaaggtgtttgatcctctctggacattatcatggctggtcttccttctgttctccgtcgacgtgacttgttagcgttaacagtgcctgtgggcaggaattaagaggacagcgaaaacttgctttgctagttaatgctctctctgctctcagagagggtcgagagacaacaaaggctcattcctgccagaaccaagaacccccacctcaactcccaactcctaccaaacattagccacccatctgaccctcatagacgtctccaagatcgaaaaatatcctttggcaaaaacgaatcattggcaatttggttattttaactacttctgtggccaggagagaaggatgagagtttcagctggatataaacagaagcaggagcttgaagaggatgagagaaaatgaagccagtgctatgatacagtccaagacagcctggtttcagttgagctgaggagaaactgaagctgatttcaaacgagtctgaaaacccgcatccctgtgctcccctcgcatagccactggccttcccatcctccgtgcggtcctgaactgaccatgcactcacaatagcacattcagggctggccatagggagccgtcttcgtgcaaggcaagttcttgagagaggagtctgtgtttatgaaggttaattccaggctcagccaaaggccacctaaggcacaaatgctccgagtcggttggggtttgtgtgttccatccgctgctgggcacctctctaggatgcgtatttctagtcagtggaccgtcctaaacatgtgaagctgctgacagatgaaagctggccttgcttgtggcatccattcttcagggcttgtacctgctcttataaggaagtagaactcagagagcactcactggcagcaggggactggtcctacactcacagcaatgtcccgactcggtttcagtgatggcttcaatgtctcattttgtgtcaccagtgttgatgaaaccttgacaaggcaaagcaaaacgacaagcacgccctgagcagagccccgggaattcaacctttaagtggataacttggcttctggtttgccaaggaaccagggcatcaaacagatgaaacagcctattgtccatttcaacaggatttttcaggagtggggatgatctttcaaattatccacaacttaattatttaatattttgatagtcaattacctaagacacggcatcgtcactgaccaatcagaagagatgccagtagttgggcgcagtggcagcactttgggaggctgagtggacagatcacctgaggtcaggagttcgagaccagcctggcctacatggtgaaaccccatctctactaaaaatacaaaaatgagccaggcatggtgggcacctgtaatcccagctacttgacagagtgagcctctgtctcaaaaaaaaaaaaaagaagaagaagaagaaggagaggaagaagatgaagaagagatggcagccacagctgggagacgggtcctagaaatcccccgtagtgcagggcatcctccctgtttgcttcttggattctgggaaagtcctcggtggcaagcctgagaggctgggcaaaggggctagagcagtggctattgacctccagggaagaggcattctatggcctgaacaagcagcaggcagcaccaggtctgggtgattctctgtcctgcagtcgtgggagatgagggcacgtacacgagggaagaagcacagaaaagaagcctctgcaaccttcgcattttttatcacactgtgttagtacccaggagactttagccttcccaaatctcactggatcaataacttcaggaaaaagaatttccaggagccaatttccacattagtttaggtgccgggaggtctttggaaactcagcccgagacacccggagacttctagtccacccccggggaattcagttcaatcctctgaaacactcagactatctcctctaggcaccgccagctcaggtttctactcagaacacatacatttgtgtctggggaaaggcaaggcatgaaatatacttcactgaaaggttgaaaagcatggagggtaaagttaattttcaaagaagaaaggaagtcaacggcataacacaatggaatgtgtgattcacctctgcagggcagacattgattttcccaccagggagtatcatcgaattagttggcagttgaaaatatgatctctgacttttttttccattccccttaggtcctacattttattttaaggccatgaaacaacatgagattaaaagtgtcatccagaaacagaagtggaaaagatgcagtatttcttttgttcaaagaaaatatttttgaagttatttcacaactaaaattgcaatgacaggtgtgtgggtggggtgcatgggctctcctcgcttggttcatattggacagaggggaagcctgtgggcttagggggcacagacccctcccatgaagagtcagcatcagggctgctctgggtgtaacccaggtcctgcaccgtttccagtggctggtgtcctgggaataggcatcagttggaagccacaccttcaccctgcgggggatgaggagggctaatggtgggagaaatcattcaggtaagaaatgttctcccacctcctagatgtgtggctttgggtgaggtgctcaactctctgagccacagctttcagagctctaaatggggactcataatttctgctatatctagatacatgtaggtctaggtttaggtgttctgatgcctaacattttgtataccttctttaagaatgccaagttgacaaatgcagaaatgggaacagagttttcaaaggggctcctgcaagtggaaggccctacagtttaagtctcgttagtgtcatggtgaatctaactttgcacacctgcctatctcaaataagaggtacgtatataaatgtacatctcaaactataattatataaatacatgatgttgaattactctataaatctgtaatacttaatgtatgctatgtgaggtgcaggaaataaagctgtgcaggagacatacaatcccacccgtatgaaacctaaaatctagaggcgttgcattatcatctatgggaggacatctattcagaatgtcctctgaatcctgaacttggaagtgaggcagatcacagtggaatggcttgattgctcgtctgcagcactagcccctctcagggctctctgaggtcctgatgccacacctggctttctgggcggtgagctctgcttgacctctgtctctgccctctccttgccaatcactgccttctcactcactctcattttgaaaccctcacagcaccaggccagcctttttattttattttaatttttattattttgagacattctcgctctttcgcccaggccggactgcagtggtgctatctcagctcactgcaagctccgcctcccgggttcacgccattctcctgcctcagcctcccacgtagctgggactacaggtgcctgccacagcgcccagctaagtttttgtatttttagtagagacggggtttcaccgtgttagccaggatggtctcgatctcctgacctcgtgatccgcccacctcggcctcccaaagtgctgggattacaggcatgagccactgtgcccagcccaggccagcctttctaacctttattttcaaacaggaatggatagcggtttcctggggaggcgggggcgacagtaagagaatgagggggtgacagccaaggagcatagttttctgggggagggtaattaaaatgttccgaaattgattgtgatgatggatacgcaactatgtgactacagtaaaacccagtgatttgtgtactttcagtgggtcagttatgtggtatatgaatgatagctcaataaagttgttaaaaatatgaacggacaaccaagaagcatctaaaattcaagaaaagcttggagcaagagaaagcagaattaataagcagggggaaaaatgaagaacactcagttcattcagaaaaaaaaaacaattttttaaatgaccaattatcctttgagagactcaagaagatgctgcatccacaaaataagaatagggagccatgaaaaaggaactatccaaaaacaagaaagagttcttgtgaattattaaaacaataagtttcctaagagataaaattttgattaaatgtctgcacaatgaagtcagggataatccctagagcataaagcaaaaggcccagacactagaaaaagagaagtttaacatgtgataaccagcactttcagagtgaaagaacagaaaaacagaggaaataaaattaaaaaggaaaaaatagggaaaacttttcccagagctaaaggaagacaagaatgtttaaaataaaagggtcttgtaggaatgaaaaagatacccatgccgaatacatcagtgtgaactttcagaacatcaaagagcagagcagagcctaaaaccttacagaaaagataaaacgggtgattgacaaaggatccagaagccaagaagcatcagaaataacagatcttacgagaccgtgtaataggcttttgaaattttcattgaaaattattttgaatggagaattttatattctaattctccaccaagaacaagagtactaaatctcaatctaatagtgggaaatcaagagatactgcctgaagttgatggaacaagaaatagaaatttcaatatagtgtttgaggtgtcacaggttgccaataaaagaattaaagtactattaccttcatggaaaaagagatgtagaatagagaaaagaacataataaaagctagatctttatttttcatacctaggaatggaccacttcttcagttgtaagaaacttaaatctaaaaatactacatagaggtaataaatataactctgagaagtattgaaaacagacatggttaaaaaaaaaaaacaaagttgcagctaaggagcaggtctgaaaggaaaagggagggatcccagggggagaagaaacccactgctttttattttaaaaatgagatataaggccaaactttttttttcaactaattaacgggacttttaaatacagatcctagaagcagtgcagagagccaaggcttggcatttgggtagctgcgcacttccaaactatactgcatgaaagcatttcacagaccgtgagttgtccagttacttaactttgggagatactgtcattcttgatgtcccttttacagattcaaaacatacattaagttattaaaagctctgagaagttctgtagaatataaaccattttgacttcatttaaatacaggtcaatttgctgaaagaccaatttgatgaactgttaatttgccgatgttactaaatttaccaacttttttaaaataaagatttaatactcacaatgggattgttttcaaagttttgataggaatgtgcaagttgcaaaagaaaattaaatagccaaaaagtgagtagagcacacattaatataaacagagaagattttacaaatgagatttttagactacttctggtttcttttggacatttctggatatcatttttaactttgcttaaaattttaagcattctaaggtttactttccctcatttcctccatgacctactggcctttattgtgtatttctaacaattaaacatttaagttaaatgtaaattcaaatgcatctcaaggacatcagaattttaaattaacttagatctaattcaaattctaaacggacggaaacacaaaattaaggttaaactatttacaaattggtgaaagaacattaaaaattctttacaaaataaaataacatttttaaagcatataaaaaaataaaatgtagttgaaacaatcctgtcacatatgaaatgccaaaacttcaggtagaaaaattgtatttcatataggaattgttcaaatgatgccgaattctgttgtcagccttccagcattttagaattttcttttctactgatacctcagacaggaaacatcttaatattagttaatacagtcatgtgccacataacatttcagtcaatggactgcatatgtgataatagttgttccacaagattatactggagctgccctatgcacctatataattttaaattttatgacatatttttgccctattttttctatgtttacatacacaaatacctgccactgtgttacaactggctacagcattcagtacaataatgtcctgtacaggtttgtagccaaggagcaccatatagtctagttgtgtagtaggatttcacaatctaggtttgtgtaaatacatttcatgacgattgcgtgacaacaaaatcatctaatgacgcatttctccgaacgtatccccattattaaacaatgcatgactatattcagaaaagcatctttcattgtcagcaaaacaggatcaaacacttagtagacagggctactaaatcgtcatgggtaaatgtgcatatctgaaaactaggctcttcgtggacttggtgtacagtgaactggcttttgatgaattggctttccataattgattttcggccaactgacctgaagccattttacttaacctagcttttcccaaattcatttgaccaggattctcttttcatttcaagtcaatggaacaattatcctgacagaacacactctggaaaccactactcaacaggaaggaagtcatatgcttgtactacaggccctggggaacagcaagccgactttgataataataattagcaactgctaacaggggaattaatgagaaaagaaacttaacttatatccagatgccatacttctataaatcggcagactatatattctattcactcatctccactggtgaaaagttccacgttttatattaatttttattttacttttttttagagatggggtcttgttctgttgcccaggctggagtgcagtggtacaatcaaagctaactgttacctcgaactcctggggtcaaaagtgatcattccacctcagcctcccgatgagctgggactaaaggtgcaccctaccatgcccagctaattttctaattttttgtaagacaaggtcttcctatgttaccccaggttgatctcaaacttcttgcctcgagggatcctcccactttggcctcccaaagcactgagattacaggtgtgagccaccacacccagcttatatgtatttttttaaaataaaaacattttaatagaaaattcatgggtgggaatgaagtgtttgtgttttttctctctcatgttctttgggtctgagaaagccttacacagcatgcttccatgtcttaatactctcccactcatgatggctgctgtgggaactgccagcagtgagggctggtagggaagaaagcaacacaggccagggatcacacacttacgagcccactggggtagacaggatgtggacgagtaaagccagcctggtggggaactagtggagactttggcaaactgacagagaatacgccaggtttaagaaggcagctgctacccagcatagctacagctgctttggggatgtggatccactgtaccagtcttctgattccccaggcaaaactagaaatctaagttaaaaaaataaaataaaatctcctgctttttagaagttagcaaatatttcattaaaatatccaccatgtggctaatcagaaatgtttcatatacatgaatgtgtatatatatatgtgtgtgtgtgtgtgtgtgtgtgtgtgtgtgtgtgtgtatgtgcatatacatatatgtgaaacaaagtaacatcagttgtattaccttaaaccaccaagttacacaaaaaattataagcaaccaaagctatactaactcctcaggatgttgtcttggaaccagtcggaggaaggaaagggtatgtgtggtcctaaccttatggaccacatgataactcatgacaagagaggcagtgagaattggagctgagttagtttgttttgtactttatttgtggctgagactaaagaagttttggaggattttgaaactcagaatctgaaagctagaagggacattacagtcatgtgggcaacctcctattcaataaaggaattatttgggtacaattccaacaggttgtcaactagttgttatgtaaacacttccaacgatggagtgttggatgctccattattgggtacctgaggtgttacaaactgttcttcctaatttgctggcatgaaatgtgtctttcctcaattccaagtaacaagtcctagttcctcctcctctggccaggaggaaaactcttcttccttcctacaagacagccttttaaaatgtttggaaatttacagcaggtatccctctccttcacagtcttttaaccttgtgatgaaatacctccagttctcatcagccatttctcatcatatggctacagaattcttctcatgatggtcatcctcagctagaaactgtctagacggggtgatggatacatgtaccccatcctttgatgttgatactatacttaaaataatgcagcctaaggttggattagctttactgcactgcactgttctctctggaccccccagatatatgttatgatttttatgttgtatgaacgaagaaatccaattcaaataggctgacgaagtaaaaataaagtttatcagcctaattgcttatgcaactcaacagtacaggagtaaatgcggtctgaggcagtgtttaaacaatgtgatcaggatccggttttcctctttccatttctcacctctacttccttggtttctttttttttttcttctgatctcttttagtcccaagaacgctaacggcctgcagtcttagggttctatgctcccttagttatgagcagtagtaaaggagaagtcttctttcttaatagttcgaatgaaaggccaagaacggacgaccatcacggctccaacatgaagccacctggctaacatgggtcacatgaccagggaaacatgacttttctagctttagccaatcacagacagactgcctctgtggtcaatcacatacacacgacatggctaggacccatttgaagttatattaagaaagaatgcagaaattaatgttattggaaaaaccaaaaataatctactaaacactagaaaaatttctccagcctattattgaattttacttccaaatgaagacttttccgtgtacccctactcactttgatgccaaatgcttctgattaaggaattaatttgaactttggttcagctctccaaaagattcttctctgctttgaatcccttccatatttgatatacataacttctacgtattcttctcattaagtctttgattaatgagaaccattaagaccaaaaaaacactgagctttgaggcatataccccactgcgtatttccccaaaggggtctatcaatctgtgaaagactatggttcagaaatagctatttaaaaggtataaattaacctcactaactcctatttttccatccataggaaatgtgccaggagacactatcaaatgccttgctgatatcaaggtgcactgtttctgtagcatttccaaaataaatgctacattttgtagcattctggctatattacttaatgcctgtagccagaaggagatagcacacaggggaactggagaacctccatagagtatgtcacacactgccatcaggtacatcaggtcctgacataatttctttgctccaggtaggacctcagctgctttctagagatccatcttttccttttccagctctcagacttcctcctaaatggctggcttgtgctctggtccaagtgggtcctgctgttcccttggaaattctaagaacctgctcttgcaaagctcaatccccagtgcataacataatggcggagagctgctgcttccttctctctcatgtaattgtcctttcatcagtctttttattggattctctttaccatctttgagtcgttttctatctgaaatgtttattagactatttctgagtggaatagtacagtggacatctattcttctggtttgtccagagttcacccaccctcctaggttttcaagaatgtctgtcccatttcaaacctgcatttttggcagggctgccagcacctcatctccctcggtccaggcagggttgggtgtgagacccacaaaggccaaagccatccatcccaaatacacagtttttaaatctggagctggagggaatagaactttttcttttgttatacagatagcagaacatgaatggggtgggggggaagaagctgctggaagccatctgtctcaccacgctgtggacaagactgtgaggaagaatgaggacagcatccaggaagggaaggaaggagggagagaaaaagaacgcaagagcaagaaagcaaaggagccagacgtcagtccgacggcccagactgcatccctgaattccatcgcagtagatctgtggctggctgtgcagtgtgtaggcaacagattctactctgcgtgaaggtgctcaggtggatttctgttacttgtattaaaattagcatcacagagtcatatggtaggaaaacagaatggtatagtggaaagaccactagagccctctgtagtgtagtaatagtttatacttttctaacaaagccaatctgggttcaggctgactcaaatgctttaaaaaattatagccaaaataaaataaatgaatccatggcctgagtttgaatcttggctccgtcatggagtgtgcaagttactaagtctcagcctcagcttctgccacagaggacaagagaggttaacatccttctcactctggctgtgaggattagaaggacaagcaagttgcttggtccacagtagcctcttaataaataacagcaattacttttcagttaaagaaagttgaaaggtagagtccttaaagtcctttcacctactcccctagaaagatgatgctaaccaatagctggcagatgcttttatgattgttgaatccagtttatctcacgttgggaggacattacggtgctatttccaattacaggtgagagcagatttgttcctctttcatactgaagggcagtgttattatgattggtgtcctttatgcaggaagagcaatttccatcatctgtttccctctttgcagagcagggcactgtctccactcctctcactactcccaagcccctgctctctccctgttcaaaggctatggctggccacccttgctacttcagttccccagaacctggctgggccatttcccttaacacatctaacaataagaatagtacacatttttccattctatctcacgagctcaagagctttatactaaccagcccagaagatattttccttgctctaaataactgtaattttgggggtcatttataccccactttttatttctttcaaggacctcttactgctcattataaatgccattatccttctctacaagcgatcaaatattataaggtctgacaagttagttttatgtttgcattgtaactgaagtcccatccatctatccttcgggagtttctgaaaactctatatgaacttcactcaaaatacacaagtagcatgtaagcgtgctgatcatattttcaaaattatgaagtgtgtcctttacataaaattaaaatgggttttaatgtgtttgagtcattcaaagttttatccttcattacccatttttcaggcccacctgatttcttttggctccctacaggggaaatgggatttctttttttcctactttctcttccacgaggtgagaaaaagaaaagagagcagcttggtagctgcacggaagccaaacaagagactgattcaacaggagaaattcaatgcatcccaaaagattccctaggaatttggtatcctgctgcttagagtacaatttgttgtaataagaaactgaaaatttttctatcaggaaagtcaaagtgctcagtgatggcttgttcaagttaaaaaaaaattgaactacaatggaaaatgtcttattctggaaatgctttcacaacataggaagcctaaacacaatttctcaaatcatatatattgctcatacacactggtcaacacaaacaaatgttttcctgttcaggtgacctagccccatacatactggtgaaccacaaacaattaaatgttttcctgttcaggtgacctagtcccaggagtggagtgtggcttccatcttattccacaaggaagttgtttatactgaaagtcaggcaaatgcaacagagataaagtctttttttttttttggagacagggtctcatgctgttgcccaagctggaatacagtggtatgaacatggttcactgtagcctcgacctccatgggctcaagtgatccttccttccacctcagcctctgagtagctggaactataggcttgagccaccatgccgagttatttttttctgtgtgtgtgtgtgtgtatttcttggtagagatagggtttcatcatgttgcccaggctggtcccaatcctgggctcaagtgatctgcccaccttggcctcccaaagtgctaaggcctacaggcatgagccaccttgactggattttttgttgttgttaagagacagagactgactcttaacccaagttggagcatgtggtggttccctgcagcctcgaactcctgggctcgagggatcctcctgcctcagcctctcaaatagctgggactacaggcaccaaccaccaccacgcccatctactttttttatgtttagtagagatgaagtcttgctgtgtcacccaggtctgtcttgaactcctgggctcaagttatcttcccaccttagcctcccaaagtgctgggattacaggtgtgagccactgtgctaggcccacaaaaggtatttcttatgtcctggcctgggttggtggctcaagagccaagcaaggtagacggggaataagtggggttggtccacagctgtgggattttggagtaaagggaaacaggtatccttgctgcaggtagggaggagcagcagaggagaatgtagaaggtagacagtgagcagagagaaagtatatgagccagaatgaaatatctccaaggaggataggccagacagaaaaacaaatggattctgaagacagatcctggaattagtatctaaaacattagagttcaggaagccttttaggaccacgagcatctatgggctgggtgaaagctatagctgggaacttctgttttccttggatactgcaaccaaggaggcacaggactggggtccctccaggttggacaaaaactttcactaggaagttatccaaaggtacaaagtagattctagtggctccctcctggtctgaacttttcccagtagactactgctacctagaatgactcatgctgttacaggaaatccagcagctccccttagcacatggttcttgactgggagcttgagtgttaaaagaggggattggattatcagaaagagcaggatttggtgaaagtcaaatggaggaatttggcatcgggaggatattttacaccgtgctttaagataaaggtttgaagacctccagttaccttgagggggtttggggggcagatcttccaacttccagcagagatgagttatgtgtatggaccaaaaggggagtcaggtggcactgccacttaggagagttctctagaacccagtgttgatcagtgtacttcttaccagaacttgggcctctctaaggtggtaatagtgcaggattatcacttctgatttgaaattaggagctctgctatttaccatctttattttatttattttattttatattatttattttattttgagacagggtctcgctcagtcacccaggttagagtgcaacgacgtgatcacagctcactgcagccttgacctcccagactcaagcgatcctctcacctcatcctccctggtggctgggactacaggcacatgccacctctcccagctaatcttcacatttttagtagagatggggtttcaccatgttgcccaggctggtcttgaactccaggactcaagcaatatgcctgccttggcctcccaaagtgctgggattgcaagcgtgagccactgtgtccggcctattcactgtcttgatgacagagagaaaaggtatgggtttccagggtcctggcatagccagggaagagtataaaaatgggtaggaattatgtataacttggggtttggggggaaaaaggaattgatatccttgtcccaggtaaggatgggaggcaaaggaggggcagaaatgagaaatgcaagtggaatcatgctgtcacaggtcgccctggccagatgtaaagccactaacttcatattacaggctttcttggctccaccccacacggtcctggggctctcagaaatgccactgcacaatttttgttgatacttaatcacttggtcagctgtaactgtgtataaagaacccgaaagtgttttaggcagattatttctcagggcagaacctctattttacacattattttatagtaaaggtaggtgagagtttaagtttgattctaaagctatcccaggctgggttcagtggctcacacctgtaatcccagaactttgggaggccaaggtgcgaggatcacttgggcccaggagttcaagactagcctgggcaacattacaagaccctgcctctacaaaaaaaaatttctttaattagcttggtgtcagggtgtgtgcctgtggtcccccctcatctactcgagaggctgaggtgggaggaacacttgagcccaggaagtaaacactgcagtgagaagtgtttgcaccactacactccagcctggacaacagagcaagaccctgtgtctcaaaaaacaaaataaaaacaaaatgaggctaccctaaaatagctgcataaacaaagccatgtcaaatgatgatattcccccatcagtgtcccctggactgctggcttctgggagaaggcatcctctggtggccaactagcacccatcaagctggtcatgagcacagcctccagctttacgccagtcactccaaggcctgagcatgctggccctggcttctgggtacccttccagctcagaggatgacagtgtggagctaaacaggggtttagccatagggagggctttgggaaatcagaggcactagattctctatatgaggctttaaaatagtagaatgatgaatgaaatcctgaaaatcaatcggggacctccaagagagataagtacttgatccactgcagggcctcctactctagcactctaaaaaccttgtccatcactggccaggccggatttggtccagcaattcctcctcaggttgtcaaaggcctggttttctggagatgctcacaggtgcccctcagctggctgttgaaggctatctgtaagctccaccagaatgaggactttgtattgcctgtttcgtttaccacagtgcatttaagtaggtaggtctccataaatatttttgttgaaaaggatgagtaaaagtgcctgacccaggaatgtgagatgtacccattcaaatcaactatgatctatacatccaggaggccatgcagtaagctgagaatcaggtagagaagatgggcaggcttctttagtccaaatgatatctcttgctctgtctcctaccggccaaggcatatctaaaggccatattcgacttcttgcatacaaataagatggaggttcctacagagatctgatttcctaaagccccatgcctgctagcattgatgtggaaagacacacacagacttggggcaggacgacagctgcacagtggagctcataacggggacaggggaggaacaagcagcttctcaattctcttgtctgaaagtggctgtggactatatctagcactcttgctacagggagagttaccagaataaagttcagcagcaggttctggcaatgctgtccagagtgaaacagaagatggggtcctctgaaagatggttgagtagtggcctctactagccaggagtgaaacactatagagatgtatggccaggaggtgacggaaagcacaggctttatgcatgttctgccatgtgcagcagcatgttggaagcaatgaatgggtcacctccccttcccagtaggggctacacatacatcagcagcacccaatcattttgtttcatccttaagacagatgggaaataggcaagctggatgaaggcatggtatgtgaagctgccagatcacctaagcctgtctgctgtcatccaaagctctgtcagaatgtgcaacacttgttcaaatgcctgaggtgacagcaatggtcagaagagctgctacattcaggagaaggagtaggcccaaggcaccctgcctcctctttttcagaggtgttgaagggccagagcttatgccagttccatgcacagagtgtcctagatttttcttccagaagtaagactacaaggctgggtcattctcacaccaaccagtaggttcagtgctggaaccactccacaaagctgggcaatgaaggtctttacccaaacgtacaggtggcatctcaagcaaggtgattagggctaaaggaagtcaaggtactttagaggagtagatggctgaagcagagatgttctcatttctcttgttccaagaaaagaagagccagagaaatcggtcataatgttctccattacctcctacctaaaccctcatattagccttggattatccataaaagtaaaacataagtaatgaggcctaagcgcaagtcagtggtgtaataaatatctactagtcattgtcatatcttctttccttcttcttcatcttccctctttctctattttcccctctttcacctcctttttcattggattttatgtctagattctgcattaagaaagtctttcagaattaaattaaaaggcttatatttaaaagtttttaaaaatgcttgggtcttgacggacccttcgcccatcactgtgcaggtgatcacggccccagtgtcccagtaagaaataaaccttacaaaatggacagcaaacagaaagaggccctgattaggcatgccagataattcagtatttcacacatacgaacacacgcacatacagagctcagagtcttgtatcgagggtcttccactaaagatactttaattgaaaactacagcatggaaaacatgattaagtggctacaagattactgttcactttaataagcagagaagaaaacatttattcatttatcaggtgaaataattctctaaatctcatcagagacaataaatggcaaacaacatacgtggaaagaatgttggatgaagttcagatagttatttcttcttctggggtgagaactggctctgagttgttctctaggtcctactccatgagcatggattaggaaaagttctaaactagatacaacagccaaggacccagcctgccctctaggaatgagcttcgttgtcagagacaatgacacaagcgtcctcagagagcaagctaacaacatctgagcaacaaggagagatgcgggattgggagaggcagacccaaagcaagcgctgggtatgtgacggcatcgaacgcgcgctcaggtcctcccactgtaatacgcacctgggatgcggggtcaggaaggcaggcccaaagcaagcgctgggcgcgtggctgcaccaaacgtgcgctcaggtcttcccactataacatgtacccggcaagctctgcagactcctgtaccagaatgtcacactgacaaaaacccatgaaagaacaactggagttcttcagaaaagcctgcttgaaaacagtagaaggtactgttatgaggaaatctcatagtttatcaacctatcttccaaaccttctcaaaaaaaggagaaaaaaaaaatcccccgcaaaattaaaaacgaatggggctgctatgtaattaactgacaatctctcagttacaaacccctgatttgtaaccatggcaggtacacaaactaccagctgcattatacttccactctctccacctgcccccattttttctgacaacaaagcacagaaaactatctgagctgaaatctcactcttatcagctttcttctccttgatggagatttcatagcccacctcccttgcctctttctctgatcacaacttaagtctcttcatcattcttgttcttctgcctttttcccaggtacgtcacaaaagtgtcattcccaccagcacaaaaatactatttatggacaacaaaattaatatcaacaaatcttaccctataatgtgggctttgatgaaagaagagatgaaggccctaatacgttttgaaatggctttagatcagaaacaacggaagtcaacgtcatctcttctcatattttcttgaggaaagagtgacattttagtgtgtgtggtgggggaggtacaatttggaaatggttatccaaatttaaaataaatataactttcactttaagagcagggggacctaacttttgatgtaccaagttaccacttaggaatttctcatgtggatttaccctatggattcaattaatcatggcactgtttgacacagtacacataaatggaaacgacagagattgatctaaaaattatggcatatccatgagatgaaatactatgtatctgttaaaaagaataaggtagctaatctggagctaatctagacagatgtctacactctcttgtaaagtgaaaaaagttacagaacatgggctagggagttatccttttctctctctctctctctttttcccgcacactaaggaggacctttggcttggcttcccttccttttctctaatccccactcctccatacaccacctcagcaggcatatttaaaagacctattggaaatgagtctttcccccagcaagacaagcaggaaaaacgcagaagtgcaggagaaagtggaagagcccacgtgaacagttctgaagggaagagagttgagagtaactgggaaagcagaataaaaggaatgggggaagcagggctttaaaaaaacattctgtgtattatgatggaaccattgttcatgttttctggcgaaggttaggattactgtttactttcaatcctctgacaccatgctaagacggaggtctatctggctctggaatatattcagaccggccactctcacacggaacatttccagaaggaaacttttagccatgtttatctttaaggagtgggacaacagtttgaagatgaggctgatttttacctttctgtcctcttaaattgtccttccctacaagcatatgttaatctcgcaacagaaatgaacagaacgggcgaatgtcctgaaagtcctcttcaaagccggaaacaccctctatatctccttatcactctctagttccgaaagaaaagtcaaatttaattaatattcgacgcacaaaaattttaaaacaatgtgctcaattttgtatttttctctccgtttttaggggctggggggggaatttatagcccatacagtggtgctatcaaaggctgagtagactttcatgggttagtctggagacatcaccataatctgtaaccatctttaataggaaaatgcatcccaagttctgaactactaattggcgaattaacattagactaagttaaacttttaaataaaatttatgaagtattttaaaattatcttcattctacttcctgtttacaatgctaagggacagatgagtttccatattagtcacatatatatgccgatactatcagaagacatactatgggctaatactaaacattatacattttgttgtatgtgatttctaacttgttttatgaaacatgaaggatgtaatgttgagttgcgtcataaaaactgagtaaaatctattgagtaaaaataaatgagagtagcaagaagggagctgaaggccataatttggattaaaatggaatagcagcactttctcctctaaggtcagcaattaaaatttagccaaggtcaggagtgacaaaatcatcaagaaagacttgacctccatctagttgttgcaaacaatatattaacattgtaaaactgttacagcagatggcaatgcaatcatcccttggtaactcatgcctagctaactgtctgtgtccttggctaaaggtgagcaaaaggcccacctcctgcgtctgcagggagccgatgcggggggctgagagcactcagtgtgaattccctcatgcacatgtgagaggtgaaaaccactgccaacttctccattcctgcctttgttccaaaattgctaacagggttgcagggtacctgacctatttgcatacattccttatttttacctctgcctgagctaaaggggaaaaaggcaaagtatgacaacatctaacctgcccatttctctcaactttgttggttctggtttatttatagccttttcctcaactacagctttaaaagcaaatgattcgtacctcactcatgtgaagtggatcaatgcagattggatttcttgaaataccaccaaaaagcaactcaacacacgccagggaagagaaaccaagggaggcttggaaatttgtcacccagcataagaacacagcacacacttaaagagattgtgacctgccaaacaccatgtaaatataaccaaacgtttcccaaacataatggactgtattctggtggaggacttggcctcacttacaagaaaggcctctttgtttaaagtcagtcaaactgccagctacttaaggtgtaagttagtgcctcaaagaggccctggtagatgtggggaagagaaggttgcaaaatacgtgcagaacagacacccgtgtaggtgtgtggtcttctttatggatgtggtggacccatgtaaagtttctgtgcttaagagtggcccgagcagggcagcctgagtgtcgaaagggaggatgaggcagaagaatcagtgcagcgctagccaagagtgaggaaccagcagctgctgttgggggcctggagaaagaagggtatttttcagtctgcatcttttggatggagtttatccactcacccagaggctgtttggcttcctcagagcaagccctggagttcagagaggtaacgccaaccatctgacctgcctctttttgcaacactaaggctcagagaggaagccttatctctttgaatgcgattcgtattttccgagaacccacaagatcgatcactctgagcaggcatttcactgctcatgggaaagtctacagtctcagccctcaagccaatccctcatacatttgattaaagctgactcacagtctggattccaaagctgttcacccacaggcagtggaggaaaccatctacagaagtcccgaaaacatgctcagggtcaggctggtggcactggctggccagggacctctgccatccgcctggctggtggagcctctgccgtcttcggggtccttgtggactgcaccaagctcctggctcacgcctggcttcctgaccaaacacctcatttctggtttactacctttgtccaaacaaatatcctagaccctggactcacttctgttcttatgttgaccctgggaaattcctctccctctagcgggaacaggaagtaccctggactctcacgtttccacctgctcctcttcgcttacagccattccctgcctgttgtcctacgttgcccctttgggctgacatggtatttgcacagtctgcaaagctgggaaattaaagatctgcccaggttggagcccctgttctccagggacctcctccctctgccatcgctcctggtcacaggtgctttcgaggtaccttcccgccagcaaccttgttctgtgctagagactgagccattcccacctcagattatggtccacatgtctccgtgcccttccccttgggctgctctccgtctcaccttctagaattatgttctcagccgactgcaaatcagggtgcagcatccaccagcgcctaactctcagcagttcaacactacccccttcaatgcttttctgagttataaaaacatctcagggcaaaacacctactggtctccaggagctgagatcagtcaagaagcaattacctatagttccttcacctgactcaaggagaagctgaggcagggccgtctccctgctgtcctccctggctcacaaggtgattatgaaggcaaatgattcaactgaaagcataaatcctgagagagataaaggaccattcttactgtcagccagaccaagggccccatatggccatcctcacctggaccagcagaggctcatgacacagcctctcaagctaggtctgagcctgcgttcctctacagctcccccaccaccctgagcccgtctttgtcactgcaagcgccacatcgtattgtaatcatctgctccagatagagacagcatctaattagtttctgtacacccacggtgtctgacacatggaaggaactttacaaatgatgaatgaatgcataagtgaatgaacaagaggagtgaataaaataagacttggttttaaacaatggttgagaagcagctggaaatgctccatgcaaagtagtaatcagaatgacttcacaacatggatcctttgcccaacgtgaagacgtcctagcccttatgtcagccctctccctgggacttgcctgtatggctccatggtccgagtaccatagaacaaggcttcctccaacaggccgaggttgatgcaggcatccatggcgcagtcgagcaccttcagctggtagatgttgatatcgggaagccgttcagaattgctgcttatgattgcctggcacatggccagaacctgctcccactctgttattaaccttagttaaggattcattgtcttcatcaagaaaaaaacaaacaaaattagattctctaaaaggctaaagagctcccaagcacaggagcgagggaagcacccgttatttttcacagatgagctgcctgaaaacacacttgagaagcaaaagcacagaagaggcatctcagtgaagtgaattctgtttacatcaacaaactatctcgtaaccaggcctgtgctttggagttttaaaacttccaaagacctgttcttgcttcatactcctagatgtgttctctttaaatctagtcataaataaatgcagtcctttattaaattggactaaagattaagttaattcgattttaaattatttactctgttagcttctgtttaaaaactgtttgaaattaaagatgctttagagagattcctttttcaaaaggaagagctcatgtttgcttctgtgttacctgagttttgggcatacatgaacccaaaaactcacacaacccacaggcacacactaggtggagcaatttgaagacatagatttccactgggtctcattttttccgattataaagcaacagtgaccccagcctgtacttaaccaaatacattaaaatatgttattttaaacccccaaaataagagacagtattaggaacatggcttatgcacatcaattgctggcaagggaaacgatgctttaaaaaggatggggagaagactcaatgtccacttctcagtaactgcctttctgattaaccatgagtcagtaacttcatctcatgtagccttggagtgacttcgctttttaaaactgatattccctgtcttacagaggcagtcagaggactgaggacatggtttatggagcgtaattttaatccctccccagtgaattctctgggaaacacagcgaaggccagagtgcaggaccctgggacctcgcagtttcttcactgtgcggtgtgttaggcgagctggagaccaaggagggtgcaggactgggactggtccttctctcactcctgtctcaccttcacccagtggagctccaaattcatctgcttcatatgttgtcattccagtagggtgaaaaggtttgaagatcagaaatggcagcctagcctttgactgtagtaaagctagattcagatctaatcgagtcctgtcatttatcagagttgaggttctgaggaagtcaaagtgcttaatgataggccagaaatagaaatgactcacgtcaacgtaagaatgagtaatatattgtatgtaaaatgacacagttcatgatgtgtcctctcatgagccagggagagttccaggtgtcagagacacagtggggaacatttcgtggcatgcacaaagcacatgctacacaagcattagtgccttccaccttccctctgtgacatgacctctgagcctgactgggcttaaagaaagtggttcagtggactgagtttgactgaactcagtgcccccttcgtgcccccacacccctcccactcccacatgacctggtccctttacaatccatgctctctgtgccatcccctgcccccaattcaaaaccctcttcactgaggtcctaacagagcacgcccagccctgagcagacagctcactgtttatggtcccctctccctctctgtccagcaaaaccttcctcttcgaatgtccatacccttctcagaacacggctttctgaaacattagcaaatacttctaataaaccaatcaagccactcctgagagtggagacaaatacctttatgaactttcacagcaaatgtattttctttccagcaaaggcctcccggagacacagtatcttactccaaaagatgagttccttgatgagaatttaaagcaccccaatgcacagctgagagcctgttccatcacacccactacaatgttaggatgagtcccgtcttggaggaattgaccctgatcccagaaaaggttcatttcctgaagaaaagcgagtgcatgatttgctcttgcattcatctgacatgtatgttcaaagtttgctgaatgtatcccctagaggttgggggaagcagtatcttaggcaacgcactgattttgtaacagattgctgggctaacctccgtggcttttcattccaggattagatatttgacgaactgtcaggaggaatgactgtctcttacacattgctagacatttctgtggcaagacttgtaccttattttaacattgtgctgtttgacctccactattatttgcctgttcatttatgtatgttcccacttattctaaagaggttcgaggtgacaggccttagaagtagaagccagatgtgatgttctgcagctactcataggaatgcatttattttatcccccagcaagctggaagggactacgtgccaatttcccttcacaatgctggcaactgtctcttgccaaacaaggcaaaacctttcctgcaaaacaccccagtgagccaaaaaatggaataattttaactaagaggcttttccccccaagctactactgacatgtatttgctcaaagatttagtccctggcatctgtgtggtgtttactacaattcactctgttccagtacggagctgagctctagacctagcagggctggagagtgcacccaaagagaacagattcctagtggacagaacggatatctttttttcctgaatacttttaaatgaccataagaggatcaggggaagagaaagggaagcaaagtaaattcacttgggaattactcaacttactgagattcaatgactgtcagaccacagagcttttattcacttaatcatattactctactgcttaaaaaatcatcccatggcctcctctcacctataaagtctaaccggtgcatggcagttaaggccttgccaccttcccctcctctcatattgcacagccagcagcttctcagtagcaatgcatgttctgcgcgtctgcacaggtcattccttgtgttggatgcctcttctcttggttggtctggtgaactcccactaatcctcccagacgcagctcactggtcacctcctctgtgaaatctttcaacttcccaaagttgactattgtgtctttgatgccgccataagtctgtatctttaccaaaatatgtattaatggacattttactaccccacaatataggagagtagtgagtgcagggctgtgtcttctaacttctgtctgaaccatcaggtgaatgatgaccagcaaggtacccagcacacagtccgttttcagtaaaaccttgtccagttgaaactgaactctggctgggttatccatgggccccaataccgctgccagggaccacacagaacaggtctactcctctgcacataaaggctctttgagcccatgagcagggacctcctgcttccagagttgactgttttccgttttcctagtatcttccatctcatcatagacagcgtttcaaatccctccttaatttcagttccacccctcaaaactagtttgtttttctatatcctttttaatacttcccacctcaaactgaatagaaaattccagaaataatcagactggtactatcatctctatcattttataatcaatattaatgcagcccaagatcacagtactaagattatattatactcttaaatgttgttaaattttgctatttactaaagccctaaatttttttcacatgttcttatgcatatttacatatttgaactttttgatccgaatagaaattttatatatgttcttgttatatttcatgtctttaaaacttggataccatttaaacatttagagatcttttgaactcttttttttctttcgagatactgattctatcatcccacctctattatcctccccatctacgtcactttggagatttgataaacctgtcctctgtatcttcattcgaggtatggaattatgcattaaagaggcccgagatggaaaaacaacactccagaatgacactgaatcatgtaacatcattttttcagtgtagctattcagttagctttgctaacatctaatgtaagtttcttgattacttttcgtcaaatccctttctaaagtctcgatacaaactttaccaaagaaagctgtgactctgtggattcattcgctcttggagaaaccaggcagcactgtgatgatcacagctttcttttccattccttagtaaccaatcctagattctttacccaagactgctaataaactcagtgggctattgattcaaaattatgtccttcacctttaaaactggaaacctccctctacctccttctctggctctttacaactctttaaatagcatcgtcagcaaattggaaacctcatctgctatgttcttagtgcctgggatataaatttaccccagagcctctgaatgaccttttgcagtcttttcatccaccttgatctcttccttcttgcctgctgtttcccttcatcacagcttcactccaatgaactcctctaccaggagcggcctccttctcagccttggcctatccaaatcctgcccctgactcaggctatcttgcacagtaaaacattagtggagccttcccagatgaccttcatcctacatggtctctccttactctgaactttggtccacctgtggtcattactattcatgctgagaaaatgtgtcgtgcagcaatccccactgccattgtagtcgtggctggtttaatatgaagcttctgggtctgacggtcaatggcactgaatgataaggattctaagctactctttcctagagatgttagtggttatgggagaagaaaattgaggaatttgttaccttttacatataaagagactaattcttactttcctactactgctaggccatgagttttgattattacctaacggtagtgagttattattcacgctgattttgccacgaacttccttgtcattactcaaactgctggccagggtcggaggtgcggcctgtgaccatggaacagaatgaaaaccactggctcatggagaggtcaaaccccgcctctgacctcattacgacagggcttcaagaaaacaaggaaacaatcccaacagtccacctcaatccacaggcgaaaggatactccagtgtgccttcagttcttcaatttttttcagggattcttgaacttccttccatacttgctcatcaccagttagcatatcagcatcctgctcaggccagaaaaggaagacaaataatctaattagtaataggcaaaggacgtgaatagacctttctcccagatatacaaatggcctgcaagcccctgaaaagatgcttggcatcatttatcatcagggaaatatataaagcaaaaccacagtgagatgttacttgatacccactaccatggctataatcaaaaagacaggataacagcaaaggttagtgaagatgcagagaaacggaaaccctcatacactgcacatgagaatgcaaaatggtagctttggaaaacactctggaagttcctcaaagggttaaacgtagagttttcatgttcccaattagagttaccatattaacagtcctactcctaggtatctacccaagataaatgaacatgtatgttcaacaaaaacttgttcacaaatattcacagcagcattgttcataatagccaaaaaatggaaacaactcacacgtctatcaataaaatatccagacaatggaatatgactccacaataaagtactacatgctacaacatggatgaacctttccacaataaagtactgatacctgctacaacatggatgaggcttgaatacgttacgctaagcgagaagccaatcacaaagaccacatgtatgattccatggatatgacatgcccagaagaggcaaatccacagagacagagtcgatttgtggttgcctagggctaagaggattggagggaactggagagtcactgctaatgggtaggagtttcttctggggtgataaaaatgctctaaaattgacaccatgctagttgcacaactctgtaaagagactgaaaaccactgaactgtacactttaactgggtgaatttcatcacaggtgaattacacctcaataatgctgatattttaaaaaaacagaagaataggataaatagttatttgttaggagacctacagctaaaaccttattaagtataaagtacaactacacccatgtgacccaattctgacttccacctaaactaaaaacaaaatcccccaacactgaaaaaattcaaaagaaaattatgagctaccatgtatgaaatgtctgccctcctattcagtaagcaggtcctctgcttccggttggccagtgtacgtctggcatctagcacagtgcctggcacatagtagttgcttactcagcacttgttgaatgaatgactgaaaaccacatgtgtgcacaatgctgaaggctttactgatatttactgatattgatatttactgatatttactgatatcgtcttatcttcacatagctcttctatgtatgtaagtatcttcacatagctcttctatgtatgtaaggtcaaatcccatggggtaacacaggcagggagtggaaaaagtctaccctgggtcaggcaatgagagggcacactgtctatagaatactaaaaaataataataaaaaccaacgaaaagtaggtctgatgtttattatgtgcaacaattcagaggtgaaatattcttcttccccccaggtcagagggtgtctaacatctttctccctaatatatcactgatcatacccagtttatacatgacaaaactgagactcagattaagtgacttacctgacaatcactagcctggaaccaaaatttcaccccaggtctgtttgattccaaaaggctatcttcttgtcaaatattactctgtttgccacagatactgctatggtcttttcagcatgctcagcaagtcctgcttatttaaagctgcactaacaggtagccaccagccaggtgtggctatttcaatttaaattaattcaaacaataaaaaactcagttcctcagctgcagcagccacattccaagaagctaacagccgcatgcggctgtggctaccacactcaacaacccagatacagaacagttcactatgtcattgcagaaagtcctgttggacagtgctgctttcaggtggctagtcaaagggtaagcactcttagaagacactattcaaaaccaggtgttcactatccatgagactttcaacgggtgtcagagacaagaaccaccctaggaagttacatgaaagcagggccagtgtgaaggatgacataagggtgaggaacgagggacattttcatactctagacatccccctggagactgtcatgtgcccgttgaaggaggtttatagaacgaccccatgagaaccactgccagagtcagtctgtgtttttgggaagaagaaatatcactcaagtgtgccagggcagaaacaaagggaggggcagagcaccacgaaccacagaaaacagatcctgagactctccttctgaggctggggcagtgggtgtgtgtatgaggagataggagcacttgtgtctgcataattgggctttgtgggcctctatgtgtatgtgctgtgtgtctgtgtgatatagtagagtggattttaaaaagacaccataggtgcactttttttttttaattctaaatacatccctaactttctgtacatggaggagggaggagataaaatgcccttaagaaggtaaacaacaggctggatgcggcggctcatgcctgtaatcccaccactttgggaggccgagacaggtggatcacctgaggtcaggagtttgagaccagcctggccaacatgacaaaacctcgtctctactaaaaatataaaaactagctgggtctagtggcacacgcctgtaatcccagatacttgggaggctgaggcaggagaatggcttgaacgtgggaggcagaggttgcagtgagccaagaccacgccactgcactccagcctggacaacagagcgagactctgcctcaaaaaaagaaaagaaaagaaggtaaacaacagtctcccttcaaatgcctgctttaagcccgtattcatctcctaaagatcacctccctctcctgcaccaaagccttcagcaacttcccactgcctcccagatcaagctcacccattagaccttaacaatcatggtcattcctgattgaatgttccagttttacatttcacaactggcagcttaaaccctagatctaagcaaaatgttagtctctatggtaagcagaataatggatccccaaagatgtccacatcctgctctccaaacctgtgaatatgttaggccacattgcaaaggggaattaagttgtagatgggattaaggttgctaatcagctgaccttaaaatagctgagagtatcccggactttccaggtgggtccaatataattacaagggtccttagaagtagaagagggaggcaaaagaggaggtcagggtgatgtgctgtgagaagaacttaaccagaagctggcaaaggcaaggaaccagtcccctggagtttccagaaaggaaggcagccttgcccacaccttgattttggccttctgagacttgggtcaggcttctggcctacagaactctaaaataataaatctgagttgttttgagatgctatatttatgatcaattgttacagcagccacagaaaatgtagtccctaacataccttctgctcctctggccactggggctctttgtgcctggccctctctgtacctggaattacttagttagatcactcatttattccattaacacttactgagtacctaaccaggcactgttctaggcagtagggatagagcagtaaataaatcagataatcatggtgttcatactgaagaggcaggtggaacacacggcaagagaagatatgtgcatgcgcgtgcgtgtgcgtgcgcgcgcacacacacacacacacacactcacacacacattttgttgggagaaaaacaaggaagagggatggggaatactggcaccagggagttcattttaaacaggatgatcggggaaggtctcaccaaagtgatatttgagtaaagctcatttaaaggaggtgaaggagtaggagacagcagttccaggaagagcggagggcaagtgcggacgcagaagcgtgcctgaatgttccaggaacatgaggccagcatggccagagcttgtggactgcagtgtgtgcatgtcatatcttccccacttaactgtaagctctttagagctgaatataggtcttattcttctttgatcctgcctctcccaaatatctagcacagtcttatatttaacaaatgctctgctgaatgtctatagcatggatctggaagaagtgaactaacttggtaatgatttgatgtctcttgtgtttatttcagttattcctcacaacatctttgaaaggcaccaatacttgttatttacagatgaggtgcaagataatcctgaagcttacataattggtccaaatgtccttctacccctaattgccgaggtaggattcaaacccaggtctgtctggctccaaagcccatgctctttctagtaccttcatgcttcaatttgatttctctcctggacttgcttaaaaggtgaaactcatatctgagttaatcaattcaaaatatcttcacccttgtttcctaagctctatctagtactagcaattctaagaggagagtaaaatcctccaacatagaacccacagcagatctcgtattcttctatcaagcagggtgagaccgcagcccagggcagaacaatttcatatgggaattacagtcacaactaaatttgccaccagtgaacataacctgattagctgttcttttaggttgatcctaagcctttatttgcttaacagaagagcaagcaagctttgaaactgctcctaaacatttagaaatgatacctctgagagcattttatattggagctagacaaagctacactcactaatagctatcacctccctggagtgttccactacggtaactgcctctcaggttccaacttcccctgaccctacccatcccactgtggctgctactcacaattatgtctacactgggtctgtcacgtctcccctctctccacaccaggctggaggaaaacattcagttgcacaggtgtataaacaggacagaaacagaaaaactacttagggaagcataattttaatcttctactttcctaatttgcaaatagaagagtaaattactgttttttatcacagtccctgaggtataaaattagtaaatttatatccttatttccattatttcatatccaaacacaaagacacttgatataattcaggacaaagttattcaggaaaaaaaaaatctctttgaattttacttttaccacataaaaggagcttgaatgggtgagtcctggaatttttttttaggggatggaaacattcattttacattcatttaaacatcaaatatactattgctggattttctacaaatgctaaaaagaattcagcctagaagcagaaggattcctaagaaagctgactttcctgggaaatgatcgagagaatgaagaacctgctggttccagcgctggtggcatctctgccctgacccactgcatgaccccgggcaagtcttccttttcctggccctcaccttcctcacctgcagaaggagcagctagtctggatggctgctatgtaaccactctagtgatttcagcagtgcagaaccaatttagctccatctctggtgactgctcttttgcacagccccggagaagtccttcaaaagcctgtctttattttaaacagtacaatcgtagagctagtttatgaaagacagaactgtgccgttgttctcaggtaagaacgagtctcatttgtccattctctctctgaccgcacaagccccttgaataccgccctcccagttcactcaccccattctttcccctcacagctccaccccaaaatcctacccacgcccatctctgacttcactgcacccactcttccaactaaaatcgccatcctgtggcttctgtcaggactcagcgtgttttctgctgtttcctcggctcaccactccatttaagtctttggctttcttcccgtttgtccttttgggacacagcccctgctgtactctatcaggaaaccttctctggttctgccttctgggttagcctggccctccaggcccctctgcacagcccctagccctgaactgacacgaatggtttcctggattgcctccccaggtatcctcagaacgccctgagggaccgtgacctcatcatagctgtattcccagtgcctgcaaggtaaatcactcggtaaatatttggtgatagagtgaatgagaagtgatcttccacaacccatgggcgacagtattacaagaataaaataccttaactccaccacaacaaagagaatcccaaccaagacaacaggttgttcctttcacagcacacgtctaccttgactctaatattactacactaagatcagatacgttcccaccgcagctgtgggtatttgtcaaatactacagctggcattggtcatcatttagagcctaagtgtgacaccctcccccagcacaggaaaccccacgccggctccggacccacgctttctgacaatcgcgtcaagggttatttggggagtgggctcgcttacctctcctggcttctacctcaaacaccatcctgagattctaatggcgctcttggcccagaggtccctcgctccatctatccctgcatgaatcagtgaggccacctacattccttcatccatagctgctgaatcaataccccaggatcatttccttaactgtaaaaataggtaccagatgatatgagatcatctcaccaccacataaaagggtatcactcaacacggttacattcaattggccaaacgcttcctttgggtttcggagtgggaagtttacctgccagataccagtagtcactgtgaattacaaagctacgtttcttccatagggaaagtttggagtccagccaggctagctgagtataaacttgagaaagtgaccacgggctctgtcaggttaaacacacgaatccatccagacccaccttgcagctcgaacacttgaacagatgtgttcacttagcttgcaagcgtttgatgttgaaactcgtatgctgggccaatttcagatggttctcattaaaaagaagaggaacaggagaaaggtaatctgcttcccagtacttcctgttatccagtactcatgcaaactctaattagattgaagagagatggagtataggatgaaaaataaaaaattaatgaacacttacaaacttttccagtaattcaataattcatgtcttaaacggaagaaaggtttttagttttagtttttaaagtagaatgaggttcaaatacagtgtctgcactcaagagagagattggaaagtcttgaaattaaaaattctgaggtaatttgcagtgtctttgactgaggtagtctggttggggcaatatactgggactagattaatatacaacatcattcaaaacctttatgattaaaaggagacatctgtgctggaaccaatttccacctcctttgacaaaaacaactgaaagcagttcagatgtaacttgaggggaaaagtggctctttcataaagcggaaaaatagtggctaaaaatagagcattcactgttatatcaactacagaccagtcagtggacattataggctggggaataaggaaaaggaaggaatgttctcaggttgaagcacgatcaaattgtagtatgttctaattagcaattaatcagcaaatgtacacaacgattaacagaaattagtgaaaaagaatgccgggcttggagccataagatgtggaactgaatccctgctgcatatccctgctgccgagctgtgtagtcttggcaagtccttcaaccttccagaggcccaatttcttcagtggtaacgattctctaaggagatgcaccttctcatcttttcctctgcaccctctagagttacttacgtcctaaatgtcacagtggcctgagttttcaatccccaccctacagggcggggaccaacaggaggctgactagagtcagctttgtttggtgggaaagaaaaaaatggtggaggagggagcacattacaatgtaatcaacaaccaactatgctgtgaccccacatctctgcacatcccattccctttgccgggaaggctcttcctcaacgtagtcatccaagcaaacttctctgatccaccacaaaccacaccaaacagcctctgacatccacaggcacaatccctgtgcacttcccactggctttcatgatgcttgctctactgcctggcggcaatgagcgtaactgtgatgcagatgaaaagcatgtcttccagatgctgtcatcagcccacaggtgaagtaaaattggctttaaaaggttattttttcatctatttcatgaaattgtgggatctcagtgcctttaacagatgtccacaagcaggatgtagcagggctctgaattgtgagtccaagcagctgcttgcatcctcgcaagagcccaaagttcccgcctcctgctgcttcacccatctcctgagctggccgaccccaggatggatgtcctcttctcagatgagagagcccagagttcctgccgccttctccttcaccggcctccctgagctggccgaccccaggatggatgtcctcttctcagatgagagagccttctcccgtcgggcagccccgtcactcccttggatccaactgaggagcacttgggcaaccaggggctgtgagcccaatccaaacaaaaatgctcgtggtgaggagaagaagtcatcaaacagctgaagccactggcagctctgttccatttcactttacattcccaccgtcgctgccagcatttgccaaatgcccatttagctttagatctcaggcagaaacagggctctcctgcaactacaaatttccacaaaccacacattcaaaccaactgcgatttcaaggttcaatctccagctacacagaattgccagaaggaaggggatattcccttcatagcttctgggaaacggagcacagccttgaaggtatgaagtcagaacttctagaaccaccaaaggccttttccggctacagcctcaacacctcccctccctctgtgtggggttgttcccatcccagtgaataaaactgcttctcagagaaataagcttatttgcttatataaaatcaagtcaacctggagagaataaaaacagcatctacacgttgagggcagtttgagagcctacctcttgtcagtggtgcttgctaaaaatgagccttctgtagaaaagcattttgtagaaaactagcatgatgggctgatatacaaggcagttaaacacacatgaatacatttaggaaggagacacttgcttgcaccctccccccatactggaaaggtatgttcctgatgtaataacatataatggggattagatgacacagagggctatgagctccacttgcaaatgcacattcagacaaattcttttcacatctgtagagagactaccaaatggatggcttaggctgctgtaagcccatactcacaactcctacccaagtcctgccaatactgttgtgtaaacgctaccaggtgggaggtttgagattctgggaaaaatgcaaagattttacaggaaaattgttctcctgacaatagccattaagataaagtacacctccaaagttcagggtgagttttgtcttaatgaagaccaaagctgcagccctcatctcctttaatcggccacatctccatcttttgtattttcttctttgaggacagatgctctcattctcctctgccaacagagataaaaatgctttaagctgccgcagaacagattcaagtgaggtttaaagggcagtgtcccgaaggcgaaggttataggataacctagatgtggccactccagagacattcagacatgggatgaatgatagcttgatttgggttctgtgctgttggcatgtaagactgtgtgacaggcagcactacggaagtggaactaaggaggccgggccctggtaccagctctgccactggccagctgtgaggcctagagtctaacagtgcctcctggctccgcttgcccaggtgagaactacattagggttaccactgacatggaaactaatccttccactccattagtcgcctatgtgtaaagtatatgttgtccatgaaaacagacctgaaattctgataggaaggttgctggggtttgtgattgtgcaacaaattgtaaatgcctttgttctgatttgtccctccttcattctattttaaactgagttttctcaagtataaacaaccccagccatagcacagagagtctacaggactgaagacaacactcaacatggtactaccttctgccaaaccaagaatttgacaatggttatttaattcacacattccctctaacatttgtatgtataatgattataacaggcaatattccaagcttgggtaaacatggtatttgcttatctgctaaagcgagcacatcagattatctaatctgtggttctgaattaaaggaatagtttagctggggtccacaatgacagcttcacataacaagtccctgagacacaagtctagacatagctttttaggaggcaatcttacgggtcatctaaagaaatgatttattttgacattagaacctctctcttaacatcagttaatggagggttccatagcgtcccctaagtcttcagagttgggctgcagaaattatcccgttctacaaacacttcataaggcagcactgaaatccttagaccatgtgtcacacaagccaaaagttcaaaagaaacatgtcgctgttcgagggaaagaaattactttaatctctcagcctttaaaaaaaaattctagaattgtattttgtatctcactggaaaaaaagccagtgttcctccaattattctaaaacaaaaaaagaaaagtctgtagtctgtgaatcaatccatacagagatctgtcccttgaagctggagggtgggtcaccccagagggcagtcacttggcctaaaggtctggtgaggagaacactactttgtaaagtttgggaggagagaggggtgaccagattccatggtacagctcttttgtgcctcacctcgtatccatgagacagactacacaaaatcaccaggacttagacgctcctgcaagcagctctgcagccatggaagtgaagtgctggctgacggcacggcgagccgcttcctggcacgccaacagaaagcacatgtctgcatttttgattccagtaaactccaggctggctctcagccagaggacctctttgtaatgtcaaagataaaagtactggccatgtttggcaccctgcctccacctccattctcttgtaaccgtctcataaaccaagcatgcattactgttaacagagtcttccagacaaaggtctgacggagcttcataaacattagcagatgacgatcagacaggtccctactgcacaggaaggaaaggaggtacagggaggggcaagtgatttcactcagaacatgctggaaattgtggggagagctggaaatagatattcaactatatactcagaatactcctactaccagagaactgctcactgagccgcctgagtcgtgcacatcttccattagaacctggcatgtgggcaacatcaaacctcaaatctgtccccagcagtataggtatcatctttatattgatatctgatgaagttcctcaaatttggatgttcaaaatggctttttgagtatacaagatgatataatgcttctcatacccctaatattcttcctcttgcccaagggaatgctacgatgccagtcacagaagatttaggaaatgattaccttttgattagtttttgttttcattttgggtcatactcattgtgggccaaaattacacagccctagctgtttgcctttaccatttctgttttactttccatttaacttttgagactactctgaaagtaagattttaaggtttgtaaatgcttaccaactaaaatacgcaaggatttcttttccggaggtaaacaaacttacaaatccctcttgctctgtgcaagaacaaggggtacccagaccttcattcagaggacttaatatgagaaagtcccaggtcttcatcaccagtggaagctggatagctctggatgtgctttttaaaatatgtatcagaggctttaattcactccagagggctgcagagagcttacttcctcccctatgctaccaagagtgtgcaaacacacagatacccacagacatgcccacatacacacacatcccaggaatatgctttaagggatactgagggctccgactttccctcaaactgcagacctgttgttcctccagctttgtctctcctctttgctgtaagggcctagtaaggtaaggtgggtatatacttagaatcacctcaggagctgttaagaatacagaccgggttccatcgaggcaaatgatatcagcatctcttgggggcaggcagataccggtatcttttctaagctccccaggtgattccaatgcacagtctgggccaaggaccatcagcgtggcctttgccgcctcagccattgctccgaatctctgcgatcatgctgtcactcttcgtgccgacatggttaagacttgctgcaagtattgatggttttgcttttcttttttcttgtctgctcaatctacagttctgtctcccatgttctctgcttttgcacaaatagtttatttacaatagacacaaaagtgaccaagtctgtggcactacggggaataaatctcatgcccttcaggtgctctttagctcaatatatgacaacatctccccagtgcactccagggccaggtactggatctgagaagacacagctgagatgtggcctcagcttacattccagtggttgaaacggccaaacaaatgtatcatttctaaataccgcacgtgataacagagaggtaagccctggggctatgggagcatagaggcagagccctctgcctggccaggatttagggaaaatgtcctggagaagaggatgcatgagtgcaggcttggaggctatgggagcacagaggcagagccctctgcctggccgggatttagggaaaatgtcccggagaagaggatgcatgagttcaggcttggaggctatggaagcattagacaaggagagacaagcaggaaggccagtagcagagaagagaaagaggtccttggggaggccacgctgttgggtgcttctggttcactcatgcatggcagggcggcgctgcggagacggggcagctccccggccctctgctgccctactaggtctgcagttacttgctgttcagaggctgcttttccttagaggctcttttccccactaagctgaagggctacttcagaatgagcccacagacccaaaaacataaagctgaattaaacggttcatcgggggaaaggggtggagataaaggtttagatatgaggtagagaggtagggaaggggtcagatcaaagaatgaatttgatcctgcatgggcaacatggagacatggggagattttaagtataatctctatgtttttcaaatatttacgtggaaaatacacttgcaggtgggagggactgaaggcggaaggtgttaggtagatgtttcaacaatccagaaagagatgacatgaatctgaataaggccgtgccttagcaacagtgagagaggaagagagagactgaagagaaaaggaacaattcaagagagtgtaacaagatgataacctgggagtaagtctgtggagagtagaggattccaggacaacggccatgcatctggcttcagtggctgagtgcatggcgaagccttccggtgagatggggaatgtagaaaggtgtttaggaaagggacgttcgcttttggacatgctaatataagatgtctgcagagaatccaggtacagttacccctaggaagcgggaaatatgaaactagacccagaagacaagtgaaagtgagaagtgtcgacttggaagtcaacgccacgcaggtggaatctgaagatatgcgacagaggaaatcacccaatccaacggggcccaagaatctcaggggcaaagcggagaagtaaaggagggcacggaaacgaaaggagagtgttcccaggaggaggaaggaagggacaggtggtgtggaactcaacaatggcatcaatggggaagagactcaaaggaggtcaatggatttgaaatcaggggctcaccgatgacatcagagagagcgtgctttggggagtgataactcctattgtgggagttaagagaaaacaaacagggtcattaagtgtgcagatgactcaaggggtttcacagattaaacaggaaacaatggttagaggcaagagctgagctggaaaaagagtttgtttcttataacgggaaagtgtgggcacgtttatgccacagggaaggagtcagtggacacggaaaggcagaccccaacagatggggcagcaaggggggcgaggtccacgaggaggcagagggtagggtcaagagcacaggtggtagaagcgggtggtggggactcggctttggcaaggaggtccccatttcctctaacaggaagagacagaatgggtgcagatagagttgcatctggaagtcagcagggtgggaagttgagatgggctttatgtctgatggactctttttccctatctactgaaatcaagagacagcagaggcttaggaggatggagcagtagtgagggtctgggagtgctatagagaatgggtaaaaaggggccagctgaggacaacttggcaaggaggaagcccagctgagggaaggccagaagcagccccagcacctgtctgcaggatcctgtgactttcacagccccattgcattacaggggcctgaactgcaggaatatactgttgatgtcatcagcagttggagggttggagagggacaacgcagggatggcaggaagagggcgttgagcttgtgagtgtaaacaaacatgggttccggcagagaaagaagggaagctgcctatgctaagattttcaaaagagtaatgccccttttctccaactacagtttagcccatgaaaccaatttgtatttgtttggcctccaggaagagcagtgttatttctttaatctaggtttcatgttaacacatctgagaaccgcttgcccatctccccatttccattttcagtgcagctataatcttgataatgagggcacggtagtcattaaactattggaaactatgagtctgaaaatgcttgacagtcgcttaggttcccatttgctttatgcatttctagtctgtacaaggttcacgttctagaacaacatctgagcacactgctcacaaacagctgataagcatttcccaataggactagatgacctacctcatagggtgggcctaagggctaaatgagataatatgcaaagtgctgtgcatagcaactggctcgcagtaaccgctaaatgcacatgagctgtgctgttacagaagagatggggagtaggcagcagaacactgcgatggagacgaagagtgtaagaggacaacgctgagtaaccgaggtgatgagaaacgcttcagtgctctctgagcaacgagaaagcatggaagagacagagtcgctgcttcaagcgtgtgagaaacatcaagagatcacagaaagctactcaattcttagggtttttcctttctccccaaagaagttattcttcatcaggagagagcagaataggaatcttagaaaagttcccatctttaattccagctgaactatattccaggacagtgaaagaacttggaaaatatggtcatgaaactattcttactccactctgaagaactgagagaaagggaatggcagcagaagaccagagtggcggcaaatatggtctcaagaaaataaaaataaaactctgtaatggaagtcttcaagcaaataagtcaatgtctatctttgaccaatgcttattaagaattttaaaacatggtgtaccctagagacagcacaggtgcgttgctgtacacaccagagatagcacaggtgcgttgctgtacacaccagagatagcacaggtgcgttgctgtacacaccagagatagcacaggtgcgttgctgtacacaccagagatagcacaggtgcgttgctgtacacgccagagatagcacaggtgcgttgctgtacacgccagagatagcacaggtgcgttgctgtacacactagagatagcacagttgccatgcacaccgctgctgtctctagtgaatgctgttcttgcagctgcagcaccaagaacaaatcctgccaatctgaactcatttaattccatggagattatacaagtatatggggcaaatattattaacaccatattgttcgatttcaaccaggatttgttaatatcttcataatattctgggggtaagataaggctatctggttaggatgagaaagtatatataggttcctggctggctggctgaacaaccaactatatcttaggattaactgatgtcagccttgaatcactccttggtaggaatcattttccttattttatagatataggtgagtttcagagatggccaactgcaggccaaataacaacaacaacatttactgagggtttattgtgctaattactttaaacactgtatcttatttaatcatttcaacgaagtatcaggtaaaaaccagtccaatccttatagaagacaagactgcagctgagaaagacaggttaacctcctcaagttcaagtagctacaaagtggtggagaaggacttgaactcccagttgtataattcagaaacctgagtgctctctgctacaccacactgcctcaaatattcaagtacttgaagactggtaggtgggacaagaaacctatttgctctttattgttccaaggggcagaactaagaccctgatgtaagtggaaagaggcagcttttagttcatgagattaattaactttacaatcacagttgcccaagagtggaacattgtgctcaaaaagagtgtgctgagatcagcactaaaaaagttcacattgagtacggatacccacccagggcacacactgtccaggagatacttgccctgggtaggcgggcctctaagggcccttcccatcctgggcttataggcccctatgaaatgattcttctacatttgttcattataaaaatatacagatctccaacaggataatggggatattcatgcttttgaccagattagaaaactcacatatctaagtataccaccaaaccaacactgtgttactcaagtctggtttcatcaactctggaatgtgtgcattcttggaggaggaaagaacaccaggggcatgaactgcaagcagaaaggaatctgtcatgatgataactggaaatatatatcctgtctttccaacgggtggtttacatgtgagtttgtaggtcttggtatggggaagtaaggtaggccatactcagtattacaaagtgttggaggaagagagggcaagaatatcccttcctgatagcccattgtttaaactaccatgaaattgttttatgagtaaaagtcattttgaagcatcaggtaatagagatttttggcatgtcctatagagcttaactccatgctaggcaaataacagtatttattcacatattcacttgcgcaacacaaatttattaggcactgtattgggcactgaggacaaaatacagaacaagactgatagggtcattagtactttcctaacaagtaagcaaatacacagcaaatataaaaatgatacgtaacgtttgctagtgcaatcatggaaataaaggcattgcagaaaataatgaggagagcagcacctgattttcatagggtagtcaaggatctctccccaaggaggtaaggttgaagccacgagctgaagaatgatgatgagctaggcaagcacaaagctacaggaagatgattttggacagagggaagccaagtgcaaaggccccaggacaagaaagagctcggcatattccagccgtgagcctgagccgagactggtagggtgaacaggagccaggccgcacaggggcctgctggtcttgttggggaagctggatctcccctccaagaaagtgggaagttgctcaagagctaccttctgaaaacattctctggcttttgcgagaaaactaaattccaagacaacagggtggaaacaggcagaccgcttagggaggctcttgcagtagtgtaaacaacagagaagggtgctgaagaaacactcacaggattatacatgttgctggaaggggagagaggcaagaagtgacaactgacctctgtcaatcgtgaggtcttgacttaacctcattctggcacgctgcttgggaaacactagctaggtttattaacccaactgtggttgccaccaacagcagctgctaaaccttcttctggttttcaacaaaaatcccccatatatcttatgtattcgcagctccctaagtcatcaaaccttcatctcatctgaaaagagagcctatctgtggcttgaatcactacaatgagccaaaaatcaatttataattttgggtaatagttctaaatctattttcaatcatgtgggggtgaggggtgttgagaggaaaaagtgaatgaagtttgagaaactagcaatgaagtctctcagtcaacaatttaatgactacaaaataaataaataaatgcactagtgtacccttgggtcccagttcttattcagttacacatctgttctgcaatagaatgagggagttaattacttttctatgacatgtatgtattttgtgagacaccacattgcaccagttaataatgatctaccttctgttgacacaaaacgtttaaattaataaaaaaatctaaatgatatatcacatagcaaagcatacttcactgaaaggctggatggcaggagtagtaattttcctgggtagaaataattgagatgagcttatggtagcatgaaaagctcaatcaataaagagacttatatgggcaaactgttttcaagagtacactctttttagaaagggtaggctgtgcttcgctaatagctaatgtagcagcactgtgattgttagagaaagaaactgagactgatacccagtaattgcccataattgacaatattagcaattttccatttgaatctgtctgttcaatctttagggtcagaaaagacaaatgtgaaaagggtaaaaacaatcccttgaagctctattaatactaaaaaaaatctttgtgctcttcactgagtgtacccttgtaactagatactaaaccaactgcattatggaaacagcctattttttccaaactgtataagcaatattaaatgaccttggaaaaatcgagataatatgtaaagtagactcccagcacaaagacggaagacatactctaaataaacttgacaagagtgccttgttcaagtctcaaaaccacccaaggaaaagtctgaaacccacaacatcccgtaattattttgctattttccacttattttgggttaaaaaacaaaagtctaccacttttctttcatttttaaattcattctcacttctttcttaaaaactaggggaaaaaaaccccaaaacatcaggactggagtcaagaagtttatttcctgtataataatttctttcttttggggtcccaacgctaaaagactattacttctttctgaccattcaagcccctgctcttcactgtccttcatggtttaaagcagcctttacccatgctggcccacagagtatcatgaaaggtccatggacctgacactgtaagaatttaggtacaaatctagcgagatgaatccttttctaattcttgcctatttttggcttttcagggagcttcatatactaggaacttcttctaggctattgagtacatagtaggtatttagtaaatgctggttgtcgtgggaagcaacagataaaggtgaaaatggccaaaacccagagtgggtgatgtaaaaaagaaaaattgtccaattttataaagtttcatgattttttttcctttagcggtaggatgtctaatatttctatttaatctcaaatattaaatttatacagggatatccaggtcagaggattccagaacttgaggattaggaagctttttagcaatgcagagatcagacagatgaaaaagactgttcttagaagacctgtacaaaacaaatgccaccatatcttcttaaaaaagcccaaaaggtcagtacatcgaatccaaatacctatagctgaagtctatttctcccaatcttagtgaggactgaaaactataggtctccctgaccatgatgcagcatggttgtctggggtaaatacccgaggttcattgtctcatgccagggtaatcgaggatgcagacacacaaagtgattttgagaacggaggtttaatgggcaaaagaaagagaaaagagaataagctctctcttctgcagggacagagaggaaccggagtggtccttccggttttgtggtgaaatgcatgggggtttttatagacaagcttgaggaggcagtgtctgatttacatagggcctgagagattgggtggaccaggtgtgatgtttgcatagcacctgaagaagctggccatcccaccctaatcttttattatgcaggtatctatctgggaggtagccatgttgtctgttccttactgtacacgtgattgacaaaagggaagatggtgccactgagaggtaaagccagcaggactttctgggttgagtggggacttggagaacttttctgtctagctagaggattgtaaatgcaccaatcagcactctgtaaaaacgcaccaatcagcgctctgtgtctagctaaaggattgtaaacggaccaatcagcactctgtaaaatggcccaatcagctctctgtaaaatggcccaatcagcaggatgtgggcagggccaaataagggaataaaagctagccacctgagccaacagcggcaacccactcgggtccccttccacgctgtggaagctttgttcttttgctcttcacaataaatcttgctgctgctcactctttgggtctgcactacctttatgagctgtaacactcaatgcgaaggtctgcggcttcactcctgaagtcagcgagaccacacacccactgggaagaacaaacaactctgtacacgccacctttaagagctgtaacattcactgtgaaggtctgcggcttcactcctgaagtcagcaagaccatgaacccaccggaaggaagaaactctggacacatctgaacatctgaaggaataaactccagacacaccatctttaagaactgtaacactcaccatgagggtctgcagcttcattcttgaagtcagtgagaccaagaacccaccggaaggaaccaattccggacacaccaccatgttgaacatgcctggcccccaggtagccttttcttattggcacagctgccagcattcacccctgcaagcttccagcttgcttgtctatgtctgtgactcgattttacaggctgttctttgttagaaaagatgtgatttggggactgcttttcattaaagggaaaaccttaccgaggacttccttaccctcactatctgcccaactaatttctttttaactcctatatcaaccagataaggcccctcctttctcctgcaggctgaagagtttgtatgcccttagtctttctttaaagtcttacttttctacagtgtttctctattagaggttctctctgtccctttttaagttatggggccactatatagttatggggcagctgcataaaaacgttcatggtcttttcttgagctaaaagacaattacataaaattaaggaggttagtatccacaatttttacaatgattttaactgaccttattcataacatgaagtagttgtaaaaagtagatattcatttaatatgatgtcaaactaaggtaattttcctcatcctctgaggctgcttgttactcccattggagtactcacccatgttgaacgcaacctaattgttcagaaataattaacatgtttttatttcagttgtagaaaacataatttattaattggctgctactttatgtgttccattttaaaaggcacaataaataagaaattagcataagaaggtattgaaaaaatgccaagattgactaaattctgagaaaagcaagataattccaaattaaggatgagtaaatttattacataaaggagtttaatgacaaatgtggagacaactgttttatgggcctttagctacagctttccaattttaatgttatagacaggaaaacattatcaacgctttcataattccaggattctaatttacatatcaaaacaagagaaagagaaagcccacatctctccttacttattagagttctcggggtctgaaaacggcttgtcaacaaaggttgaaagaagaggaagcagaagatatgctgatggctgcaactgaagcaatacaatatcctaattactgggaagtacagctagtttagagaccatcacaccctcacctcagcaattaatacccagtacaattggtaaatgttctaatctttaatagaagcacccagaaacagcctgtaagcagatgagtatttgaaacaaaccgtttgccatatccccgggtattaatcgaacccaaaagcatctcattctttgtgggggaggaagaaagctgccatcatagatatgcataagcagctctctacaagctcttcttctgggtgtaatgatgtgaaaaccatgctaatttccttgcccgatatttgaattttttattcttcatgcaatcatttctgacttcttggttctacacacactcacgtttttctggctattgcgggtcgaaaggccaacctcactgttctaacaatgacttcccatccctccatgatgaaaatgcaaaccctctgcccagcataggccatccctcaccacccactgctggccttaccagcctttatcctccagcaatactaaaccattagctgttccctgatgcgccatattctctcaagcctctgggacatttcacagggtgtgtccctgtcagaagcatgtgaaccagagcaactccatcttgaataggggcctggtaaaatgaggctaagacctactgggtggcattcccagatggttaaggcattctaagtcacaggatgagataggaagttaccacaagtaacaggtcataaagaccttgctgataaaacaggttgcagtaaaggagctggccaaatcctaccaaaaccgagatggccatgagagtgacctctagtcatcctcactgctatactcccaccagcaccatgacagtttacaaatgccatggcaacgtcaggaagttaccctatatggtctaaaaaggggaggcatgaataatccacccctcgtttagcatatcatcaagaaataaccataaaaatgggtaacccgcagcccttggggctgctgtgtgtggaggagtcattctttattcctccaccttcttaataaacttgctttcactttttggactcgccctgaattctttcttgtgtgagatccaagaaccttctcttggggtctggattgggaccccttttccagtaacatccccagactgaatctctttgaaaccatctcaatgaaaattcctatacaacctgtacatctcaggtcaatgtctcctgtgaagtctttctagactgaccagggattttttttctctttcattgccactatacttcaaacaggcttccagtaaaatcactgccacaccaaattaaactgtgtctgggtatctatctccacattagaatggaagccacctacaggaaggggacatctttcaatctcaggattcccatggttggcctatgatatatgtctcacatcatgaaatacttgaggaagaaagaaagggacaaaaggagagaaacagggagggagggagagattcaagcaggtttgctgaaagactggagatgaaaatggtaattatgggtgagtaataagcaaaaaaaaggagacttaagtctatttaagccctaagcaatataagacgccttatttccagagagttaatgttcaagctataaacagaaaagacttattcctaattctagtccttgttggggtgagtcagggctccctggactctccacagcagctaatgcttcagtctcttcttacatgatagacctgtcatggagtctcacccaagtgggttgtaaaagcactggccaatgtcagtctagggtcttaaatggacacttaaatatactaaattattcagtagtaaagccaacccaaaatatctatttttcctgtttatatttctagaattctaccatctaaagggcttgagaaattggacaaagatagtatgttaagtatttgaaaatgaatacataaatggaagtgatctctcaagaaaaataatgtaaataaataaataggcctaaaagttccctcttgatgttattttacctttatttaccttttaaccttgcttccacaaccaagggcagtacccacagtgctttatcaaaagagcactgccccagaattatgatacttgtattttctgggccggattgtccagcgtcactctatttgtgagtgacacaagtcatttctcctctctgcaaaatgctgatattgacctagatgcctaatgtttcttctagctattcaaatttaactgactttctgacaaaccacttagcttgtgtgatattcgatggatctaagtacaaagtatgctctctcacgtctaccttttaagctctgaaggtatgcaatcaataacatgcagaaagagcccaatctgagtgtcatttcagcaggttttaaagacagagtgaagaaatgcatgtgttctacatcaaccatgtctacctgaagcccaacagcaacttctcagagcagggaaagagaaagtggaaccacatttggtcacctaccatccctaatacacggagctgcattacatactccctgtagcttaccaatgccaccaattccccagcttcattcttccaaggatgcaatgtcactagagggcgcagttaatgactatataaatagtgagccccaagatagttattgtgaaatttaacctctttccatatcccaacagtgagctgttagtggaactttgtgtggcagagacctatagaactccaaagttaggtaaggtcaaacatgtcatgttttaaaggctttgagcatgtactatggaccaaaagcataagccttcaagttcactgttgagcccgattaacagataaggggaaaatgtactttttgagaaaaataaataggttatttttgcatggcaccatgttctcttaatttctatagagagtgagataacagaagtgactagaatacctttttctccttctaggacatccttcccattgacactggaggggccaactacatgttttaatcagagcccacagctgcccacacccactgcagagtgagctactctccaccaaccctgcagccctgaagtttctgtgaccactgaagaggtctgttttcagacttagggtcaaagtgtgggtgacctccaacacctactgtaatgaaggaataaatgtcaatagaagccttgtctggtctctgtcccaaggcattttattatttgtttcattgtgagattccaaatgtggtcttactcagaaaagaacaataattcttacatggcaaattctgaaagaggcatcaatgcaatccctctcaaaataccaatgacattcttcacagaaacagaaaaactaatccccaaatttatatggaaccacaaaaggtccagaatagccaaagccattctgagcaaaaagaacaaaactgaaggaatcacattacctgacttcaaattatactacagagctatagtaaccaaaacagcatggtactggcataaaaacagacacacagaccaatggaaagaaatagagaatccagaattaaatccatacatctgcagtgaactcatttttgacaaaggtgccaagaacatacactgggggaaggatagtcttcaataaatggtgccgggaaaactggatgtgcagaagaatgaaactagatttctatctctcactatataaaacaattaaccaagatggattaacgacttaaatttaagaccctcaaactacgaaactactaaaagaaaacactggggaaactctccaggacattggtgtgggcaaagatttcttgagtaacatcccaaaagcacaggcaaccaaaacaaaaatggacaaatgggatcacatcaagttaaaagcttctacacagcaaagaaaacaatgaacaaagtaaagagacaacccacagaatgggtgaaaatatctgcaaactacccatctgacaaggaatcaataactaggatatatataaggacttcaaacaactgaataaggaaaaaaatctaacaatctaacaatctgggcaaaagatctaaataaacatttctcaaaagacgacatacaaatggtgaacaggtataagaacatcccgcatcatcaaagaaatgcaaatcaaaactacaatgagatatcatctcaccacagttaaaatggctttgatccaaaagatagggagtaacatatgctgacaaagatgtggaaaaaaagggaaccctcgcacactattgttgggaatgtaaattagtacatctactatggaaaactgtatgaagggtcctcgaaaaactaaaatagaactaccattgatccagcaatctcactggtaggtatatacgcaaatgaaaggaaatcagtatatcgaagaggtatctgcacgcccatgtttattgcactactattcacaatagctaagctttggaagcaacctgagtgtctgttgatagatgaataaagaaaacatggtacatatacacaatggagtactagtcagccataaacaagaatgagatcctatcacttgcaacagcaaggatggaatgggaggacattgtgttcaattaaactagccagacacagaaagaccaacttcacatgttctcactaatttgtaggagctaaaaattaaaagaatttaactcatggagatagagagtagaatgatggttaccagagcctgggaaggtagtgggcaagggagggaacgggggatggttaatgggtacaaaaatataatcagatagaatgaataacatctactatttgatacaacagggtgaccagagtctacaataatttactgtacatttaaaaattactgaagaaatataattggaatatttgtaccacaaaagaaatgataaatgcttgaggcaatggataccccatttatcctaacatgattattacacattgtatgacagtatcaaaatatttatctcatgtacccataaatatacacgcctactctgtagccataaacattcaaaatttaaaaatacaaaaataaataatgtttacaaaagaggattggtctcttgggaaataaactgcagagacagcccaggatgacatccactttgtccaggaatctggggggaggggagcaatgacctggatgtgactctgtgcagtgccactcatgctgtcttcttactcagctgtacttcccttccttctgctatgtacaccccctcagtgacagcaatgtcgggaactgtaggggtgaagaggacagcacgagtagtgatgaaggacagtgatatgccccctaagtctggacaaaggtcagcttacttctggaaggagagcccaggttaggaagtgcaggggagcaagccaggaagaatacaagaatgaaaaacaagctgagctgagcatggtggctcacacctgtaatcccaacagtttgggaggcagaggcaggaggactgcttgatcccagaagctgaagactagcctgggcaatacagtgagactccatctctacaaaaatatttttaaaaattagcagggcatggtggcacacgcctgtagccccagctactgaggaggctgacatgggaggattgcctgagcccaggagtgagccatgaacacaccactgcacttcagcctgggcgaaagagtgacgccctgtctcaaaacagaaaaaagaaagaaagaaaaacaccaaccaccccagcacagtgaccactggaaccaaaccaaacaagaggcactaggcacaaaaaaagggggaagaaagcagagacaactaaaaattggaacaggaggagttaaaaaactgttaagaaaattatgtgaacaattcagagactctgatcagcaaatgatgggaactgaggatgctgtatttcttggaacctcccaaatagactatttccccagatcattcaataataataatggctaccattaccaagcatctaccatctcccaatctatacatatattatctaattatctaattgaacccttaaagtagctttgccaggtttagagtattctcattttacaaaagagaaaattaagaccatcacagggaaggtaacttgctgatgtcaaagggttggtcaacagcagaaaccagaaccatctatctgcaaagcacatgctctttccaccgtatcaagctgtcctcttatccaccatttggatttcatgtctctggccagttgctgatgctccggaactagaacccaacttctgctaaatctaactctgtactctttgtataatatcctgtggctttaaataagatattgactcagcaaatggtactagaatcattggctatccatatacaaaaaagaacattatgcatacacataaattaactgaaaatggatcaaattcctaaatgtaaaacctaaaactataaaatctaatatgaaacacagaagaaatatctttctcctcttgaattaggtaaagattttcagctatggcttcaaaagactgatccatgaaagaaaaatactgataaactaaactatttcaaaatttaaaacttctgcttttcattctgtgaagagaatgaaaagaccagctgcaaactgaggaaaaaaacatgtataaaacatatgtccaacaaaagacctgtgtacaggataaagaactctcaaaactcagtaagaaaacacccaatttttaaaataggcaaaagatttgaacagatatatcaacaattaagatgtacatgtggcacacaaacacgtgagaaaacacattacagtactgcaaattaaaaccacaatgcaatgttaccacactaaatgtattaggaggatgaaaaacaaaaagaaaatctgacaaaaacaagtgctggtgaggatttggggtaactggaactctgagtcattgctggtgggaattcaaaacaataggggctgctttgaaaaaaagtgcagcaatttcttataaagttaaacatatatttaccatagagcccagcaaccccactcctaggtatttgtccaaataaaatgaaaacttatatttgcacaataacctgtatgtgaatgttcacagtggctttgacaaccaccaaaactagaaaacaactcaaatatccttcacttagaaaaacaaactatgaaatagccatgtaatggaatactacttggcaataaaaatgaaccaactattgaggttatatattataaatgtgtgtacaaataacatggctaagcaaaagaagccaaatgaaatggctggttaatgtatatgatattgtggaaaaggtaaaatggtagtgacagaaagaagatttgggttagcaggtgctgggagtggggtatagacatggatacaacgcagtacgaaggaatttgggagtggtggtgatagaacgcttctctatcttgatggtggtggtggtggttgtggtcacagactgcatttatccaagtttgtagaactgtacactaaaaagggtgaattttactgaatgcaaattacactccaattctttaaaaagatagggaaggtctatctgttactcttatcactatagaaacagcatagtgaagaggttagggctatactcttgaaagctcccgttgcctcatctgtaaaacggcagtaagagtaaccctaactttgatatggttgtagagagaaatgagatgaggcatacagagaagtctgcagagtacctcgtgagaggtgaagccagctggacttccagggtggagtggggaattggagaacttttctgtcttacaaggggattgtaaaatgcaccagctggtgctctgtagctagctagacgtttgtaaaatgcaccaatcagtgctctgtaaaaacgcaccaatcagcgctctgtagctagctagaggtttgtaaaatggaccaatcagcaccctgtaaaatggaccaatcagcaccctgtaaaatgaacctatcagcactctgtaaaatgaacctatcagcactctgtaaaaggaaccaatcagcaggacatgggtggggacaaataagggaataaaacctggccaccccaaccagcagcggaaacccgctcaggtccccttccacgccgtggaagcttttgttttttcactcttcacaatacatcctgctgctgcttactctttgggtccgtgccatctttaagagctctaacactcaccgcaaaggtccgcggctccattcttcaagtcatcaagaccatgaacccaccggaaggaaccaactctggacacactagcacacaataagtgcccccataagctttagcaggtattctaatttccagtagtatctgaggaagaatcaccttattgtactagacttcctgaacactactgcgtacctgtggaccatgtgttgggctggggatggtacttggtacacaagaacacatactctgtatcacattagctgccatccctcaatctatcctctgagctggaggcttatgaagccccaaagatggtagaaaagaatgtgtgtgcaagaactggaaaggtgagacagaattcacgacaccacaaattgtggagagaccatcttttacccgaggtggacataacagggccacgtgaaggagcctggtgagcacagctgcctgtcctctggggagaaggcagagaagaagtgccacatcctgtgatgtggtgaacgccacagtccaaggcaaacacaatagctacattgtttatctctcagccaactttacagcccatcgtagcatgcccagaagcctctccccgtatgtcatagcaacactgcagacgggattatgtgattatgaagtcagtaactcccttccttgattaaacatgaactcaaacagacagtcattcactctgggggaaacccatttttctgcttgtctggagaagcaagacacaggtaacatacagcaatgttaggtttcaactaattaaaaatgggaatgaacacacgcacacgcacgcacacacttcttcagttccctgtcaaatcttcctgaggacaacatagtttggttatgatgaaaactttagaaacgggaaacattctgcttagattgttaaaattgagaacaacgcagagctggttgggctcatcatcccaccaggagacagttctgcttacaatttatctagcaaaatagagtaaggcagcagaaaaaatcttggtttcctagtgacctttaagtaagtgctcccatttcaaatagactcagtaccataaaaactttcttgggctgagaactttcatttcctttgaatataacttttgcgctaacattctttcatttcttcttcttcagacaatcattgtttcttcctttcactcaaacctgcctctgttccccggttttcacggtttacagggcatagcccaggtgatgtacagcccacatgggaatcaaggcagttcccacacagcaccagcacaaagtcatttctttgtagaagctgggcttcttcagggctgtgtaactcataggtgtcgtggagggtctcagaaggaaacgagggaaggcaattctgtgttgcagaaaaagagtttttctaaaaagaagctgaaataattaccagagacaaaaattaacattgctttatatttacagaagaaactaagaggaagtaggcttagaattgtagcatcagggaatgagaagtttattaaggcttctccccactacagaaccatttattaaactgtttccagaatggatacattttcacaatgatcctactcaatctctcttcatagaaggctctgtgataaaagaagatatagatcccctgctccacagacggctgacactgggtaaaagatgcacacatacttggaagccctcaggaaaattagatcattatcttctcgttttttctttgcctccaaagacttagatttttacctatgtactcgaaaagcaactgcagacttccaatcaagatgctgtaagttcaaacctggaagcgttcccttctactccaaatccatagtaatgacaggtaaaatataaaaacaggaaccaaaaatagctttgccaagtcaaaaaaaaaaaaaaaaacaggcaatgatctccctggaccaaaaatagaacagaaatgcaaagcaataaacaaagctgaagctccagggcctgaggtctggaagtaggtggcagtaggtacaagctgagtgctggtggttaaacagggaatacaaatgtttcacataaaaatggtgagtacagtcaaccttaaagcttaaagccagagaatggggtgaggctaccttgcttgacaaaagaggccgggataaacaaaaccagggctgatgacctgttcccctgtgctagatatttacaggaagctgtgggcctgaaggggccaaacagagccatgctctcttgtctaggtacacagccatgacgcccaccatctaggcaacacttctgcactagcctcagcatcaccggggcgcaagaggtccaaatgccattaagttctggttttgaactggaggctgaggggcttgggggaggcaaaactaccagacagaagggaagagcacagaaggagtgaaaagaacaaaacaaaaaaactgtccactaaaaatgagcctgccatacaaaattccagaacactgagtgaaatgcaatgctaaccaactgaaaacaatcagaacataaattccctccagtaaaataaacttcatggaactaacacttaaaagaagtgtgattagaatacccaaagagatgaataatgtagtagcatgcattaaagtaaaaaagaagttataaaaccaaaataggcagaaataaaacacagagacgtgaaaaagaacaaatttgaaatcttggaaataaaaattggtctttaagctgaaccagtaagcagaaagtatccctagcacctgacttaagggagctctaagtttaaaaacacggacaaaatgccagaagctaaaatgggttctctctgaggagtaggtcgtgggcaggagcaagagaggaaaggggtaccattgttttcaactgtgttagagtactttaatttttcaaactatatacatgtattactttaataaaaaatcaaaataagaaatgtaaaagcccatttgcaagaaataacactagtgaaggattacctgaaggatttgcagtcactgctttcctccatagagactaaattgtattcttggaaagaaacaaaccatcaaagagatatgatcttagattacctaatttttcacgcttctagttacctcttttattaagaagtattaatttggctgggcacggtggttcacacctgtaatcccagcactttgggaggccagggcgggtggatcacttgaggtcaggagttcgagaccagcctggccaacatgttgaaaccccatctctaccaaaaagtataaaaaattagccaggtgtggtggtgcgcggcgcctgtaatcccagctattcagggggcaaggcaggagaattactgaaacctgggaggcagaggttgcagtgagctgagattgtgccactgcactgcagcctagaagacacagtgagactgtctccaaaaaaaaaaaaagtattgtcaatcagctatgatgaagaatattatagaaatcagtgatttcactcgctgtggaagtccagtaagaatgctttgtgagtgcctcaggcctcagtgcagggaaaaactgctctggctgtgttttccttcttagggctactgtgaattttgaaagtagtcttttaggtttggctgctgatacattaagggtaaattcatcatttttctagctgttatatattgcttctaggccttttggttaagctcaagtgtagtacttctagctgttacataaaggatcatatggtataaattctgcatactaaactactttcatcttatttgtcacttttatttctcaaacgaaaataaaatttattgctgttgtattacatatgcaagtagatacatatatacatgtgtatgtatccttgtgaatgtgtgcgtgtaagctacttcaaaatcttttgggtggaggaaagggaacaattagataaaggaaattggtattttgaaacagaaaaagggaacaaaagcaggttgaatgttagggtcgcaactagagagcactgaatggcaacctatgagtatgaagttgatcctgagtgctaaagataatgctgaatgcttgaacatttctgagcaaagtaacaacatgagaatagtggcatctgagagagtttacctaaaacagtgtgtgccaaggatgaaaagaaagaaattgagagcccggtgaataatcaggggctatttcaataacctagcagtgaggcaacagagctttgatagactgatagacatggtgtttcaaaagaattaactctaacaggacttaggaaagaaaaattgacatggcaagtaatcatagcttgtttgttttttgcaacaaggcatgtgacatccaaagcagcacgctatgttcttgccacaaacttatggaaacaatcaattccatttggtctgttcagctcctattgccttggattctgacctgggcaagccatgaggacccaaatcattcaaaaacctccctcagaaggtaagttttatttttttccagaaattaagctgcagctgattacaaatgacaactgtaaatatgcaaattatacttgctattaaaagggttcctgccttcctgaaacaaaatactgtgtaagtccaataatatgcagatgtagacacataataaatattgcttgatgcagaaaactggtgagatgaattttctaggttccaagaaaagcagaaaaataagcttggaaactttaaatccaggaactgaaaattaattttgattgaactaatgttgaatttatgatcttttgggaatgcactaagctgaatttacctctgtatttttttttgaggcaaattgatagtacagagatctcagaggagtgtttatatcactaaacaaaattctcaaatagaaacttaaaaatacaactgaaaaattagttgcaaactaagtttatattctcatctaagtacatactctactctcttccactagaaaatatttcatggaaacatgggaaaacaggagcggggaggggccctatggctgtctagtgtaattctttaatgttacagaggatggaacgaatccagagaggttcaatgacttgcccaggaccattcaatgtgttagatacagcatggactataatccagcagagtaatcaagtactgttttcatgacaccattagacccatctcaatattttaatggtcaatgttatatgttaacttgagtgggccacagggtgcccagatatttggtcaaacattattcatagagtgtctgtgagagtatttctttatgagcttgccattggaatccacagactcagtaaaggagtctgctctctctggtggcacttaactaaccagctgaaggcctgagtggaaccaaaaggctgcaattccctcaagtaaaagcaaaagagaattcctcctggcttactgcttgagttggactgatcagttcttcttggaacttgggcctgccagcttttggaacagaacttacaccactggctctcctggttctcagggcttcagacttgtcctgaaactataccatggctcttctgggtctccagcttgccaactgcagatcttgagacttctcaacctccataatcaggtgagacaattccttagaataaatctgtttctccaccccatcttgttggttctccttctctgaaaaaccctaattttaatattaaacgaatctttagctcaatagagtaaagaaaatggtctcagtgggtatggtagacattatgcactagctacccaaaatccatttaacacctctcttttctcttgacttcctcttgcataaaggctaaaaagctaaaatacagttcctagcctcttctatagctaaaggtggccatatgacaccattctgaacaacaaagtaaatgacatcatttttgagcaataaagtgtaggtagatatccttaggaggtcttccctttgctctttgcctcttattaccccatcttttttctccagagcttagatacactgactggggtttggaagcatcagtcatcttcagactgtaaggacaaacccacatgctagggatgactatggaggaagacagaaggatttcaggtccatgatgagatctatgagtcgctgctgtcatcttggattacttctccagaatttttagaacatgcaccccacctactaaagctacgtttagttgggctatctgttatttatagccaaatcctttcctaatatactattgcagcccagatgtcacctgttacaataaaactaagatcactatgacccccattttaataaaagatcatcattcattcactcaagaattttctgaagatccaccatattcatggcacctaagaggaactaaattcaagagccttctcatttccaaccaaggatgctggtggaaagctaccttgctaacattccagatcatggtctgggaggaatcccagggcagtttcccatgatttctgtcattcttgcctgtggcaaaaggctaacaataaagtagattgaatcttcaggagctattagaatattcaacttttcccacttaattcccttattttcaaaagttcttcttaaggcaaaatggatcatgttcatggactcctgcagcattagaatgagctcagggtcctttctcatgcagtgagagcaactacctctcttgattcatgttgccaatgggagttacagtgagttgtggtatactggcaggagcattaggtttagtcatgacatctgggtgtcagacttggttttgccactttttcctttaagtcccaggggtaagtcctgggataagtctcagaggcatatctctgaacctttccgagtttcacttcctaatttacttataattactcagaccaagaaagataacaattacgaaagaattctagtgaggtaaacattcttccaaagtaagatttctttagacaatctgattatgtgaaatatttcatattggacctaaaaataagtaggtccaacatgaaaaaggtatatgagtaacagaagaaaagtccattcattatcttcatggcatttactttgtctctcctttctcagagtaaaagttgttacataagtgatctcaatctaataatgtgctgcagtggaaaagccttatggagcaaatgttaaagaaacagagagacatcatcaagatggctgactagaggcagctggcactcatctcctccaccaaaaagaaggaaaacagtcagcagataaccacaggttaaacagagcatctaagagggaacaatggaattcagcacaaaagggacagggactctccaaggcacagagaaagagggaagataagcagcagtctcagccgggattggctcagagccaggaaaggctccccattgtagggaaaaggtaagcaagaaatctccagttgtccacattaccaccacagatgcctgccatcctagccacaggagagctgctcagcttcacaggccctgagcctagtatagggagttgactggagtccatcatggaattgttcccaagggcattcatgctgcattctagtcacccctcaggacccaaggtgctgtggcatggcaccattttaagagcccagcaacaaccagactatatcctgccctggaccccagaagcccctccattccacatccctggaatgccactgatattcccccatatccactcagagggctgcagtatcatgaggccagctggaccaagtggtacagccagatatccagtactctagcccacactgtgtcctataccctggggaccagcagaaccagtgcaccagggaggctgcccccatgacaaatggagctgaagcacattttcctcaaagcatgggagctgcctgcctggggccactgccacctacagcgatgccaccccttccaaggacaaggccaccacacacctgtacatgccttcaggggacctgagaaccagctctctggggcacaatgtccagaggccccatctgtatcctatctgggggctggaagataggataagcctgcacatggcatcaaggaaattgaggacaggcctgggtcaacccatctccagtggtgccatatgcaccattacaaggcctgcagacagtctcatgtcatttagacacctaaggaccagaatgcctggcccactgccaccatcaccagtacctacatgtgccaacaaggggcctaagaaccagcccacctggtgtctccatccccagcaaaggttgcccaagcctccactaacaatcacagcctaagccactaaagaacctgtgatcactgctgacactgattatggacaaagaaataatatgaagaccacagtactgttcctacccaaaatcagagctaaagaactctacccaacaaatactgtaaatatatctacatgaaaaagtcattctctatgaaagccaatccaaaaacttagaagaagcaattatgacaccagatgcacagacgtaaggacacgagaaatgcgaaaaagaaaacatgacacctacaaagcaacacaataattcttcagaaaaagatatcaaagaaaaggaaatctatgatatgcttgaaacgaaatgcaaaataatgacctcaaggaaactcagtgatatacaagagaacacaggtaaaacaatatgaaaaactcagaaaagcagttaatgatctgaataaattcaaagagatatcgtaaaaagaaccaaagagaaatcctaagactgaagaattcaatgaacaaaattaaaaaatataatcgagaagcttcaacaataggctagatcatgaagaaggaatttctgaattgaaggcagagcttttgaaataacacagtccaaaaaaggtgaaaatctaacaaaaaagaatgaagaaagcctaagtgacatatcggacatcataaagtaaaaagtattcaaataccgaaatttccaaaaggagaagaaattataaaagtcagagaaaacaggcagagcaagatgctggaatagaaagcttcaccaattgcccccacccccacaaggacaccaagttaacaactatccacacagaaaaaaacaccttcatgagaaccaaacgccagatgagcattcacagtactggcttttaacttcctattgcgaaaaggggcactgaagacatagaacaaactgtcctgaatcgccagtgccacctctccctgacccccagcagtggtgcgtggtgacaagagcatctctgggtgctagggaagggatgatatagtttggctccgtgtccttacccaaatctcatctggaattgtaactggggcttgcatcccctgaaataacagcctgagctgtaccttggcctcttttacccacagctggagcaggtgggatgccccaagtcccgaggctgcacactgcaggggggccctggaccctgcccataaaaccattttttacctcctaggcctctgggcctgtgatgggaggggctgctgtgaaagtctctgagatgccctagagacattttccccgctgtcttggtgattaacatttggctccttgtttcttatgcaaatttctgtagccagcttgaatttctccccagaatatgggtttttcttttctaccacatcgtcaggctgcaaatgttgactccatgtctcacatccaggtcatgtggggattatgggaagtacatcttgaattgtaatccccataattctcacaggtcaagggaagaacctggtgggaggtgattggatcatgggggctgttttcctgagacgggggtgagttctcatgagatctcatggttttataaggtgctcttcctgctttgctcttcgttttctctctcatctgccaccatgtaagacatgcctcttcctcttcactatgattttaagtttcctgaggcctccctaaccatgtggaactgtgagacaattaaaactctcttctttgtaaattacccagtctcaggtaatatcttcatagcagtgtgaaaacagactcatacaaggaagaatacagcaattgtgaggcactgaactcagtgctgtcctgttagaggagaaaggaaaagcaaaccaaactcacctgatgttgcccacagagggagcatttaaactagccctagccagggggcaatctccaatcccagaggtccgaacttgagtgcctgcaaacctcaccactgagggccaaagtactgttggcctctaagtaaacctgaaaggcagtctaggccataacgactgcaactcgtaggcaagtcctacagctgaactaggcccagagacagtggacttagggggcatgcgacatactgaggcaccagctgggacagccgagagagtgctggcgtcacccctcccctggccccagggtgcacagcacctggctccaaaagagaccccttccttctgcttgaggagaggacagggaagagtagggaggactttgtcctgcatcttggataccagctcagccacagcaggagagggcaccagcagagtcgtgaggcccccattccagaccgtagctcccagatgacatttctagacatactctgagccggaagggaagccgctgccttgaaggaaacaacccagtcctgccagcattcatcacctactaactgaagaacccttgggccccgaataaccagcagtgacacccatgaattacatcgaaggccttgggtgagtctccgggacttgctggcttcaggtgagactcagcacataaccagctgtggtagctacagggcaaaactccttctgtttgagaaaagcagagagaaaaataaaagggactcaactaccaacatcttaggtaccaagaaccccaagaatgggttcctggggtccctgactccaagacttgagtcttagcatttctgggcctgccttcggccggagggcagtcctctcccctgactagagtcccaaatccctgcaacattcaccacgagctgactttagagaccttgggccttaagggaatgttggcagtaatctggcaatactccatgtggccaggggtaaaggtggctgcggggtgaggctcctgtgcctttggaaaaaggagggaagactgagaaagattgagtcttacagttttagtgccagctcagtcgtaatacaaaagaataccaggtagacttttaaggtctgactcccagacagtacttctggacccacctggggcctgggggacctcatggccctgaagggaagggcataggccttgctggctttgccacctgctgattgtagagccccagacccttgagcaaacacagtcagcagccagggagtggttacagcaggtcttgggcgagacccagcactgtgctggcttcaggtctacataaaagcagaaacatggaacaatggaacacaacagaaaacccagaaacaaatatacacacctatggtgaactaatttttgataaaagtgccaagaacatagaaaagacagtctcttcaataaatgatgctgggaaaactggatagccatatgcaaaagaatgaaactacaccactatctctcaccatatacaaaaataaaatcaaatggattaaagacttaaatctaagacctcaaactataaaactactacaagaaaatattaaggaaaatctccaggacactgggctgggcaaagatattttgagcaataccctataaacacaggcaaccaaagaaaacatggacaaatgggatcacatcaagttaaaaagcttctgcatagcagaggaaacaatcagcaaagcgaagagacaacccatggaatgggagaaaatatttgcaagctacccatctgacaaggggttaatcaccagaatatacaaagagctcaaacaaatctatagaaaaaacaaatctaataatctgatcaaaagacggacaaaagatttgaatagacattgctcaaaagaagacatacacatggcatacagacatatgaaaaggtgttcaatatcactgtcagagaaatgcaaatcaaaaccacaatgaggtatcatctcaccccagttaaaatggcttataataaagacaagcagtaacaaatgctggtgaggatgtggagaaaagggaacccttgtacactgttgatgggaatgtaaattaatacaaccactatggagaactgtttggaggttcctcaagaaactaaaaatataactaccataggatccagcaatcctactgctgggtatatacccaaaacaaaggaaatcagcttatcgaagaggtatctgcactcctatgtttgttgcagcactgttcacaatagctaagatttggaagcaaactaaacgtccatcagcagatgaatgcataaagaaaatgtggtacatatacacaatggagtactattcagccagaaaaaaatgagatccagtcatttgtaacaacatggatggaaatgaaggttattccattaagtgaaataccagtctcagaaagacaaacatatgttcttacttatttgtggtatctaagaaaaatcacacgttcttatttatttacttatttattactaaaaaatcacatgttcttacttatttgtggtatccaaaaatcaaaccaattgaactcatggacagagagagtagaaggaggcttcccagaggctgcaaatcgtacgtggtttacaggggacgtgaggatggttaatggggacaacagaaatagaaagaatgggtaagacctactatttgatagcacaatagggtgactatagtcaatgattacctagttgtatgttttaagataacttaaaaaatgtaatcggatcgtttgtaactcaaaggataaatgcttgaggggatggataccatattttccttaacatgcttctttcacattgcatccttgtatcaaaacatctcatgtactccataaatatatgcccctactatgtacccacaaattttttaaaaaataaaataatttaaagtcagagaaaacctatttaacgaaataacagccaaaaccaaaggaattcatcaccactagactagctctaaaaaaaattcttaggagagtcctatatccagcagcaaaaggacaatatttgccatcatgaaaacacaccaaagtagagaactcactgatagaacagatacgcaaatgggaaaaagaagggaatcaaatgttatcactacagaaaaccaccaaactgtaaaggcaaacaatacaagaggaagaggagaacaaaggatttacaaaacaatcagaaaacaatttttaaaatgtcaggactaagtcctctcatataaataaccataactgtaaatggtttaaattcccccaattaaaagattggctggataggtaggaataacaacaacaaaaagaatctaactatgtgctgcctacaaaaaaaatcacttcaattgtaaagccagattaaaagtgaagggatggccaggcatggtggctcacgcctgtaatcccagcactttgggaggccgaggtgggcagatcacgaggtcaggagatcgagaccatcctggccaatatgatgaaaccctgtctctactaaaaatataaaaatcagctgggcgtggtggctcgtgcctgtaatcccagctactcaggaagctgaggccggagaatcccttgacccagggagttggaggttgcagtgagctgagatcgcgccactgcactccaacgtggtgatagagtgagactccatctcaaaaaaaaaaagtgaagggatgacaaacaatactccacgcaaacagaagccaaagctgagcaggagtagctgtagtgtatcacacaaaatagacattaagtcaaaaaacaaagagagacacaaaaggtcattaaaaatgataaaaacatcaattcagcgataggatataaccattgtaaacatatatgcgcccaaactggagcacccagatatacaagacaaatattattagggctaaatagacagagagaccccaatacactaatagttggggacttcagcagtggacagatcatctagacagaaaatctacagaaaaatatcacacttaatctgtaccacagaggaatccagcagatgtttacagaacatacatccaacacctgtagaatatactttcatctcatcagtaaatggaacattctccaagataaatgatacattagtcctctaaacaaggcttaacacatttttagaaactgagatcatatcaggtaccttttcagactgcaatgaaataaaactagaaatcagtaaaagaaactttggctgtacaaatacatgaaaattaaacatgcttcttgggtcagtgaagcaattgagaaaaagatcaaaaactttattcaaacaaatgaaaatggacatacaacatatcaaaatgtatgggttacagcaaaagtagtgttaagatggaagtttatagcaataaacacctctataaaagaggtaggaagatttcaagttaaaaagtctaacaatgtatctcaaggaactagaaaaacaagaataaaccaacatcaaaattagtagaaggtaagaaataaagatccaaacagatctaaacaaaacagagattaaagaacaatacaatacaaaagatcaatgaaacaaaaagttttttgaaaagataaacaaaattaataaacgacttgctagactaagaaagaaaaagactcaaataagtaaaatcagtgaggaaaaaggggacattataccagattccccagaaattcaaagcatgattagagactgttagcaacaactgtatgccaataaattggaaaacctagaagaaatggataaattcccagtcacacacaaactaccaaggttaaaccgtgaagaaaacagaaaacgtgaacagaacaatagcaagtaatgagatagaaacagtaataaagcctcccatcaaagaaaagcctaggacctgatggcttcactgctgaattctaccaaacatttaaaaaagaatgaataccaattctactcccactattccagaaaaattaggaggaggaaatacttccaaagtatatatataaaaccagcattatgtaaaaccagcattaccctgatgctaaaactagacaaaggcacaacaacaaaaaactaaaggccaatatcactgattagcatagacacacttttttttcaacaaaatactggcaaaccaaattcaacattaaaaagatcattcatcataatcaagtgggttcatctcagggatggaaggatggttgaacatatgtaaatcaataaaggtgatacatcacattaacagaatcaatgacaaaaccatatgatcatttcaatagatgttgaaaaaaactttcaataaaattcaatatgccttcatgatgaaaaaaatcttaacaaactgggtatgagggaaacatacttcagaaaataagggccatatatgacaaaccccaagctagcatcacacttaattgggaaaaactgaaagcccctcctttaccacgtggaacaagacaaagatgtccactttcaccacttttactcaacacagtactggaattcctagccagagcaattagacaggagaaaaaattaaagggcattcaaattagaaaggaagaattcaagttagccttgttcacagacaacatgatcttacatctagaaccaagagactccaacaaaaactgttaaactgataaattcagttaagtcgcaggatacaaaatcaacatacaaaaatcagtagcatttctatatgccaacagcaaacatctgaaaacaaataaagaaagcaatcccatttgcaacagctacaataaaatagcataaacacctaggactaaacttaataaaagtgagatctctacaataaaagtataaagcattgataaaagaaattgaagagaacataataaattggaaagatagcccatgtggattggaagaatactgctaaaatgaccgttctatccaaagcaatctacattttcaatgtaatccatatcaaaatatcaatgacactctgcacatgaaaagaaaaaggcaatccggaaattcatatggaacaacaaaagcaatcctggacaaaacgaacaaagctggaggcatcacgttacctgacttgaaaatgctctataaaattacaaaaagcaaagtaagcatggtactagcataaaaatggacatatggaccaatggaacacatgaaagaacgtagaaacaaatccacacatttagtcaatggagtttcaagaaagtcatcaagaaaatacattgagaaaggaaaatctagatagcccatatgcaaaagaataaaactagacccctatctctccccatatacaaaagtcatatcaaaacagcttaaatatttgaatataagacctaaaaccatgaaactactataagaaaacattgggtaaacacttcagacattgagctgggcaactacttattgagcaagacctcaaaagcacaggcaaccaaagcaaatatagaaacatgagatcaaatcaagctagaaagcttctgcacagcaaagaaaataatcaatgaagaaacaacctatagaattgaaaaaaaaatttgcaaagtattcattggacaagagattaataatcacaatatataggaactcaaactcaatagcaaaaaacaacccaattaagaacaggcaaaatatgctgaattcatagaaatggccaacagatatataaaaaaatgttcaataacattaatggtcagggaaatgcaaattaaaaccacaatgagctatcatctccccagttaaaatggctactataaaaaagtaagaaaataacaaatgctggcaaggatgtggagaaaggggaaggctcacacattgttggtggaatgtaaattagtacaaccactatggacaacagtaaggaggttcctcaagaaactacaaacgcaactaccatataaccaaacaatccaaacgttggatatagatccaaaagaaaggaaatcagaatatcaaagagagatctgcactcccatgtttattgctgcactattcaaaatagccaaggcaggggtcgacctaaatgtccatcaataagtaaaaaaaaaaatgccatatatatatatatacacacacatatacacacacacacaacggaatatagttcctctatgaaaagtaataaaatcctgtcatttgtagcaacatggatggaacttaaagacatcacatgatgtgaaatatgccaggcacagaaagacatatctcatgttctcactcatacatgggaactaaaaagaaggtgattttatagagatagtgaatacaatagtggttttgaggctggaaagagtagtaggtagagggattaagaggggttggttaatgcatacaagattacagctcaataggaggagtaagatctagtgttcagctgcacaatagggcaactatagttaatagtttactgtatatttcaaaatagctagaagagaaaatttagaatgttcccaacataaataaatttttgaggagatggatctcccagttacccagatctgatcattacacattgtatgctggtatcaaaataccacatataccacacaaatatgtacaactatcatatatcaataaaaatgtttaaaaagcaataaagagcatttaacttggaagaaatcacattgtcctccctttgcagacaacatgaccttatatacggagaaactaaaagactccaccaaaatacccttagaactgataaattcagtaaagctgcaagatacaaaatcaacatgcaagaatcagcagtgtttctatacaccaataatgaactacctgaaacagaaatcaagaaagtaatcccatttacactagctacccaccccccaaaaaaagacacctaggagtaaatttaaccaaggaggtgaaaggcctctgcaataagaactataaaacattgataaaagaaactgaagagaacacaaatggaaaggcataccatgctcattaattggaagaattaatattgttaaatgatgatactatccaaagcaatctacagattcaatgcaatccctattaaaataccaacgatattcttcaagaaatagaactaatgatcctaaaattaacatgaaaacacaaaagaccccaaatagccaaggcaataccgagcaaaaagaacaaagctggaggtatcacactacctaacttcaaaatatcccacaaagttatactaacaaaaaaaacatggaattggtataaaaacagacatatagaccaatggaacagaacagaaaacgcacaattaaatacacattatttataggcaactgattgtcaacaaaggcaccaagaacacacagtggggaaaggacacctcttcaattatttgtcatcagaaaagtggatatccacgtgcagaagaatgaaactaaacccttatctgtcaccacacagaaaaatcaaccaaaattaattaactactgtgagcctggaaactataatactaaaagaaaacagttggtgggactgtaaactagttcaaccattgtggaaaacagtgtggcgattcctcagggatctagaactagaaataccatttgacccagccatcccattactgggtatatacccaaaggattataagtcatgctgctataaagacacatgcacacgtatgtttattgtggcactattcacaacagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccggggcctgttgtggtgtggggggaggggggagggatagcattaggagatatacctaatgtaaatgacaagttaatgggtgcagcacaccaacatggcacatgtatacatatgtaacaaacctgcacgttgtgcacatgtgccctagaacttaaactataatttaaaaaaaaaaaaagaaaacataggggaaacacttcagaacattggtctaggcaaagattttatggctaagaccacaaaagcacaagcaacaaaaacaaaaatagataaatgagactgtattaaaccaaaatgcttctgcagagcaaaggaaacactcaacagagtgaagagacaactataaaatggcagaaaatatttgcaaattatgcattcaaaaaggaactaatatccagaatatacaaggaactcaaacaactcaacagcaaaaatatcacaaatattccaattcaaaagagggcaaaggatctaaatagatatttatctaacacatatagaaaaggccaataaaaatgcttatcagcaaccatcaggaaaatgcaaatcaaaaccaaaatgaggtgtcatctcaccccaatgagaatgactattatcaaaaagaccaaaaaaaataaaaataacaaatgctggcaaggatgtggggaaaacatactctcatactaggctggtgcaaaagtaattgtggtttttgccattaaaattaatagctacccactcccaaaaaaagacacctaggaataaatttaaccaaggaggtgaaaggcctctacaatgaggccactgccattacttttaatggcaaaaactgcaataacttttgcacccacctaatagtatagccattatggaaaacagcatgaggggttctcaaaaaactaaaaatagaactaccatacaatctagcaattacagtactgggtatttatccaaaggatagaaaatcagtatatccaagggatacctgcagccccatgtttattacagcagcactattcagaaaaactaagatgaaatcaacctctatgtccatcaatggaaaaatggataaagaaaatgtggcatacatacacaatggaatattattcagtcatgaaaatgatattctgtcattcatggcaacatggatgggcctagaggacactatgttaagcaaagtcagtcaggtgcagaaagataaaatactccgtgttctcactcatatgtgggaattaaaaaaaatggatttcatggaagtagagagcagaactgtgggtactagaggctaagaaggtggggagaggttggttaatgaacacaaacttaggaggaacgaatctgctcatctgcagcactgtagggggatatggttcactttattttattgtatattctcaaaacgctaaaagaggattttgaatattcatgacataaagaaatgataaatatatgaggtgacagatatgctaattaccctgatttgatactacacatagtatacacataattaagtatcactctgtatcccaaaatatgtgcaattattatgtgtcaactaaaaacaaaaggaaaaaactataaggataaaaaacagatcagcggttatcaggggttggggtaggggtggtagggttgactataaagggacatgagggcacttttttgggaaacgaaaccattctgtatcttgattttgatggcagtttcatgactgggtttgttgaaatcatagaactgtctcactaagtagggtaaattttttgcatgtaaattgtacctcaacaaacctgattttattttaaaaaacatttttaaagaaataaactaggtaaaacttggtatgttgtttaccgagcaataacttgtcaatcataacgtaattcaacccacttactacatatgttctactagcactctggccttcacccatccttttaattaaatatttaatgcctacattcccacttgactctaaactccacagatccttacctttggttaaatcggttaaatctcagcttggtgggtgacaaaagttccaggaaacaaaatatatgcagttcaatgagttatcttatttatctgtttcctaccatgtactgagggtcattacttttgggtttatgaaatctaggcagagttctctgaagatcattgagattttgccgtggaggtgtttcaatctggttccatactacataccttgtcctgggtttggcaacggaaacagtcacattcaaagcagtactggtccctcagctgcttccggcgctcctcactggtcatcagcatatccaggtagcagatggtgagctgtgcaggccagagagagggaagcgctgaaacatctgctgtgctcatttctttaacaaatggttattattattgctaattattggagtaaaacttgtttttattataaaccaaaaatataagagagaaggtactgcttatagtttctctacccaaatgatcacacgtaaatttttaatctatttcctttcagtctttgctatgtggtaaatatatatgtatcatatatttaaagaacgggtcttatgatctctacccacttttgtatcttagtttttttcactacaggaaaatatcaaaaactgttgtatgtttactaaggtttgctaataaattctataaccattagcaatcagagaagccaaattaatcctggcaaccgaaagggtggcagatgatacagccagattgctcttaaattctaaccaattctatagctgcctcatggaatttaaggtcatccaaatttggtatctttgaaatgagaaaacagttctcttatttgtatctaggtttggaaaaaaaagggggggtagaataatttccaaataggggagagtttaacttgagagtaccaccactgatggaagcattcaaactgactgccttacaccctttcagagtaatatcccctgcctcggatggtgaagggttataaatgagaggatatatttaaaggactcctcggacactctctaacactgagtcccattaagtcacgggtctttaggcaacatcataatgcttgagcattttgcacttgattagatctcttatgaaagtctaattcaaaatccagaaaacagaatgcttgatcttcccctcaacctgttccatctcggctagagcattctcactctcagttgacagtaactcatcttttgacttatccaagttgaagcctcagagtcatccttgacttcactctttcctttacacttgccatccaatccaccaggaaattctgcgggctccaccttaaaaactacccagaatcaaccactttttaccttttccagtgccaccatcctggtctgagccatcattacctctcacctgtaaaatgtaatagtctcacaactggtctctctgattctttctccaggccccctgcactccaccctctagccagagtgattcacataaaatatgtcagatgacatgttctgtttgaaacatcacaacagctccccactttgcctgagtgaaggccaggtccttctaactccccaagtgcaattcaaagtatggtccccgcattggtgccagtgcgcactgtgggttaccagtccatgacgacatgagtcaagaaacaaagtcaatatttagaaatgttttttactaatttggtaagggtaattttatgtgactctaataataaaacattgggctttaaaaaaaaaaaaaaagacagggtctcactgtgccaccaaggctggtgtgcagtggcatgatcacaactcactgcagcctcaacctcccaggtttgggtgatcctcccacccctcagcttcccaggtagctggggctacaggcatgtaccaccacactggctaattttctgtatttcttgtagagatggagtttcgccatgctacccaggctggtcttgaactcctgggctcaagcaatccttcctccttgacctcccatggaattacaggcgtaagccactgcacccagcccttcatttttctaataatttattttcactagattttataaaaatactggtctgcaatagattatgaaggaaaagaaaaactggtccttcgtcataggtagagaagcaatggcttcacataatcccacctgttccctctcatttcccagtttccctcattgctgctgctccaccaggctggcctcccgtctggctccacacacactcctacctcaaggcctgtgcactggctgttccctctgcccttctgccccgtttactatgacaacctccctcatcgcctttgagtttcagtcaaatcccactttctcgttcaggtctaacctcaatgccctattaagagtaacaacccaattcccttacctgctctagtttttcttttcctgtatcatatatcagcttgtaccagactgtagaaattacttctttgcttttaaaagtagaaagtaatcatggcggtatgtgtggtggggggagaagtgaagactttggcagagcaagaaggcaggattatccactgaagggatgcaaaaaactccctagagcagaaaactccatgtggtttttgttatacttaaaagaaagcatctcatgtctacaaagcatgatcttacttgtttgaaatcatagtagggcaaaggcagccaccctctctggcagaaaacaaagctttgggaaggactctctcaagctgtaggggtgatggtggatggctgggctggccagccagatctgtcaaatccaccatggccgtcaccatcaccaacgggacaggagtcacagcctgatctggctggctggctctccatagattcttcacattaggcaaccataacatgctgctccacacacagaaacaagaatatctgcccttaagagatacagacaatgacgttactgagtatctactgtttgtggcgaggcagcatagcacagtaaaaactggcaaaggtcttgggttcaggtaacactgaagactgcacccagatctcttgataagtctgatgctctttttacttttacatggctgcttctcatacttggcagggagagagggctgtagaagaagctggcgtcccttaaggagtgtccgtagcaccgtcaaacctaaaatactcacacctgtgttagagaatgttctgtggcaactgagatccttcagctgagacaacagccactttttgatttcctccatgtttctcttgcttcatgatctgaagccagggttgcctctgaggcacaaagggtcacctataccaggcaagttcctcttgtttctaatgaatgctatgttccaaattccaaataacctatttccaagctcactttttgaaacagcctatgagtaagtctgggacagtagatagattcatcttatactatcaggctctgtgggtcccagtttccttacaggaggtgaggtagcaaatgagcgcatccctatgtcccctcttgggttaactctaggacactaattctgaatccagcccaatggctcttagtcatcaactcccattatcagagcaggtaaatggacagtagttattgggagattacagtgtgcccagtgtgaagccactaactccagggcctgtcatgccagaaaaaaatgtgcttgactaacccaagactttattacaagggccaaaactcatgagtgatcttgtcaggcagtgaatggccaacaggagactagttatttcatttaaccccaataaatgggctcctaaagcctccctcggcatactgtaactgcctggaaccattacctggactacgcaatggctttctaactggcttccccgctgcctgcagtgtacctttcatcttctaaactgctttgagagagatcttcctaaaactcacatgtgatcacgtcatttctctacataaaaacttgcgatggtttctcactgcccttgaataaaggcacacaaggatttccctcagctgtttttctgtctgcctttctagcctccatgtctctccctgaaccccagcctgtcacagttatgtacattgctagacctctgaaacaatgaacaccatgccaacatgtgtctgggcatcactggctaagcgagcctctcctccacactcagcctcctgagagcctctcatcctccaagcttggctcaaatacacctcttcctatggcgactgccccattacctcagagaaagccacccatttttgtgcttcttttatgccaatgaagtctgcagaatatctggttatcaattgtgaagtgcttaatggcaaaaatattttattcatatttttgggaaaaaacagccagattactaactggtaatgacagctaaaatcatgttattagccaaagataaaaacctttattaaagactcattgactcactagttgtaatggaatatctgctcagtaaatgtaaggctcatttagtgggaatgtatatgtgaaacttggccattgatcagtagacaccttaatggcacagaacaaaattgcattaaaatattaatgccattgaccactgctctgccattttagtgcagctcttatagaaaatgcagtaaatcatttctgacattagagtaatataatgaaggagattttctagatcttgaatacatagcttacattaaaatctcaagacaaaatgaactccttttccatgaaaccatcttttcattgtctacaactgagtggataagatgagcaagttaaggccggccacggtggctcacgcctgtaatcccagcactttgggaggccaaggcggtaggatcacgaggtcaggagattgagaccatcctggctaacacggtgaaaccccgtctctactaaaaatacaaaaaattagccaggcgtggtggcgggcgcctgtagtcccagctactcgggaggcagaggcaggaggatggcgtgaactcgggaggcggagcttgcagtgagacgagatcatgccactgcactccagcctgggcgacagagcgagactccgtctcaaaaaaaaaaaaaaaaaaaaaaaaaagatgaccaagttaaaattagaccttgtttcatttctagaattccgtgatcacagttatgaatgtttctgttaatactggctctgaactggaaaaaagcctgaaaaatgtcacttctttttaaagtcaaacctgagtatctttgtgtctcttgtttcacaagttgtgtccttgtttcacaaatcctgctaattttatcttcttaatattatagtcttcaggtaccctatcacaagccaccacctgagctccccgacttcaggctaccactgttatctcttccctggattattacatcaccccgacgctcattctcccaaccttgcctacacatagaaaagtggtcatacaaaaataagcaatgagcaaaggacatcctgttcaataaacggtgctaggacggctggctagccatatgcagaagacacctaccttgtaccatatataaaaattaatacaaagattaaaaatttaaatgtaagaccacagactttatgcaccctagaagaaaacctaagaaacaccattctggacgtcagctttcggaaagaacatatgactaagtcttcaacagcaattgcaacaaaaacaaaaattgacaagtgggacctaaactaaagagtttctgcacagcaagagaaactatcaacaaagtaaacaaacgacctacagaataggagaaaatattcacaaactatgcatctgacaaaggtctaatacccagaatctataaggaacttaagcaattcaataagcaaataacccaagtaaaaagtgggccaaagacatgagcagacacatttgaaaagaagacataccagcagccaacaaacatggttttaaatgctccacatcactaatcagagaaatgcaaatcaaaaccacaacgagaaaccatcttacaccagtcagaatggctattactaaaaagtccaaaaataacaaatgttggtgaagctgtggagaaaagggaacacttatacactattggtgggaatgtaaattggttaacccactgttgaaagcagtttggagaggagctcagaactaccatttgagccaacaatcccattactgggtatatacccaaagaaaataagtcattctaccaaaaacacacatgcactcacgtgttcatcacagtactattcacaatagcaaagaaatagaatcaacctaagtgcccatcaacagtgagctaaaaaatgtggtgtatatatatatatatatatatacacataccatggaatagtatgcagccataaaaaagaatgacatcatgtcctttgtggcaacatgaatgcagctagtggccattctcctaagcaaatcaatgcagaaacagaaaaccaaacccagcaattacagatttctcataaattgtggaaacaaatatttagagaatctatcgaaccaaacacccaatgttctcacttataagtgggaactaaacactgggtactcatggacataaagatggcaatgacagacactggcactactagagagggaggtagggcaaggggtgaaaaactgttgggtaccatgttcactaccagggtgatgggattcatcacaccccaaagctcactatcatgcaatatacccatgcaacacagctgcacatgtgccccctgaatctaaaataaaagttgaaattatttttttaaaaatcacaattaggttactaaatattcttttagcttaattcaaaaggtaaatgaaattacatttcttttacacttatccattcttaagaatggggcagggacttttataatgaatttaactgtgaaatcacaatttagttatttattgaatataatttaataaaaccccgttaaaagtaattttatcatcttaagccaaaaacaaaaatcaaacttgtatgtatttgtattcaacagcctaaacctgaaagcaccggctcatttcagacttaaaggtaccttcatttaaagtgaaactggtcataacactttcagcttcaatttcagaggagcatgtattagaacaaagactgcctatagaaaatgttaatttaagaatggaaaataatctgtgtagatgtcatcatggaccaacacttctatacacaaaccaaatgttattcaacagttgtagcaatctttcttgccgagtccaaacatcagccagaccacctccaccaaagaccaattattctgctttgatacgtaagatgagatttactatagttttgatagattctctaaatatgtttccacaatttatgagaaatctctaatgtcatattttttttttggacactcaccatttgagctctacttttcccttcaggaaactctaatcacaaatggaagaagaaaatcactatgtagtaagcatcatgtgctgggcactgtcctaggtaaataatttgttacttcaatcctgagaatgaagctttattactaaccccctccacactgcgtagtagtaagtgtagcactgaacaaatcatttcccagtttaaaccttacattttcttccataaaataaaaaaaatgaatatgtaacattatctgagttttctaagattccaaagatggtacagactacttaggtcttactcaattttgtagtccttgggttttgttttttgtttttacctattaggcttcatctattgcttcctaaattgaatcaccctataaatattccctatcatcatagccatggtcgtatatacaaaaagtgaatgaaaggcaaaggaaacatcacgtttcaatcatatggttcaacgagttgagaaaaactcacactacagcaacagtgactgaggtaaaattgaatgtacactgagtaaaatgtttcgtttgtgatatcccaaatctaactcaggggttagaattgggtggggttttaaaaattgttttcttcaagtgttttatgtatagtacatacaataaaaaacagtaacatttgtaaacatgcaggaaaaaaaaaacaagaaaatctggccacgcagttcctttgctgaaacccttcaatcatgtcccgctgctcgtccttctcccttacacaaatatttactgggcgcctcctatagaccagccaatgttatgaaaccttcagctaaaccaaggtctgtgataaggctcccatggggtttgtcagtctgatccctacatcttccctcaaattcgggtcacatctaaattctttcgtcgtctattgatgagaactgcttcctactccttgaactcaccattctgtccctggcctctgtgtctatgtctacaatgccttttccagcctcatccaactctaactccatggatcctttcagagtctaggagtcagtcctctggaagcattccttaaccactctccactccctccccttactaatcactcgagtgctcctgctctgagctgctgtaagcctgtgcccatttacaccactgtgcatcttaattctattattgttttctgttctctgtcagtttcctcaactataccttgaactcttgaagtcagggctgggtcttaataatctttgtattagagaaggtttctaaaactgctaccaactcctgacatccagtaaacatgcagtgaattcgtttaatggtttagcaaataagatgactaacagaagaaacagactgtcttaatcccaaaagacatcagattaagactgacattagggatactaatgcattcaacttgtgtcaatcacatttctcccagttgatatggcgccagagaatgctggcagccaatggcattatttgtaacagctacaagttattttaaccaggaactaccataagactgctttggcctacccagctttcctccctgatccatgttttataaaactatcagaacaaatgaatctcatatttaagataattttgaaaaggtagccatcagcaatccagtcaagtgagccatgacttaaatgatattacacatctctctctgtaggaggcggctgaatgaggagacaaaaatccaaagtcaaataaaaaaaaaagacccaataactcagcattacaatggagagccttaaatagcaaagtattataaatgttgctggtttgcaaggaaactgtccaaagagggtccaaaggatggatttatatagagagaaacatggggtgagaaatttccatggcaacttctgttatcacagaccttgtgcaattttccagctctccttgtgtgaggtttgaaatgctcccatcttaaactggcagtagactggctttcatattcccttcctttcaggagccatgggacaccactgaggactgccagtcatttgtaaatgtctgagactctattccagctttttttttttttttttttttttctgagatggagtttcactctgtcgcccaggctggagtgcaatggtgcgatcttggctcaccgcaacctgcgcctcctgggtttaagcgattctcctgcctcagcctcctcagtagctgggattacaggtgtgcgccaccacacctggctaattttttgtatttttagtagagacggggtttcaccatgtcggccaggctggatgcaaactcctgacctcaagtgatccacctcccttagcctcccaaagtgctgagattacaggcatgagccacggtgcccagccctattccagctcttattttatctttaagaagtctcattaatttactcaacaaatgttgattgaggaacttctgcctcagttgctgttgagtcttccattgtgaatcccatattctgacactcagatcccaaatagctcatattaaaactgtgggtgccctaatgagcactaaagccaaatgcaaagttcatgataggaaattaccaaaatgtctaaaattttttcccaaggaattttaactttcaaaaaattaatacataatatttatacatatttatggggtccaggtactattttgctacctgcatacgatgtgtaatgatcaagtgatggtatttaggttatccacgacctcatgtatttaccatttttgtatgttgggaacacaaaatgtctagatttattccttaatttaaagctaatatttgtacaataaataggaattaccctgcttaatcaatgcctcaaactgtcttttctcatggctctccctctcccctacctctgctccaaggggtcagtttgaaaggcataggatatattttagttgttgggggatggctacaggcattagttaagcacacgccaaggacacaagtcttctccaatgatgcaacaatcccacacgatgaagaactgtcccattcaaaatggcaatagtgtccccacaagaaatactgccggtcattagagtaagctcaatataatagagagtcgattcaacaaaaagttatcaaatgcctcctggatgcaaagctaagtgctaagagatacagaaataagacacgattgtctgtcctcataaagctctaaatagagaggtctccaaaacagccataatatgtgccaaaaatgtattaataaccactataagcgagaactcaaaggaaaagaacttcttctaatatgggaaatcagggaaagagttacacaagagatgtgattgaaagggtatcttagtccattttctgctgttttaacagaataccacagactgggtaatttataaataaatttctcacagttctggagtctgggaagcatgatgccaaaagcatggcaccggcatctggggagggccttcttgctgcctgataacatggcagagggcgtcacatgaggtggcagcaggagtgtcctcttcttataaagccaccaatctcatcatggggttcccaccctgataaccttatctaatctggattacttcccaaagactccacctccacaaagcatcagcaagaatttggggataaagttttcaacagatggaatctgggggacatgtttaaatcataacaaacagcctcgaagggcatataacattaagacaaagagacacagtggacagaaacgatgatgaatcaggggaaacactgttcagcaagacctacaaaatggaatggagaaatgtttattctcttaaactggtatatatgaaggacttgtggggagaaccttctttttgttgagaagatgccttgctaagtaccacagggaaaaatatctgagtctgaagggctttacactgagtggaaatgtctcgtatttggcaagagggaggatttgcttgttgctccagagatggaaagagaaagatgtgaaaaagtgaaagcagcacctaaagacaaggtgtcttattcaactaaatgaaaagcaaccacgggagaatgactggcagccgagcctaggaaaatagaagaaactttctttgttgtttctgaaaattccaaccaactctaattgcttttgtcaagttacttggtttgttttttaatttgcaaaaacatcgtcatcatcgacaacagcagcagccgctcttcagcccccaaatgaatattgctgaaaatagatagcggtttcatctcttacctgccttgaagtcctttgcggccccagaaaaaaaagagaaaaaactacattgtccatctcactgacatctatcccagtatatttcatacactggtcctaaaatctggaaatttagcgagtagttgtataagaagtggctccttccactgaaaatcagtttggggagaatcttgtcaaagccaaatccctgtctacataaaatatggtacctctgagttgaggttttattggctgagtgctgcataaatgcaataaaagctttcagtactgttttccttgcaataaatatccactttagcaaattggaaaggagaaggaaacggggttctggaaagtagaaatatctgtaactcagaactcagcatgggtagtcactgtgcaaaccagtgcaagcttaggttcagagccctggagcagcccgtttgcagctgtcttgtaagaaggttctgcaccaaaagaggctggctggacagtctgtcaaactggaggggtcaaggccagttcactgctggaggtcatcctccctgtcctctattccctttgcatctttgctgaaatgatcacccagagatgctgatgggtttgtcaagtcccaatgtcagcctgagacagtataagctgtttgctttactagcacaaagttaacatgcatcattaccttcaatgtagccagtggccttccgagtgaagaagtcttggggatcccactcacaagctgggatgcccccccctgcccacggaaggatatgagaggctgctcagctgttgccactgaggagatttcatgaattccctgtgtgtgcataaaacacacaccctctgtcatacacaaactcctctctctctcacacacaggacaggaactgtcatcatccagaaatatggtgacctctcccctaaaaaattagcccatttgtaatttgggagaagaaaggataggttgctggggagaggtgactgaactacaaatactctcactggcagaaggacaatgaaaagttgtcccctcaggcacaatcagttttagggacgggccgagctgagagggtctttgataggaaagaaggccaggctgggaagcatgagtttccttacctcctctcccacctcgatgtctcggactgctcgcagtaagaggtggggcccattgaacacaatcgaacagttggggtcacagctgtgattgagcaaagagatactggaaaaaaaaaggggggaagactgtcacagctcagcaggtagagtcaactaaatttaacaaatgcagtgggtaaaatacaccttcctttggggggcagcagcaggtagggttgacaggatgccaggggttcagtactcggggatgcattcacagaaatgtcactagcacacctcccacgaagtgcaattctcctcaagatgcaggctaactagggaattccgtcatttaataataaaaaaatttcctgagtcctttttggggattggggcatagttgactgattagataacagtcaataaggcaacccaacacgaaggtcagaaagaaactgactcagaaagaaatacttagacagctgggtgtggtggctcacgcctgtaatcctaggactttaggaagccgaggtgggtggatcatttgaggccagcagtttgagaccagcctgatcagcatggtgaaaccctgtccctactaaaaatacaaaaaaattagctgggtgtggtggcacatgcctgtagtcctagctactcaggaggtggaggcaggagaatcgcttgaacccaggaggcggaggttgcagtgagccgagatcgcaccactgcactccagcctgggtgacagagtgagactccatctcaaaaaaaaaaaatactcagacataatgggatgcagcagccaagataccactgacctctcccataggatctcatttgttgagctcctttggagaaatggccgcctttgctagaacatccacactgaaaaataattaggactatttgctcttaaatagagagctgacgttattttgccacctacatcctgatgcatcctgggccatggtccagtcattttattaccttggagggacatttcttaccatctgggaaacaaaatggatttaagctgctatcaggaattggtaataattagaatgagcacttactatgtagaaacactttcttgcacttgagcatgttcatcacatttaatcctcacaacaatcttatgaggatcatttacaggtaaagagactgatgcacagaaattaaatgacttgctcaaggacatacagctagtaagtggtgatggaatttggaccaggtggcctgaacgcagagcccatgctttgaatcatcctatgttactgccttttgagaaccacctaccagtagacctgacctacagttaatgacaattgtgagaaataagaaaaaaggctgaattcttagattcacaattattagaaagtctaaatttgtatttggactcttatggcataaaaacaaaatgaaactgggtgtgcctatagtgcttgtggagagacggtttcatagctcagtggtaagagtcagctcagcaatagctggagagagcattcaggggccaaagcctgagagttttcttgcctccttgagtgaaagggctcagagtgtgccaactcgaaagacaacatgaacccaactgatacgtacggcaagtccggtgaaatcagcatgtgctgcagctcaggaaactggggaataaccaaaaatcagcccgatggttaattagcacccaccgtcctcaacttcttcacccaaagtccccctgagaacaagagtttagttctgagatctgcccctttgttaatatcacagcatataatgtggggttataaaactgttttctttcaacttaacattttccatttttttgtaatttattgctaagttttaagcttggctcttgaacaagctgcagcaactgcctttctaactacctccaaagggctggggatttgggtgggaatgaaagtgtgtcttccagtacatgaagtaccatacaccatacctgggatataggccaacaccaacttcctgcatctccgcattacagatggtgaaagagttgcagatcacctgtaaacacaaggggaaccatcagtattactagagtcacttaagaaacttcatagccaagagaataaaaaacgttcaaacccaaatgtaggagcatcttagtagttgcttaagaaagagccaagccaatcatggatgctctttgacttacaacagaatttatctgggatatactccccctaaaaacatcaggtggttaagtgcagaaataccaacctcctgggagaaaaaaaaaaaaaacagacggaaaccagcagaggaaccattaatttcagtctcattatccactaccccaaagttacagttacatgaactgttcaaaatccagaatatgaataagctatttattgaaaactagactcctgctgtatcacgattttttcaaactgcatgcagtttccaaatgccactgtgtatctgttcagtgatagcaacttgtctcttactcctacagaaagcgaagtatcccgtgactgagcctgtcgtctgatgcgtgttggtgaagaccacagggagcactggaggtcatttagtcaagccatggtatttaccaggagtccatcactgggtacatgacacagtcctgtcttatgcagggacggagcagaagcagtaaaaaacacaatcgactgtgctcaaggaacttaaaaacctcgtttgtgaaataaggttgatgtatgaggtcacacagaaccatggaaagagcactggaccagaatcaggaaatctagattctggctaaaatcactgcttcagacaggtgcgaggaaaagagcagtgaagaaaaacaaaacaaaagttcctgcctccgtggagctcaagttctagttgaatacacagattttttaaaaaacccaatgatagaaaactgtcacatgtagataaatgccaaggagagaaacaaggtccttacagagaaaaaaagttgtcaagaaagctctttaggatgagttgacatttaagcaatgacctgaagggactgctgaaatgaacgtgtgtatttataggcgataaaggctcatatcaggagaaagagcaagtgcgaaggccctacgctaggaatgcccgtggtaacagaggaacagcaaagaggctagtgtgaccaaagcggagcaagaaagtagggggcaaaacacgagctcaaagacggagtgggatcacttacggccctactgccatatttgggttttgctctgaagaagatagaaagccactggattttgagccaaggcatgaaggagtctgacttctgctttaaaaggatcattctggctgttgtgtagagaatgggctataaaaaggtgaatggaagtggagaaaatggttaggaagtcactgctatagcccaggtgatagacaatggtgactcggatgtcggtagcaggagaactgggtagcacagccaacaggccttacttactgcgggacggcttgtggggaatgaaaggagtcaggataatgctcgagtttttggccgaagcaagtggaagatcatagctaccatttattaagatgaggaagaatttaacaggaacaaatttggttacagggagttgagagcaagtccaacagttctgttttggttaagttaaatttgaaatccaagccaagactaagaatgaacaattggagttcacaagaggagttgcgcctagagatataaatttaggatgaaacatgacaaaggccatcaaaaaacaaaaaaaggagaagaggctaaacatttgagatgaaccagagactacaaatggatgctgacttgttataaagtttctgtaaaggaaaaagtgatgacgaatttctcaaatcaggtttacatgaaagaacacgaagtatgaaaacacactgagtcctctgagactcttccactgctccaaacagctcttacatgaaatctagtgcactctagcatgatttggcttttttccctctaaatatataaaattgcagtttcaaatcaggagcaaaattatacatatatatttgtaaacaaatgctaaattgctttaaggacaactattttgcattaagcagcaacagtacattgtctatatatacttatgtataaattggatggtaaaaatataagacagaaagtcctacgtttaatttttgaaattttaaacatttttaaatgtgtataatttgggaagggatacaagttttaacaaatattttaaagtataatgagaactttagttgaaataatccaccaacaaaaaaaccaggtcaaacacatctgatctgttaacttctgaatcaaaccagcatggttttttcctggactatgaagcaaattaacggttttttcaaaataggaaaaatctttatcagtttttttccatcggtttatttcatggattctgatggaatgtttaagaaggaaaagctaacaagaggaaatgtcagcttgcttgtctcttccactgggaaactcttcctgatttcctaagatgacttccctctttagcagcatttatcatactggatcattatttacccatttacttgccatcatacacaactggatcgtaaaatacttgggagggcagacacagtgtttcattcatcactctagtcctgtacctggctcaaagcctggcaaacagaagacactaataaatctatttccttttcttagagacaaggtctcactctgtcacccaggctggagtgcagtggtgcgatcatggctcactgcagcctcgaactccggagctcaagtaatccaccctcagagcctccggggtaactgggactacaggctggcaccaccacctctgactaattttttaaaactttttgcagagacaggagtcttgctatattgccctggctgaccttgaactcctggcctcaagtggtcctcccgtctcggcttcccaaaatgctgagattacaggagtgagccatagctcctggatttcatctatattagtctgagtgttacgtgttagtctttctgggctagtaaacagaaggtttagttttttgcctactctcacttttatttaaaatgctggctccatccagcactatctcaattaacaacctgacaggaaatatttttgacatacacaactgatagcaacagtggatatgcagaagctctctggcttttttttagtgcaagaataggtagataatatgtccatgtgtgctcaataatttgaaaggaattgctctttatatcaagaattaaaagaatggaaataaagcccagaaataaaagtttaaacatttttcaaagtactgtctttgtgaaaacagttttcttagggaattgcacaggttaaaacaattaatgaatgcttacttcacaaaaagataacatttagaaaaaaatattaatggtactacttcaataaaaaataaatgcaactgggttaatgaattctttctaaaaattaagcttgagtattactttagaaatttttaccatgtcttaaaactaaaacacatatttaaattgttttattattgaatgcaaagttatatttactttctgtaatttttcctttaaactaattgaaagccttcatatataatattatagtttttctagatgacaaaaatctagtgagttgtcattgagcctctgtattttataaaaacaactacagtgaaacttaaaatgttctgtgaaccaaattcttatgtcatttggttcagagtctaggtccagaatctgacatttgtgtcctgaggttagcaattccccggtagattagacacaaatagcaaaatcaataccaacacacaaagtgaataccttacaaaatgagtgtattaccatgtattcaaatttcatatttttcctgaaattcttaggactaaaggctttgtattgtagcagcagttaaactgagatatttgcaacacaagagaaaatcactactaagccattatcttgcaacggtaaaaatcagaacagccataagcaaactcacaaccaatcagagctgagtaattctacaccataagacaagaacccagccacttcccagccccctcccccaattactgaattctacacagcctatttcaaataatactttcaatttcccaatatatatacaaattttaaaacacatttaaaaagaaggggattcagtttctgaacacaactatacagaggtttcctccaagaccatctgcatctcctttaaaacttttctgtctaaaatgttcagtacagtgtctggcacagaagactttaggcacatcaagtttactaactagagggactaaatatgagttttcaaaacggagtttaatgtacttagttttattaaaccctggacagaaaaactggaaggaggaagagttggcaggtacgaaaaccagaagcagaagcttttacactacataactgcctctgccccccggcaccccgactcctagaactaatatttctctaactttaaaagcacaataagaattttaatcagggtatatttttctctacccacagaatatgacaggttattaagtacagatttttttccagaatcttctcataaaccttaagagattaaaaattgtatctcccaatccctccttatctgtatggcaaatatttatccatccttcaggacccaattcagtccttgcctgtcccattgcctcttttggtcacatagttaaagggtttgaaatctccaaaccagaacagcgggaggggaccaggctggcgacggaggtcagctcaggagaggagaggctatacttcttaaatgatgattcgcaaatcccagaatccacaaagtgttaccggaaggtttacgagagtacaggtgatttcggcatctgtttcaatttcaattaaaaaaaaaatccataatagaaacaatgaccaactacatttccctttgccaggaagttgctggagggtctcaagttttaccagggagcatgctgtaaggttgcggggacaaaggcccatgctcacgacttagtcactaagctgcatcttcactacactgctagtcttgcgacagtttgacattatagttttccattgtttcttagtcacgttatttcatttgcaaacctaatggacccctgattaaagacagaagcaagtaggagatatgactccaaagcacaatgtagacaaatggggttgcatcaaactaaaaagcttctgcatagcacaggaaatggtcaagaaagagacaacccacagagtgggagaaagtatttataaaccatacaacggataagaggttaatacctaaaatatataagaaactcaagcaacacaatatcaagaaaacaaacaacccaattttaaaatgggcaaaggatttgagtagacatttctcaaaagaagacatataaatggtcaaaagattcatgagaaaatgctcaatatcaccaaatgctcaatcattaggaaaatacaaaataaaatcacaatgaggtatcacctcatgcctgtttcatcaaaaagatgaaagataaaccttggtgaggatgtggagacaagggaattcctgcacactggtggagtctacattagtccagccattatgaaaaactgtacagaagttactcgaaaacctcaaaatagaactgccatataatcaagcaatcccatttctgtactcaactaactaaaataagagatatccgtgctcccactctcacgtgcactgcagcatttttcacattagctacgatatggaattgacctaagtgtccatcaacaaatggatcaagaaaatgtagtatagatacacaaatggagtaatattcagcccttaaaaagaaggaaattctgtcatttgcaagaatatggatgaacctggaggacagtatgttaagtgaactaagccaggtacaaaaagacaaataatccatgatctcacttatatgtggaatattaaaaagtcaaactcatagtaatagagtataatggtggttaccagaggcatgggctggggagagaaatggggagatgttggtcaaagggtgcaaagtttcaccttcttcacaggaggaataagttcttgagatcaccacagcatgatgactacagttaataataaattgtatatatatttcaaagtttccaagaaaaaatttcaaatgcctcaccgtaaaaaatgacatgaggtaagggatatgctaaattagcttgatttaatcattccaccttgtatacatttaccaaaaattcacattgtactctaaatatatacaattgttattcgttaattaaaattttaaataatttaataagacagaaagcaaggatgttgaaaaacaagggaaaatacataaaatgataattctataaatttgtctcaagatgctttatatcatgacttaccaggttgaaattcttatagagcatctcaagacatctctaatatttgaaaaaatgttaggaggagaacatacactgaatacgtaatcttatttttttttttgcagatggcgtgaagaccacgaaagtccccagtgtgtgatttggaatgtgcttgcactttgctacctaaaacctttcttgtcttataatcgagaaaaagaacatagaagtcatgaaacataatccagctggtttcttaaagagttaattataagaatgtgaagcatcaggtcatgaaagcaatatgcaacctaaggcccaaagcaataatatttcatttaaaaatttgtgttgattaaggccaggcgcagcggctcactcctgtaatcccagtactttgggaggccaaggcaagtggatcgattgagcccagaagtttgagaccagcttgggcaacatggcaaaacctcgccactataaaaaatacaaaaattagctgggcatgatgccatgcacctacctgtaggtccagctactcaggaggctgaggctgcagtgagccatgatcgcgccactgcactccaatgactgtccccgccacaaaaaaaaatgttgtggtaataatgtttttacaaaactaatttacagcaggttaaaccatgcgatatcacgtgataaaggagaaaactaaaaatttgtctttatatgctatgattattaaagattttacaaattcactttgtaatacaagtcaagtaaaaaataaaataataatattatttaagaaaactctttatcccaccacacatgacaatatatttgggaatttgtctttctagactgagatacatccaactgttttcacaactgcagtggtgtctgtcccatttcaagctctggccacaaataagtctgcagtgcacactagacacacaaaatcctcaacaatcacttgtcaaggctaaaatcaatatcaaggccaatatcataaggaatggcaatcataaaattgtgctttctattttatctctctcccacagtcaaactgccaaatgttagcaaatgaagcccctttagataacatgctttctaaaatccacagattttcattttctaaaagctttactcacaacagaacttataaacaactatccttgctaatagcaaaatagtcacatatttgtccactgttccttccctgaggctcttacctggcatttcacctccttaaagccatctgatgaaacaagcacttaccacagatgtctgtcaaatacgtagagaaggtataaagctctgacacatcattttcattgtttcattttcttcccatatcctgaggctcagaaattcttcaataatttattacaagacatcattataggtttccatagctccacggtcacatctaccaatttcatttagatgtgctcctacccaaaaggtttatcacaatgaactgaactttctcccatgtatcgcacttaaagattcttttgttcagcttaaatcttcaaaaacattctcttctatgatactctagtttcattattctctaagtaagtggtgtggaaatccacccccagcagtaccaggacgcctcactgtaatcttactcccagtactaaattcctaaatcaagtatgctaggtgctgcatagcacctgactgaagttgaattagatatggcagcgtgtggctcaagttatctgtttttccgtcaaattaatggagaaaaggaaactacagaaaaacgttacacgtgaaaggtaagactgcacactaatcaactgcttaaagtaatccccaaatgaaagatacagtgcgtgctgaggttcctttcactatgtagaaattaaggtgaatattctctccgggtgaacttttggcaggcaagggtttgccataccgatgatgcctgacatctcagggagtgaaacccagaagcaggtatttcacatgacagtagctgaagtgtgcatgactcgtgtacaagctgtgcgggcccgcatgaaggtattttggggactagtgcgtggctgtttctggcagccaatgacaggctagatggggagcaccttggggggccactccttctttggttgcccaagcatgcctgatccctggatacagcccgataacctagtgggcaggagccagggaagaacaaacacagatcagacgagagagagtcacaactttaattatgcagtcaagaggcatcaagaaatgagtctctgaggtcagacagcccctcttttgatctctccaggtatgctcctttatttttggaaatatagaaagaaataaaagaggaaatttatcatggcttcattccaactcctacactgttcctttgtacagaagtagctcataattcttccccttcttcttccagacacttttatagatggccagatacacaaatcagactggtgggatttcaatgcaaggatatcatttgatcttttgtcttctcttctggtaccatttttaactagtcaccatcatgaatacataaatagtgccattcccagcctctttcctgaccagattcctgagttggtaagtagctaaaacaccagcatactgcccctacaccgcttcagtgagttgctgcagcaatttgcaaggaaggttcccctttcctgactcaagagttcatcagaatgtgaagaaaagaggagttcaagaccaccctggccaacatggtgaaaccctgtctctactaaaaatacaaaaattagccgggcgtggtggcctgaggctatattcccagctactcgggagggtgaggcagaatcacctgaacctaggaagtggaggttacagtgagccaagatcacaccactgcactccagcctcggcgacagagcgagactccatctcaataaaaaaaattaaaaaataaaaaaatttaaaaaaaaaagaatgtgaagaaaatagataatttagaaaagtagattaaacatattttcttttgtaatggacattgctgaaaatacagtttgacaaactcttcttagctagttagcaggaccctcttgactaagaaagcattatagaagtatcggtttaaaaagatagacaggccaggcaccatggttcacacctgtaatcccaacactttgggaggccaaggcgggtggatcacgaggtcaggagatcgagaccagcctggccaatatggtgaaaccccatctctactaaaatacaaaaaattagctaggcatggtggtggcaggtgtctgtagtccaagctactcgggagactgaggcaggggaatcgcttgaacccaggaggcagaggttgcagtgagccaagatcgcaccactccactccagcctggcgacagagcaagactccgtctcaggaagaaataaataaataaatagccaaaccctggcctagaggagacaggctgactgttgggtccagatctggtccccatcaacttttctagtctcttctctagtgtctgccttctcatgttttcctctcagttttcctgtcttcacaccttcatgtctctgccaggtggaacagtcccactgcttagaatgttctcccctccttcctctagctactgaaataccactggtcccttaagaacggttcgaaagtcttttcctgtgggaggccttcatgtcattgaaaaagaagaagagagagggacagctgcaatcactgtggctccagtcggtgccggggagactgggtggtttggactgggaggaattctccacagtgcagcatagcggctatggcaaatcatggccagactgtttctttaggtgggtcacagatccatccctcctcaccttcccctcagggaatttcagcaactccagccaggggtttacggacagaactctgatctccccgggacacagcactggggggaggggcagctatggtctctatgttcagcagacttagtctttcctgcctgctagctctgaagagtccatgcagtctggacaaggggaactccccccagcgcagtgcacctgctctgccaaggggcagccacactgcttctttaagcatatccctcatcctgtgcctcctgactgggtgagacctcccaactggggtcactagatacctctgacaggagcattctagctggcatcaggtcagtgcctctctgggaggaagctcccagaggaaggggcaggcagccatctgtgctattctgcagcctccactggtgatacctccaggtgcaggaagcacccaggtgaatacggtctggaatggactcagcaaaccacagcagccctatggaagagggtcttgactgttaaaaaaacaaaacaaaacaaaacaaaaaaaaacagaaagcaccactaccaccgacatcatcatcaacaaaaaagactccacaaaaaccccacctaaaggtcaacagcctcaaaggtcaaaggtagataagcccacaaagatgagaaagaatcaatgcaaaaatgctgaaaactcaaaaagccatagtgcctcttctccttcaaatgactgcaacatctctccagcaagggcacagaactaggcagagtctgagctggatgaaatgacaaaagtaggcttcagaaggtgggtaataacgaacttcactgagttaaagtagtttgttctaacccaatgcaaagaagctaagaaccatgataaaacattacaggagctattaagcagaataaccagttgagagaggaacataaatgacctgatggagctgaaaaacacaacatgagaacttcacaatgcagccacatgtaacaacagctgaacagaccaagtggaagaaagaattctgagcttgaagactgtcttgctgaaataagacaggtagacaagattagagaaaaaagaatgaaaaggaatgaacaaaacctccaagaactattggtttatataaaaagaccaaatctacgaatgattggggtacctgaaagagctggggagaacaaaaccgagttggaaaacataactcaaggtatcatccaggagaacttgcccaacctagcaagacagaccaacattcaaactcaaaaaatccagggaaccccagtaagatactccatgagaagatcaaccccaagactcataatcatcagattctccatggttgaaatgaaagaaaaaatgttaagggcggccagagagaaaggccaggtcacgtacaaagggaagcccatcagactaacagcagatctctcagtggaaaccctacaaggtggaagagattagggatcaatattcaacatttttttcgtttgtttgttttgagacagagtctcactctgtcacccaggctggagagcaatggaacaatctcggctcactacaacctctgcctcccaggtacaagtgattctcctgcctcagcctcccgagtagctgagattacaggtgcatgccaccatgccaagctaatttttttgtatttttagtagagacaggttttcaacatgttggccaggctggtctccaactcctgacctcaagtgatctgcctgcctcagcctcccaaagtgctgggattacaggtataagccactgcaccctgcctcaatattcttaaagaaaataatttccaacccagaatttcataactggccatactaggctttataagtgaaggagaaataaaatccttttcacacaagctaatggtgaggaaatgtgtcaccaccaggcctaccttgcaagagctcctaaaggaagcactaaataaggaaaggaaaaactgttaccagccactacagaaacacactgaagtacacagaccgatgacactatgaagcagctatatcaacaagtctgcaaaataaccagctagcatcatgatgacaggatcaaattcacacataacaatattaaccttaaatgtaaatgggctaaatgccccaattaaaagacacagaatggcaagctggatgaacagctgagacccatcagtgtgctgtgtttaagacacccatctcacgtgcaaagacacacgcaggctcaaaataaagggatacaggaaaatttaccaagcaaatggaaagcagaaaaaaagcaggcattgcaatcctagtttttaacaaaacagactttaaaccagcaaagatcaaaaaagacaaagaagggcattacataatggtaaagggttcaattcaacaagaagagctaactatcctaactatatatgcacccaatacaggagcacccagattcataaaacaagttcttagagacctacaaagagacttagactcccacacaataatgggagactttaacaccccactgccaacattagacagatcatcaagacagaatattaataaagctattcaggatctgaactcagctctggataagtggatctgacatacctataaaaatctctaaccccccaaaacagaatacacattcttctctgtgccacatggcactcactctaaaattgatcccttctaattgttttactaattggaagtaaaacactaatcagcaaatgcaaaataactaaagtcataaccgtctctcagaccacagcacaatcaaattagaactcaagattaagaaactcactcaaaaccacacaactacatggaaattgaacaatgtgctcctgaatgactcctgggtaaataatgaaattgaggcagaaatgaagaagttctttgaaaccaatgagaacgaagaaactatgtaccagaacctctgggatagagctaaagcagtgttaagaggggaatttatggtactaaaagcccacatcaaaaagctagaaagacctcaaatcgacatcctaacatcacacaactaaaagaactagagaaccacgagcaaacaaaccccaaagctagcagaagacaacaaataaccaagatcagagaggaactgaggacagacacacacacactttccaaaaaaaaaaaaaaaatcaaagaatacaggggctgagttttttttttttttttttttaaataaaataggccactagctagacttaaaaagggagaggaatcaaacagacacaatgaaaaatgataaaggggatatcaccactgatcccacagatatacaaccaaccatcagagagtactataaacacctctatgcaaataaactagaaaatctagaataaatggataaattcctggacacatacatcctcccaagactaaagcaggaagaagtagaatctgaatagatcagtaacaagttccaaaattgaggcagtaatagcctaccaaccaaaagcagcctaggaccagacatattgacagctgaattctacaagaggtacaaagacgaagtggtaccatttattctgaaactattccaaacaattgaaaaagagggactcctcgctaacttattttatgaggccagcgtcatcctgacaccaaaacctggcagaggtacaacaaaaaaagaaaacttcaggccaatactcctgatgaacatcagtgtgaaaatcctcaataaaatactggcaaaccaaatccagcagcacatcaaaaaacttacccaccatgatcaagtaggctccatcccagggatgcaaagctggttcaatatttgcaaatcggtaaataaatgtaattcatcacataaatagaaccagtgacaaaaaccacatgattatctcaatagatgcagacaacgcctttgagaaaattcaacaccccctcattgtaaaaaccctcaataaactaggtattgaaggaacataactcaaaaatattaagagccatatatgacaaacccacccagccaatgtcatactgaatgggcaaaagctggaagcattcctcttgaaaactggcacaagacaaggatgccctctctcaccactcctattcaacacagtattggaagttctgaccagggcaatcaggcaagagagagaaataaagggtactcaaataggaagagaggaagtcaaattgtctttgtttgcagataacatgatcctatatctagaaaactccatcgtctaagcctaaaagcttcttaagctgatgagcaacttcagcaaactctcgggattaaaaaaaaaatcaatgtgcaaaaatcacaagcattcctatacaccaacagacatgcagagagccaaatgatgaataaactcctattcataattgctacaaagagaataaaatacctaggaatacagctaacaaggaaaataaagaatctcttcaaggagaacgataaacctccgctcaagaaaatcagaggacacaaataaatggaaaaatattccatgctcatagataggagaaatctttattatgaaaatagccatactgcccaaagtaatttatagattcaatgctattcccattaaactaccattgacattattcacagaattagaaaaaactattttaaaatccatatggaaccaaaagagagcctgtagagccaagacaatcctaagcaaaaagaacaaagccggaggcatcatgctaccaaacttaaaactacactacaaggctactgtaactaaaacagcatggtactggtacaaaaacagacatatagactaatggaacagaatagagaactcagaaataagactgcacatctaccaccatctgatcttcgataaacctgacaaaagcaatggagaaaggattccttatttaaaaaatggtactgggggaactggctagccatatgcagaaaactgaaactggaccccttccttacacattatacaaaaattaactcaagatggattaaagacataaatataaaacataaaactataaaaaactccagaaaaaaatctcggcaataccattcaggacataggcataggcaaagatttcatgaagaaaacatcaaaagcaattgcaacaaaagcaaaaatggacacatgggatctaattaaagagctttcgcacagcaaaagaaactgtcatcagagcaaacagcctacagaatggaagaaaatgtttgcaatctatccatctaacaatggtctaatgtccagagtctacaaggaacttaaacaaatttacaagaagaaaacaaacagccccattaaaaaaatgggcaaaggacatgaacagacacttctcaaaagaagacatttatgctgccaacaaacatgaaaaaaagctcaacatcactgatcagagaaatgcaaatcaaagccacaatgagaatctcacccactcagaatggtgattaaaaagtcaagaaacaacagatgctggcaaggctgcaaagaaatagggatgcttttacatggttgatgagaatgtaaatttgttcaatcattgtgcaagagtgtggcaattcctcaaaggcctagaagcagaaataccatttgacccagcaatctcattactggttatatacccaaagaaatataagttattctactacaaagatacatgcatgtctattttctttgcagcactattcacaatagcaaagacaaggaattaaatgtccatcaataatagactggataaaaaaatcatggtacatatacaccatggaatactacacagtaataaaaaggaacacgatcatgttctttgcagggacttagatggaactggaagtcaatatcctcagcaaactaatgcaggaacagaaacccaaacaccacatgttctcacttataagtgggagctgaacattgagaacgcatggacacagggaggggaacaacatacactggggcctgtccggggattgaggggcggaagaacatcagcataaatagctaatgcacgctgggattagattaatacctaggtgatggggtgatagctgcagcaaaccactatggcacatgtttacatatgtaacaaacctgaacgtcctgtacatgcacccccgcagttaaatttaaaaaaggaaacagcacagcaatattaaagatagtactgcctgaaataccacaatttaggttttttctctgaagagccagaaaggagatacaggaagagctgaatacaagtgacaaagaatctgaacaggagaggagagatggtctcagagttgttccaaacttacttgtcctcaaagctctcctccaccaccttcctccaccgcatgtggaggccacctaaaaatcacaccactcaacacattgttttctatcaaacaggtctttacactaaatcccaaatatgttgtccatgagaggaacatctgacgttcccacgccactcacgcctcaaagcacttcacctcacctcttccagttctccaatcccctcacaaagaagctatgagtacagtatcttcatgaaagaaaggtaagagaactcaacagacgcttctgaggctacatggtccgatgttctcacgcatcaaggaaatttggtcaaaataacctttgcagaaaactcagttatgaaggaagtacgtacaggcagagtggggagggggttaagctaaaggtcgggtctgaaacacagtgttgtacactagacccatcagaaggatagatttgttcattcattaagggtctattatgtaccaagcacagcgccaggcactaggaagaaaagaggaaaaattgtcccttttaatcatgttgctattatttcaccgcccaagtaaaacaaaaatgtaaaaaactccccatttctctctaattttgacaaattttagccttcctcagccaaagattattttcctgactattggccatatttctttgttaagtcactctgtcaaaacataagttgcaataatgcggggcagcgtcgaatctgccagatcaatttagaaacaaatgagtctgctgctcttccgtggccctgggaggcgggctggcctccacgtactgtcagatcgtccacaggaagaattgctggggattactgaagaccagctgggaagcgtcaactaaaatggatggcctttgaattttccactctcccattgtctaactatagccagccgccattcccaaattaatgccacagagagagagatattctctcctaaggcaggctgcaaagataaatcggctacaaaagagcaagtagctaaaggaagaaacagaaaatgaagccttggcactctgtcatgtgaatgtcacagtatttgcaggaattcatacacggcacaaccagagacagaatagaaaagtaagcttccttcctaccccggtcctcctccatatccccccaaaacgaacccaattgtttcctgttttgtgaatgccttctgctaccccatgtcaccgtattttaaaacatcagggattcagttgctttatgtggggtaaaatgtgttaaatgtgcctgcatttctaaaccatcggctaatgagattttattaggaagagcccagaaataaattaccagaatttaccagaaagctataaaatggagggattgtgaggattaaatgagaaaatacatgtgggccttggaatgactcagggcatataggaagcttagtaaatggtagcaagatcataattattaccatagttcgatcaactgtaagacccactcaataaacagtccacaccattatgttacgtaccactaagaaaaaacactaccaattaaactgtcagcctgtgtattataaatcagatatctcagaattaatgaaatacagtatcactacatatacctctaggtttccagaagtaagtcacagtgtacgtaactagtgacaaagattctttacttggccaaactcagaggagattctttacttggccaaattcagaggagattcacgcctctgaatctcctaggtccatccgtgttgttcctcaaaatccagttttagcaaaagaaccctgcctagccggtttcgccagaacctcggtactcagaatcttcatgttcctcatccttcaccaccctcgggtgctgtctgatcaccctggcctgtcttcagcaagaatccagttaggtaagaggggcctcaaggtgactgagaagatgcatctggaacttgcttcctccacaaagaagaatcgaaacagcaggacggaatcgcaactggaaacagcaggacggaatcacaactggaacagatcatctaacagagaacagtggaattcaacatggaagtgacaggagacgcctaaggcaagaaaggagagggaagcaaggcagcctctttggctgggaccctgaagaggctccccactgtgtggagagagtaagtgagagatgcccagccgtccacattcccacatggactcctgtgatccgagccacaggagagccccttgtggtccttagactaacagagtgctgcccggggaccacgctgtggcactgctccagggagggagcttgtgctgggccccacatactgctcgagtcctaagcagctacagcacagcaccattttgagggcccagcttccaccaggcagcatcctgccctgggccccaaatagcccttgaatgtccacattcctggagccccattgatatcctccaccacagccactgctggctcctgctgctgccagggctgaagcacaagccactagcagtgaccctgtggccccagcagcaaggccaccatgcacatacaagtaccctaggacaggttaacccacctgcagccaccacctaggaccaaagcacacactcttcaggacacctggcccagttccaccagccccagtgaccaggcaagccatgcaaaggcctggggattgccctaccccgtccatccaccactgtgggcagctgagcagttcctctgcaagcctgaggatgggcctgcccgacctgccgctaccagcacatctagcatccattgcatgtgccaactgcaggcctaaggaccggactgcccagccgggtgcagccaacaccaacactggccacttgggagccaggggatcctcctgccattgctactgccattgcctatgccacgcccattgcccagacgcccaaggaccctcccacccagcacactgatgccacctaccaccagcacccaagcaagccaactggatgcccaagaactgacatgcctagacttgctaacgtggatgccagtgtacacagccttgaggccaaggacaggcacatttagcccaccaccgccaccgtggggcccaaggactggtgcgcccggggtccctgtccccagcaaaatttcactgcagcttctgctaacaaccacaccacccagagccactgaggaaattatagacaccacggatgccgatacagccaaaaaagaaaaagaaaaaaaatcatatggagactacactaccgtgcgcacccagaaccaaaaccaaagtacccaaccaaggccggatgcggtggctcacgcctgtaatcccagcactttgggaggccaaggcggtggatcacttgaggtcaggagttcaagaccagcctggccaacatggtgaaaccctgtcttcactaaaaatacaaaaattagccaggcgtggtggcacacacctgtagtcccagatacttgagaggctgaggtggaagaatctcttgaacctgggaggcacaggttgcagtgagccaagattgtaccactggactccagcctgggcaacagagtgagaccctgtctccaaaaaaaagaaacccaccccccccacccccacccaaccaaccaagaaacaacaaattaaaaaacacagtgcccaacccaaacaccactatagacctatcttcaggaaaaatcctcccctgtgaatgcaaatttaaaaaactggaaggagcacaagtcactgtctgtggaagagaaagcgaaaaataaataaaacaatttaaaaatggataataaataaatggaagaagcaattgttagaccaggagtgcagacatcaatttaaggacacaagaaacatgacaaaagcaaggacatatgactaagaaatacattaattctccagcaacaggttccaaagaaaaagaaatttaaaacatttttattaagtagtaaaagaagcctgacctaatactgttaggtgaggttagccagaatcccccttacctggatatttcctcttggtaattttccatctaccgacccccacactgccccttggctaccaattcccacgtgcccacaatgtatttggagctgagcctaatctttctcccccagtgcaagacctggttgcagtggtccctgtacctatcgccatggtcctgtgctttaacaaacaggactgagtatttttttctgtaacagcaggatctgagtacaggttgttggtgtcaccacagccacactaggccctgaacgtctgaccaccccctgttcttggagcctcagtcactacacagattggctcgctctggccttcttgactcttaacattgcccagaaggattcaccaccactttcagcgtcatagttctttgctttcaccattccgagtcggtcgtcatagaatatgctatcatatgtcactcaaaatccaaaatatgcctccgatataaagttacactgcttatgccaagtcagtggtcttgccaaatgtggccatactctggaggtgactttgtgcacatatgttcccagtattttctatccatgctcagttaagcagtgccatttcccttggcacagagtttaaattagttatttgcaaacgtaaattcacatttctttttcacctatcacaccgctctctctaaataacagagtaaaaacacttacgcagataatttgggtagggaaactggggatggatttcacagtcattcatcattagcctgacaagtctttgagttagggattgaacactccggcatattagttggctatttgttattgagagcaccagctctcaagatcacaggacatataaggtaagtgatgaaggatacacaatggcatttagagaaactacacaagaactgaagaaaaacaaggaggcacattgtttctgcatcactcttattacctgcaaaccaggggatggataatttaaaataccagcggagtccacggcagccgacagcctgttaccttccttggttacagaaagatgcgggggtgaattacccactccatggctgctttaccgcgatgcacagtacacgtcagatctcttgaaaatactcgtcgtggctcactttgggaggctgaggcgggtggatcacgaggtcaggagatcgagaccatcctggctaacacggtgaaaccccatctctactaaaaatacaaaaaattagctgggcgaggtggtgcacgcctgtagtcccagctactcgggaggctgaggcaggagaatggcgtgaacccgggaggcagagcttgcagtgagccgagatcgcgcccctgcactccagcctgggtgacagagcgaggctctctctcaaaaaaaaaaaaaaacaattgccatgatatagtcaattcctacctcctacgagtctgactgtgctgcttgtgatctgaccaggagaactctccacttttcccctgtgttgtcctttttcataatccctgcttagtaatcacttccaccaagaagaaacgtctcaactttctcatgtgtgagattcaaccagtcaccctactcttcattattacaaacaaaaggtcaagttctccttttcttgagttatatacagatttaattagttatttctaataaaaaataaaattccacatgatcctttctttccctctagctttattttgcacaaatgctctcatttcccccctacatctaaatgcaaaacagaatatattcactaaaggaatcagggtttgatgattacagcaaacaactgcatttgcatatgtgaggtttccaactttgaattcaaagacaataaatagcaaaatgatttagattagaatttgccgtttctggaaaaaaaatgttatcaatgacaggaaaagaaatgttggtgtcaaagaaaataaaacagaaatacctgtaaataaagatgagtatctatcaattataccatgataaagctgggtgggagggagattattactgtaaaacttgtttgaaggggaaaaaattaaccaaagcattatcaataaacgactaaaaagctgaaacgtaaggatcactttgggaaatgaagcaaaatcaaacaccaggaaacaaggcatgaaaagaaaaggattaagggaacagatgagttgatgacaaaaaagttacaaagaccaggaggaaaaagaaatatgagaattaccgattgtaataaagaaaaagaaaaagactgacaagcataggaaaaaaaatgacgtttttatggctgcttgatgatagttcagtccattgtcaacctaactagaatcaatcagaaagccgatcctcagaagcaaatgagtgaagaggcctctgggtaaaggctgagagtactggttgatgggcatcactgttaccactgttctcacctaacttgagaagattgtgatactagctccccaaatgctcctgttaatggcatgtaccctactcttagcaggtctcacattctgtgcaaaaacactgaaagtcaacataatatgttttgtagtgtaatggagacagatcaggtttttactaagctaaaaggagatacagccttggctacgcactcgagcagaacgctgtgaaaacgcatactaaaatgatgagcctgaactccccacataccctcaagtgcatacagggttgtgtctctgcaaaagcctctacccattgaggtttccttgtgcaggggatagtctgtatctagatgctatatcaaggtgaagatcaagtatctttagttttcataaaatactagattccaaacagaaaggtaattatcagacagagtaggtggcaattagaggctgagcaggaggctctaagaatctaaaaggaatttggtcggcatgtgatcatgaaatccccaaaacattccagaaagtgataaaaataaacacctttgggtaaagtgttatttccccaaagaggaattgaagctagttagatctctttggtcataatatatattatcagtatatctggagaaagaaacaaagcaagattaccttttcttcttcttcttccatagtttaaatttgctacattgggaaacttcactgcacattaatatatcaactccaactagaccaaaatctttcaattaactaaaaacattttttaggatgtaactctgaaaaaaataaaaagtgagaaaaagcaaacataaagtaaactggcttaaaagtagggttcagtttgttttgttttgtttttgagacagagtctcgctctgtcacccaggctggagtgcagtggtgtgatctcggctcactgcaagctccgcctcctgggttcaagcaattctctgcctcagcatcctgagtagctgggattataggcgcctgacaccacgtctggctaattttttgtatttttagtacagacagggtttcaccatcttggccaggctgatcttgaactcctgacctcatgatacaccagccttgtcctcccaaagtgccgggatcacaggcatgagccaccgtgcctggccaagtagggttcagtttttaaaaataaacagcagcaacaacaaaaaccccacatgtactttcaaaagtatgttctgtgattactcttgtgcctggttcttcaaacaaacacaggacttttcacaaatgaagcctgcatgttcaatgctgaataagattaaaacgtgtttagctcattgtacctacagaaacacaacagaacttcagcaagattttcaacaatgattattttaattttaaaaaggattttgtgtaactttgtttaaatctgataatcctctttacttcaaaaaattaaagaagaaagtgaaagtaatacttggaagcaaaatgaaactaacacgaagtgtatcaggtacttttccacattaactcactgatgtaattaaattacaaatgctcagcgtcctaaggggtcaacactgtaattaggaaaagtgtatttctccttagtccttataccatttgccctggtataaatgcttgtagtaaacattgttactctttctcagacaagcgttttaaagatgctagttaaaatgtagttggtagctagtttcctgagtcaatatggcaattataccaataaaattgcagatcaagatgagccagaggcagtaaggaacaggccaaagaaaaacaggaagaaaaggggacgataaagaaagtggtaggccaggtgtggtggctcacacacctgtaatcttagcactttgggagactgaggcgggcagattacttgagcctagatgtttgagaccagcctgggcaacatggtgaaaccctgtctctacagaaaatgctaaaacattagccgagcatgctggcaggcaccagcagtcacagctactcaggaagctgaggtggaaggctcgcttgagcccccaggaagcaggggttgcagtgagccaatatagcaccactgcagccactgtccagccttggtgacacagcaagactgtcgcaaattaaattttaaaacagtggtagtttattccaaattcatgtgctaatcaaatcatatctctgtgccactctcacattcagccctttcttcccgtttccactgcaggtatttgtctcctgtattcattatctcttacttgcaactttccaagtcaatctctctggtccctgtctttttccaaaccattctttaaattgtcatcagataaatcttttttaaaaacagatttgattttacaaaagagaaacaggagatctacccagtagttgcagaataaagacaaaattctctcgtgtgacatcaaacgccccctataatctactcccatcctgtgtttccctgcacccaacacgtatttcagttatcctggcttctctgtcattcccaagtcaggttgtgggcccatgtggtgttttgtttttgtttttgtttgagtctcgctctgtcgcccaggctggactgcagtggcgcgatctcagctcactgcaagttccgcctcccgggttcacgccattctcctgcctcagcctcctgagtagctgggactacaggtgcccgccgccatacctggctaatttttttttgtattttttagtagagacggggtttcaccgcattagccaggatggtctcgatctcctgccttggcgtcccagagtgctgggattaccggcatgagccaccgcgcctggccgcccatgtggttttatgtcttttctttttttttggcatatgattgccaggtcatagcttttatatctttattcatagtttcctcttttaaaaatatctttttcactactgcgatcgctcataattttattcatcctttaggatccggcttaaatgtcacctccttcaagaaactttcctacatccaaatagatttacctgatacctgagtatagatagtacagtatattgttataattgttctattttagtattattgttgttaatctactgtgcctaagttataaattaaactttattgtaagtatgtatacataagaaaaaacagtatacatgaggttcagtactatccatggtgtcaggcaccctctggggtactggaatgtatcccccatggataaggaggcactaagcaacatattgtatgtttagctttgcatacttttggctacttacagatggaatcatactgcattgatgattttgcaatttgttttgggttttttttttttttggctcaacattatatcctaagattcatttatgttgatgcatgttgctatagtttatagctgacagacctcttgatgtgtcttctaggaggcgcttatgaagagaatttccataggaacactgtttgtaaatgcaaaaaattacaaatgaccctatgttcattactaggttatacaaatagataacattattttctattttttcatttttcagagatggggtctcattttgttgcccaggctggtctcaaactcctgggatcaagcaatcctcctgcctgggcctcccaaagtgttgggattataggcgtgagccacagtattcagcctcttggtattttctatactagcacctactaatgtatatggcacatagtatactctctacaataaatgctttttaagataaacgaatttgagaagaaaagttatgtctgattcattgtggcttcctcatccatagaggccagcacatgctcagatgctcagtcaagatctgatattcagccacaaaaggctagcagtggacaggcaggaaataatctgagctgacacaagtgagggagcaaaacaggacgtgtgacgtgttgggtgcctacccctagcgaggcaggcagagcattattttttatgaggttaattccacctgcttacttttgagtcctacaaaccactgtagttcacaagaattcctttcttctcttgtgactctctgtctccccagcctcagctaattccctctccctgtctttgtctccctccttctacttctcctcctcctcctgtactactcccctactcccctgggtatgagcctgcttcggtactctgggaagggtttagtgatggtggtaaaaactgacttcttgatttccttccttgcctgccagcgaagtcatcttccagcaacttcttccattctgttggagcaatgatttgtctctcactatgccatcctttggtttgaacattgcatacccatcttaaggcagttgatccaccctgcttattgcctttttggcatattggatgccagctcttgagcagaaccaaacccctggaaaactgatcaccatctcaacatcttattaaactaattctcattttgctaaactagaaacgaatcatcaggctaacactgccagtgaagatgcaatgtaagacaaattataccaaaccaccaataggcatgtattcatctgcagcaccagccaactactctcaaaagaactgatacagaaaatgatgaaaaggaattaaatccaaaagtaaagagacgactgccaactacagataagattttccatgaaattgagtattattcggttcatctcactctgacttcattttattacagtttagacctgactagctaaaaaaagaaagaccatcgctttgacacacaatagaagtaaaaataaagctgacatgtcaccctttccttcattcctgttttcaatattcaatcttccccctttccctttcccatcacctactacactcacttccactgtaacatttctttctcctctcttagaaaagatccttagaggaaattaaaatgtggccagtccttactctttaacgtcaacgtttctctcagcatgcacttctctaacttgagctatcatttcactaaaataactcaactctttcttttctgaatcttccctagcgttgctgtatttcttacacccgcttggattcatgcccactcgctgctcaggatatattgtgtctatacttgagtaggcacaaaatgctttttcaaacaaaacgtatctgtcatatcagtactgtttcctccatatacgtcaaccaaattaaatagcttccctgaccttttgtctactttctttgccttctgagtatcctcatcatctaactcttggcctggtaaaacaggatatgtggaaaagtcataacttaccttcctcattattttctctatcaagccataaaaagtaataagggaaacctttactttgggcttaccttcactccaaaatgtagaattgtgtggttaggtttaaaaaatgacagaattcttgcaagaaaatgttaatctaatgttagaactcctagcagacaaggtagggacgctgaatgtaattattcagagactttgagaaaaaaaaagcgggggggagaaacaagcgggttttctatctgcaatgagcccagcactttatgaggtgcctgtctagattctttttttaccacgaaagttgggagaagctactatcaccctcatttcacaaacgaggcttctaaggctcaaagaggcttaagtggtgccagatattgaatccaggtttttctgatcctcatgttccaaagcaggacaagttaaatctgaaagcatcttaagaggaatgagctataaaataacattctgacaatacaatcatacacgatgcagactgcttatccatgaaggcccttcacaatctggcctctgcatcctttcctcacccttcctctcatcaccggccacaaatctccctttttccagccctacagaacaccatacaccattttctaaagtgctgtgctgatgaatgtactttccacaggctctttcattcgtgtgactgccctttctcttgcttcatctatctcctactccaaaacttagctcaagggttgcctccttcaggaagcttttcctcattctccagtctgatttaggttctcctcctccgtagcaaagtacatacccctaacaataccacttaccccactgaaccatcattgctgatttacttgtctgtttcttttactactagggttattcctagaaagaagaagctacattttatcctactttgtatctctttcatatagtacagtgactgacacatcataggtgctccagaccccaaatagaagaactgggacagaaatcaaagggtagtatatctgggatcaccaccctgggggagtgggctatctcatgaaccagtatttaagcagaggctagataataactttcaggagcattaagaactcttttttgttgttgtttggtttttttgaaacagagtttcattccgtctcccaggctggagtttggtggcatgatctcagctcacttcaacctccgcctcccaggttcaagcgattttcacgtctcagcctcccaagtagttgggattataggcgtgtgccaccatgtccagctaattttttgggttttgtttttgtttttttaaggagagatggagtttctcaaaaaacaaacaaacaaacaaacaaaaaacaaacaaacaaactctggccaggttggtctcaaactcctggccttaagtgattgacctgcctcagcctcccaaagggctgggattacaggcatgagccaccatgcccggccaagagctctttacactaagtgaggagcagtgttaggcaagccaagacatccatgcttgctctgttattctacggctcccgacagctccagatcaaagttttctgatgaagatgggccaacatctcagaagacaggatggcacaacagtaacacaactatcatagttagaaaacctgggttctggctctgacttggttgtgtgatttttggtagacagtcccaaaagtcttgggtgatttcatctcagtttccctatttataaaacaaagggtgaaaggtaagctagggggagctgaccaactagatggtctgttaaacgccttccagtgctaagagaattgccttattttcccattgctcactgtgttctcttgtgaccacctgaaggtctctgccagctcatcttataccagtgctgtcttccctgtttgatggctcatttctctaaataaagcataacattcacagaacaaaatgagtaaaatctctgtttttttagttcactggacaacatcacttttcttttttcatttttgagacagggtcttgctctgttgcccaggctgtagtatggtagtgccgtcacagctcactgtggcctggacctcccaggctcaagtgattttcctacctcagcctcctgagtagctgagactgcaggtgtgtgccaccatgcccggctaactttttccattttctgtagagacaaggtttcatcatgttgcccaagctgctctcaaactcgtgactcaaatgatccaccagcctcagcctcccaaagtgctgggattacaggtgtgagccacatgtgctcggccacatatctttttattttaaaatattaataaaacaaaattatgcaggtaaactctgagtccaaagggaaattggcattgacttacaaaatttaatcagatacttagaattcactgagttaacacgtgcatacttgaccttgcttgatgcaaagatctgtgatatgtaatcatttgctacttcactgaagatgtttgaatcctccttgttgtaaggttgactccacaggaaaagactgattcacatggctttgttatcattggctttctgttatgaaagcagacaatttaggtcaagggacaacaatctatttttctgcctgaaaatgaccccgacatgaaaaccaactgatagattggttcatttctattaccagcactaaagaatgggcatagggctgggcacagtggctcacacctgtaatcccagcacttagaaggccgaggccagcctgggtaacatgggaaaacccccatctctacgaaaaaaagacacaaaaattagtcaggtgtggtagtgtgtgcctatagtcccagctactgaggaggctgaggtgggaggatcacttgagcctgggaggtggaggttgcagtgagctgagaccatgccactgcactccagcctgggtgacagaaaccagactctgtctctaaataaataaataaataaataaatggcataaattagccttataaattactttaatcctgaatttatagaatcgttacacatctagaggaattacttaactttttcagatatactttgcatttttcacagagagaaaaataattacataggcattttcacatttggaagttcataactccctcgggacctattccacaggaaggccgaaggccaaaggtctcttgtatattatctagctccttaaaatggcaacatttaaaaaaaaatctaacctccttctcccccaaatcaattcagtttgttgaaattcttccatatgccttaaaactaccaagggaaggcagagtcagacaaggtttaaatgtttgtaggcatctgagaaagaattgaaaacaatcagagtagagatggtggtctactctgcattctcccttgggcgctaccacaaaggcacttctctgtacccatcagcagagccgcacatgctctctcttctcatagaaacagggtcaaccctcatttctaggaacataattttcaaccacaaagttcccttccattttttactttcctgacatcagtctgctaagtgaagatatctcggtaagaactccaattttaaggggaatgaatctttacagaatgtactttatcttgtcagcactttgaatctaaatttccttctcaccctttcaccctaaaatatcagcttgcatcaggcacaaaggaagatgcacagctgcaagtgctcaagatgactaaggaaggaaaagcagacaagtcactaattactctccaaactggaggcctaaatcatccttctcttctacctgttgtttctggaatagtttatgtcagtaatggaaaatttaaacactgtcatataattccattttttttccccactccagctcttaaaaacatcctagatgttaagatgtgtagcctaggacagtggttttcacacagtgctctaaggaacctttagagccagacacacagaggaggtatcaataggaggggtctgatgccccttcgacacatgttactataattaacatgtattttgagactgagaatgtaggctccatgaaagccgggattcctgtttcctcacagccatcacctcgtccttttaacagggcccagaatacagtaagctgccggataaaagttttttgactgaataaactgcacggttattacagctgggaactgatttcgctgatttccacggtaaccctgtgaggcacgtatagtagttatcctcactttgcagatgggcaaactgaggctcagagcagcctggcttccaagaccctccttctaaacatcataccacatgacacagcctcccacgtgagccagcagctgtatttcatctgttttacatgtgaggtttcccaccatttgactggagaaaggtcgatgttaggggagaaaaaaccatttaaaaaccaccaacttcatggtgaaatccaaaggctgcaagtaatcaatctcactccttgctctgtttttcctgccacccttgggacttgacgcaagtggcttaactgctcattgtttcaggttcctcatcttattttacaacctatcttgcaagatgagtatacatgaaatattagaggatcctgatgttgtcagaagtgtagttttgcggatgttgatcccagaattgtgaaacaaggacacggttgagatgatcgctaaactctgcctgaagttcaacgcctctgtcattgaagaccttgcacagtgccgtccacatggttattttattcctccatgtccttaccaactaaacaagccatatgattttaggtttcgtggccagacagcctggctaagctcctatcaacatgtcagccagatgaggtgaagagatggagaaacaaacctgcatgtgggttgcgtcgaacaataaagagaaaacagagaccaaaaatcttgtgccaaggtttgacctcaacaaccgcaaaaccaatcattgctgtgttgtttcactatgtttctagaaacatccatagaggagaaaccaaagtcggcctgaatacatgttaatagctttcacgggcttacttctgatattttaaacaggcaacaaaaaagaaaaaccaagtttcagatcttgccagaaattggggtttcacttaactgtaaaacagtcaaggggagtttatcaggtaagacacgaagcctttctttataagctcttataagactagagaccactggattgccgtgcagttactgccgctggcattattttcttagcacactaagaaaaataaaaatgttcaaagtcctgtttttaaaaacaggatgagacttctggcttctgatctggtatgtaagaagcttagaagtcaccattccatcctaacaacaagtaaaaagctaaacaaactaaaaaatcaaccattcttcttacacatttgagatgctagatatattagcttaatttaattattccacattgtattaaaaactcacaataccactttgcatcttataaatatacacaactataatttctcaatatacagtgttaaaaaaaaattcttagatctgccaaagaaataaggtcacagggcaagctgctgcccccaagactagagagacagaggggcgcatacagagcattgcaacttactacaacagaaacctccatggaaatcagtacccggtagaaacctcaattgtactcgacatactgctgggggtctagaatgaacaactcttcgagtttaaaactccagaggtgcccatcatggggagtagggagggataagcttttgtgagtttttttttttccaggagctctagcagggcctcgcagtgagtatcagagaaaaattcccttatgcttccagtggaaaaaggaggaaaaggaccattttgaaaaaacaccagagatcagcaccataggaaaaggaaaaaagaaaaagaaaaaaacaccagagaattatgttcttaacaaggttttgccctccagagaaactaaccagaccctaacttgctggggctttggcagagcctaacctacctggggaaggaaaatacccaactccagtccactctagtcatcctgtcccacaagaaaacaaacaaacaaactgagaagcactgagtgaagctcacagtccagggtcatgggctcactagaagactgagacccactcacaggactacaggagaacaattccattctgagttagtccactttgcatttgctataaagacgtaaccaatgctggctaattttcaaagaaaagagatttatttggctcacggctctgcaggccatacatgaagcagagtgtaggcgtctgcttctgatgagggcctcaggaagttcaccatcatggcagaaggcaaagaggggccagcatgtcacatggtgatggagggagcaagaaaagggaaggagagccagactcttaacaaccagctcttgtgtgaactaacagagcaagaacctgctcatcaccaaggggaaggcaccacgccatgcatgaggggtccacccccatgatccaaaacctcccaccaggccccacctccaacactgggggtcatatttcaacataagcttcggaggggacaaaacatccaaacagtatcactccccagtgatttaccaccacatcactaaagacccattcacaattctttttacccagtacatcatgacatccgtctttcagcaaaaacttaccagacatactaaaaggcaaaaaacacagtgtgaaaagattgaacaagcatcagaatcatagtcagatacagcagaaatattggaatcattcgacaagaaaatttttgaaaatgatgaataagctaaaggctttaatgaaaaaaggacatgaaagaacagataagtataagcagatgaaaattctaagaaagcaaaagtaatgctagagatcaaaatcattttaacagacttgaataatccttttgaccaacttattaggagactgaacacaactgaggaaaaatctcagcttgaggatacgacaacagaaacttctgaaatgaaaaagcaaagagaacaaagattgtaaaaaaaaaaaaagaatatccaagaactgtaggacaactatgaaagatgtaacatacatataatgggaatattagaaagagaataaagagggaaaggaacagaagaaataatattcaaaacaataatgactgagaaattccccaaattaatgtcaaacaccaaaccacagatccatgaagcttagagaacactaagcaggatgccaggaaaactacctctgggcatatcatatttacaactaagaaaatcaaagataaagaaaaaaaatatttaaaaaaataccccagagggaagaagaacatacttcagtggaggtaaaagaaaaacttttgttttcttattcttaattgatcaacacacaatatctttttcaaaataatagcaacaatgtactcaattacgtatgcatatatatgcttatgtataagtgaaatgaatgacagtgatgattccaaagatgggagggaagaattgggaatattttgttattataagatatttgcactactgataaagcagtttcatgttattcgaaaatggacttggattagtagtaagtgtatattgcaaactctacggcaaccattttaaaaagtaaaaagaagtataattaatatgctaataaaggagagaaaacagtatcatataaaatccagctttattcataatttccaaaacttggaagcaaccaagatgtccttcagtaggtgaacaggtaaactgtggtacatctagacaacagattattcatcactaaacagagattagtcatcaagccatcaaaggacatggtagaaccttaaatgcatattactaagtgtaagaagccaatctgaaacactttatacggtatgatttcaactgtatgacattatggaaaaggcgaaagtatgaagatagtaaaaagatcaatggtggccagagatgagaggggagggagagatgaacaggtggaacatgaaagattttgggggcagtgaaaaaagtctgtatgacgctctaacagtgaagacatgccattctacatttgtgcaaactcacaggatgcacaacaccaagggtgagccctaatgtcaactcgggagtctgggagataatgtgtcaatgtaggttcatcgactttagcaaatgtaccaatctggtttgggatgtttatgatgatgggagataggggtggggcagggaatggccaagggttatatgggaaacctctatgctcaattctgctgtgaacataaaacggttctcaaataaaaagtttattaattttttaaaggatttttacacaactaagccttgataaacatttaccttctttcttcttcatcataattatttttccgcattattttgctattttccttctctccttctctctctctctttcttttagagacagggtctcactctgttgcccagcctgaagtacagtggtgccatcacagccaactgtaacctcgaattcctaggctcaagcaattctcctacctcagcctccccactagaactacagacgcctgccactatgcctggctaatgtttcagtttcttcgtagagatgaggtctcattatgtttcccaggctggtcttgaactcctggcctcaagaactcctcccaccttggcctcacaaagggccgggattacaggcgcacatcacgatgccagacccaattttgctattttctagcataacatggtatgcacacattaaattaaatgtgaaaaacaaaggcaaaaagaaaaataaatcaacaaaagttctccaatcatgactaaaatcatggactatttccttctaatcttttctacaggctgatttttaaaaacattacttaattcatggagaatatcaaccagagtgctcaagatctggcccttgggaagacaggctttcagatcatctcgagtccttatttcctttctacccccaacctctgctgtgcctggtgctcagggcccctctccagaaaccgtcactctgaagatgagcaggcacattcaaggctgtagggagtacaggggaggatctgatgcagtctttcaaatactccttttcttttaaggtccccatatgaacctatcccccctcaggacctcacttcattaatttctgagcctttctgagcaggaaatatgcttgcttctcatcgatatccaccactgtaggcactcagatcccacctagctccccactgttaattcagtcatcagaactccaactgctttttgtcttcattattgatcaatgtgttataatgacttttgattccatcaaaagtagaatttgtttttccattcctcattctccttgccattctatggtgatggatgatttctgagagaagaaagaggtagaaatctctctattccatcacaattcttattcttacatggtattgtaataccatattatctttattaatctggctttataatatatttcactgtctggcaggaacatggtcatttcaaatttgactgaatgtttcaaaaaagtattttctatttgtctttaaagttatgggcaacttaccagataagttgaaaagaagttcaatatcctaaattcaaaatcctaaattttcacatgtagaccttcctatcaactcagacaatgccaggcacaaacctatgatcagtaactgctgagtgattgtgaacaagccatccaagaaaagtcaaatgcataggggcatttgtggaagtgtggagttgtctctgaaaagctgttgcactgtgaacttgtttcagcctgagaggcaagaaaggctggcctgtgattacttccggtgtctacctagtgtgaaatgtgttgagtcaatgaagcatctggaacagacttagttcaactggaaggttcatgactgggatgcttcctggagccctcagaccagagggcagacataacccaagaattgcttcttattaaaggaacagagacaaaaacctaaacagagggataacggcagagcattaaatgcagataattccatttgcgactaatttacccaaataaaatagcagaaagcagctttcagtggaataatttaaggcaacaggcaggagagtggcgtgaactattattttcatatttccattgcttacttgtcacttccagtgaatatttaacttttgagcatccactttgtggcttaaggatgttcctaacttccccaaactttgcatccttgaccagtacactacaatatttattcacaaccctgggaaatacctatgggaaagttactgttccctgaacgaaatacatgaaaatccagatttctctactcgctgacagtttatatagataatgctacttccccctcaatttatctctactctgtttcaatctacacactgctgtcagaacagcgttagaccacagatctgagcactttaatccccccctcaaaaatggcccccctctgctcaccagctccatgctgaggctctcacgtccttctcatgatataacccccatctactgagacactcagttctcctcaaatgaatctattctccattccctgactaagctgcagcgttctcacctcagtgcctttgcctaggctgtgtcttccatctgaaatgccctttaccagactactggaatgacaactctccttcaaggcccaagtgcctcctatattaaaacaataatggttagaactttccatttcaacaaaatgatgcagaattcaccttatattgaaaaaggcaggtagtgaaggaaattcagtgtacgagtaacaatgcacctcatgtaaaccactgtgaggtaaagaaaaggcaaggactttaaagccagatattcatggatttagctccctggtctggcatctttgaatcttgtgactcggggcaagttactcaagtcttctggaactgagttttctcctctatacaatggacacaatggtacctgtgttgcaagtgtggactgtagacacaaaccacgcgtttcccatattccatttaataattctgtgctgccctcgtctttcccgcgttgtaaatttcagccttctcaggtctgtgtctttctcctgtgccgttcatcagtggaggcttagttcccagtgctggtggaagatgcctccgtacactgttaaggaggcaatgctttctcttcctatcattgataatattctgcatcatagggctatgagacctccaggcttcagagattaccactgtgtcctgtggaggcaacctctaaaaagtatgtaattctgattttcttagttaataatgtgtcactctggtaacactatttaaatgggtctctattttctcaaaacgtaagtacttctgagttctctttgttaagccagaaggggaggcaaaagaaaataactttgctagctttcttatttaaattgagagcctgggatcaatgaaaatcaacacgggtttgctgtgagaatgaaccacaataattaatgactcttcagtggctagaacataaaagatagctagtgttagtgagaccatcagcaacaatacaactgcacaacttctactaacaataatgacatggacactgttctgccagaccttccagtccacaggcctttgaggccttagccaagacttttctctactggaggggtaaaaaccactaagcaaagcctcgcttgtctgagtcagctgagtctcatagccagggtatttgtctgaccctgttttcagtgctgaatttgccatcctgttgtaaatcagtcagcacaaactcagaaacatacccgttcatttacttaacagcacacaatccttcaaagggcaaagtggtttgaggaaatccaaactaaccaaggggggaaaggccaggaacacggattcctctgctgaagataaatggtagctatcaaatctgcacacaaatccctgaataaataccaacagcattccttcgtgttgttttgaaattcaaactacattaggaaaagagaaaggtgccttactttttgacataccactaagtcttcactccatcagaatgctattagcattagtggcagattttattacctctctaagtgtgtataaaaaccaagtgtctctaaaaagtattatttttgttgacatttatcataaagactattaaaacaacatataaaaatgtcaatgttgactttcttcagagaaatagaaagaactacttaaatttcatatggagcccaaaaagagcccatatagctaagacaatcctaagcaaaaagaacaaagctggaggcatcatgctacctgacttcaaactgtactacaaggctacagcagccaaaacagcatggtactggtaccaaaacagacgtatagacgaatggaacagaacagaggcctcaggaataataccacacatctacaaccatctgatctttgacaaacctgacaaaaacaagcaatggggaaagaattccctatttaataaatggtgttggaaaactggctagccacatgtagaaaggggaaactggatcccttccttacaccttatacaaaaattaattcaagatggattaaagacttcaatgttaggcctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaagtatcagaggaaacaggcaacctacagaatgggagaaaaattttgccatctatccatatgacaaagggctaatatccagaatctacaaggaacttaaatttacaagaaaaaaaacaaccccatcagaaagtgagtgaaggatatgaacagacacttctcaaaagaagacacttatgtggccaaaaattatgaaaaaagctcatcatcactggtcagagaaaagcaaatcaaaaccacagtgagataccatctcacaccagttagaatggtgatcattaaaaagtagggaaacaacaggtgctggagaggatgtggaaaaataggaacacttttacactactggtgggagtgtaaattagttcaaccattgtggaagacagtgtggtgattcctcaaggatctagaactagaattaccatttgacccagtgatcccattactgggtatatacccaaaggcttataaatcattctactataaagacacatgcacacatatgtttattgcggcactattcacaatagcaaagacttgcaaccaatctaaatgtccattagtgatagactagatacagaaaatgtggcacatatacaccacagaatactatgcagccataaaaaaggataagttcgtgtcctttgcagggacatggatgaagctggaaaccatcattctcagtaaactaacataggaaaagaaaaccaaacaccacatgttctcactcttaagtgggagttgcacaatgagaacacgtggacacagggagtggaacatcacacaccaaggcctgtctggaggtggggctaggggagagatagcattagaagaaatacctaatgtagatgacgggttgatgggtgcagcaaaccaccatggcacgtgtatacctatgtaacaaagctgcactgttctgcacacatatcccagaacttaaagtataattaaaaaaaaaaatcaatgtgtcatttgagtagctcattgcacccaaactggctattgcacaatttcagtttatacaatctattaagagaacgcacacgctctcgtctggttagaacgcattcttcttcctgagggaaaacctgagcttaggttgttctctctgaaacatccccactaacggggatgtcccttgaaggccgcagggactctaccttttatctctaaatctctggagcctaccttggtgcctggtacatagcagtcactcaattcatggttggtgggtttatttttttaaaaatagcagctgtcatttaaccagatgctgctttgtgggaggccctttgcttacatgatcactaacacttaaaacaactctgtgaaggaggctaacaaatcctgccttacagttgaggaatctcagatttaggaagattaagaaacttgtccacagctacatacctggtcagtgagtaaaagattcaaactccaaagcccagctttgcagagtctgaagcaaacactacgctgtacagagtctagtcacctatagtcactgctgatcttgccatgtctcgggcaccactgatgcctcactataactgaaccaagtgggaagggggcactgatctgaatgtattctgacaacagaccatgccctaggatgtaagtccctggtacaagactgttttcattattcttactcctgtctcctaaaagcaggcaagaaaaccagtttttgatagattagaattgcactctattttcattcggataccaagtcctgagacaccttagctggctaggtaagtctggtggtgggagacctgctcctgaagccataagcaagttaacatatgtgaatttcctctgtaaactccacatggctctatgacaacaacacagtgttcaatggtatcacggtggtgaaaagagcacagatttttaaatcagatataacagaattagaatctgcacctcccccttacaacctcatcatctagggcaagttgagttaattaacctctcaaatttctaattcatcatctggaaagtgtacagaataatctgcacattgcaggatgtggtgaatattgctaggtgttcaccaacatctgttctcccttgctcccagggcacaggcctgaactacgtttcccagttcctcccccaacccctggaatcaggcacagctacgtgactaagttcgctccaactgagtggaagtgaaagagttgggaactgcttctggagctaagccttgagactgtgggctggccctgctgggctcctttttccacttcttgtgaaggcctgaggggcggtggagcaacaccatggaaagaatccgggccctgaataacagcatggagtggagtcacccacccacctggtacatacattacacaatcagtgaaaaagaaataaatgtctatctcctttgaagctactcaattatcattatgtccctttgttacgagaacctggccttacctttgccaacagtgtttttcccacctattataatgcctggcacaaattgggtactcaataaataaatgatgtcattgctgctgctgttaccactactgccacacctaccatgcaaagcagttcccttcttacacacattgaaggttccacggccacagacacaaactgctgcccttagctacagaaaggaaagttaatgaaatgaagatggctctggaggaaaacaaaatcaaaactttcaactctagaagaaatagcttaaagcacatgccctattgaaggacaaacacttagctaaaacagccatcatcattgttgcttttgttaggtattatgtttttgaggttatagcaggaaagcttatagacacagcacaagaaggaaatttaggaaggcatataatcggggtgtccatgttatacacagggtgttcacccaatctgcaaatgtttattaaactattcaccaaatatttgtgaaaccaacgaggtaccaggtatttgctaaatggaggtacagataatagcctcaccctcaactttcacaggagttttatcacaaaaaaaatcaaatgaaaataagtagcttattgtgtacatgtgacaagggaaaaaggagaggaacaaaacctacccatgttgtgaggctgcacgagagagcaaacataccaaagaatcttgctttattttctcagcgaaaagagttctagtgcacccatcagttgctcttgtaaccagacactgtccaaggagcatcagaccatcccaactcaagaacaaatgtcccagttagccatggctaaagaacacttcccttaataacgtcttttgatcggcacgaggaaatctacctatatgagtacttttttggggggttcagtgagtcactcacagacctatttctcaccaagtcattcggaaacgtaaatgtccagaaaaataaattttaaatatgataggacttcctggatgttaaattcaatttcagagtattttctcatatgagagtcattttgtaaaatagacttttgcattttaacaaaatcatcatcattaatacctatgcttataggtctaaacagtttcaatcaagtcacaaactaaatcaggctgcccttcctccagaccctgacttgctaacagatgccactatctgttcaggcaccctcctttcctcttcccacctctctcaaagccactcccactgtgagtatcctcactctgacacttgtgtactggaagatgatttttcaatgagaaaaaatctctctttaaatgacatttttcaaatttaatatgactaagttctgcccccaaacctactccttagatgggaagattcattcccatctgagagatgacagtatttatttttctctaatacatgagcagtattataaaaccttcccccatttctccccaatccatgtcatccagtctatcagagtcatgacaattctgaccccagaatgtatcttgaatctatttcatttttcccatctcctacatctcctatgccaacctcctaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcccagggaaagccatcgtctccggcccagggaaagccatcgtctccggcccagggaaagccatcatctctagcctagggaaagccatcgtctgtagcctagggaaagccatcgtctccggcccagggaaagccatcgtctccggcctagggaaagccatcgtctctagcctagggaaagccatcgtctctagcctagggaaagccatcgtctctagcctagggaaagccatcgtctccggcccagggaaagccatcgtctctagcccagggaaagccatcgtctccggcccagggaaagccatcgtctccggcccagggaaagccatcgtctccggcccagggaaagccatcgtctccggcccagggaaagccatcgtctctagcccagggaaagccatcgtctccggcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcctagggaaagccatcgtctccggcccagggaaagccatcgtctccggcccagggaaagccatcgtctccggcccagggaaagccatcgtctctagcccagggaaagccatcgtctctagcctagggaaagccatcgtctccggcccagggaaagccatcgtctccagcccagggaaagccatcgtctccggcccagggaaagccatcgtctctagcccagggaaagccatcgtctccagcccagggaaagccatcgtctccggcccagggaaagccatcgtctctagcccagggaaagccatcgtctccagcccagggaaagccatcgtctccggcctagggaaagccatcgtctctagcccagggaaagccatcgtctctagcctagggaaagccatcgtctctagcctagggaaagccatcgtctctagcctagggaaagccatcgtctccggcccagggaaagccatcgtctctagcctagggaaagccatcgtctctagcctagggaaagccatcgtctctagcctagggaaagccatcgtctccggcccagggaaagccatcgtctctagcccagggaaagccatcgtctctagcccagggaaagccatcgtctccggcccagggaaagccatcgtctctagcctatgttattgtgacactcttaacctcatctcatgcttgaccccttgaatccattctctatatacttctctagacagaattagaatcatctttttacaaacatgaaggattcagtcacacccacatttcaaacatttcaatggttttctgctacttcagaagaaaattgaaacttcttcaaatggcctaacacggctccgcttgatccagcctctaccacacaacagccatccccactcttctagccttgctccctcatggcatggctttaaatgccaccattggaggaagtccatccttaatcacaaaaccgaaaggaggggccacgcacggtggctcacacctgtaatcccagcactttgggaggctgaggcaggcagatcacttgaggccacgagcttgagaccagcctgggcaacatggtgaaacctcgtctctactagaaatacaaaaattagccaggtgtggtggtgcatgcctgtaatcccagctactctggaggctgaggcaggagaattacatgaacccaggaggtggaggttgcagtgagccgagatcgtgccactgcattccagcctgggtgacggagtgagactgtctcagaaaacaaaaaacaaaaaaccccaaaacttaaaagattctcccttgcatgagaatcttatttgccctccacttaccaccatttataataattcctctttttgtttccttcctgccctgttattaacacctctgaaggttggccccatgcagggaacatactacttttatagtgcactcggctggcaagcagtctttcttactttctctgtgttgtgtctatgtatacacagcatatctgtgagggagatattaatattattcccattttacagataaagaagatgtgaagcatatggaggctaagcccctccctccatcaggccacagagccaggtgcaagcccagtctcaccccagcatcctggctcctgtcagctgtcgtttatcatcactatacaccagcacgcctggctctttgtaggagctgagtgaacatgggcagaaggaatcgtgaagtaaacgcttccaagtcggaacatccagagacatttggttcctctctaggtgctcttacccattcctagttctactatttatgctgggaggcatcttctgtcccttactaattgataagttcatctagggcaagaatcatgatttatccatcttcgtgcctctcatgatacccaacagtaggcgctcaaaaaacttttcctagtgtgtgcaggcatttaaaactcagtagaaattaaccacaattgcaatgaagtaaaattcaactaagagttcccacaaaaaataagtacaacagtcaccattccagtcatttatagagctgatctgaatccagaggtaagtttccagaattaaagagctgttttatagactgcgtctttctacttcacgagtgggtagaaatcatctttattagaaaaaaaataagtgcgggagggcggggggcagagagaactatttcaaaaggtttttccctgtttgtcctaaatcctccagagcaggcagttaaacgttgagtccagcgtttcggagcctggccagtctattacaggccttggtggtgaaaggcagagtggcctcatccaagctttgtctctcgtcagcaatgctacctgtgctggcctttccgccttacttcccaaactcctctcccatttctcatttctgctcccatttccccttgttccctccaacactacgaaggcaaattatggggctcaatactgagaagtcctttccaccttattgataatgaatttctttcctgggaaacacctgggaaagagaccaaaaattcaggacagtacagcctaatctgaggtatctgtccattcttggcaggtatgcattgctaaaagcatgtgactactaccgtatatcagagagcccttttatggaacgtggctctctgctccatgagtgggtggaaataatatttagtgaaaagaagagtctcggcatcttaatgaaagaaacctagataggagatgagtcatttaaaccctctctctgtcatcacacagaaatagcttgaagaaagaaggagtcaactcaaatgcccaaggagggcaatggcaacagagatttgggaatcttttccagggtaaaaacaactgggatgggctaggggtgaataaggaagttccatcctgtctaaaggtgtctgttatggggtgaattatgttccctccaataagattatgttgaagtcttaacccccagtaccctaaaatgtgaccttatttggaaataaagtcactgtagatagaatgagttaggaaaagatcacactagagagtaagtaggcccgaaattcaacatgactggcatcccagtaagaaggtggccatgagaagacagacacaaggagagttccacatgaagacgggggcagagactggggtgatgcaggtacaagcagggaacaccaaggacagcctgctgccaccaggagctacgggaaagaaacggaacagtctgcctcagaaggagctcaccctgcccacacgccctgatttcagacctttaccctcagaattgtgaaaaaaattttgttgttttaagctaccctgtttgtggtatgtcaccatggccgttttaagaatcgaatacagcatcccaattcagacttaaaaaacgcaagatgaccaaacccagccccggcagctagatggtctctaattccaatgctcactattcagtgggcagtcacatttctgtcaaaaacaaaaatgcagttacaaaacattttctggctaaacaatgcattctcctggatctcacacatcagaattatcttccagatcccaggggtgagaagcgcagcttctgcgtcagacaccagtctagtggacatcgcacgctagccctgccactcgccagctgtggggctttgggagctctgtgcctcagtctcctccacctataagtgggaatgatagtgaagtcggcctcacagatgaggatgcagggcacactgggaagcctgctgaattacaacgagggggagaactcagcaacccaagcggcatgatctctatcacaggctgcagcactggattttaccttactgtgcatgatttttcatttgctttactgtgaactcacctaggacggggtccaggccttggtcacttttgctctccttgcacatgtgtggcaggtagtcagacatgcctcgggaatgaaggcaggaatgtacttcatcgactccactcctgtgatgtgagatccctgagggcaggacccaagtcctacatcaaccctagagcccagcaccaggtaagaggccacacagagggcaacgaagtcattgtgttggaaggacgtctgtagatgtattgctcaactctgccaagctagcatgggagcaggaattaaatgcttcattccagtttcaaggtctgagtttgtctgtttcctttctgcttatcacacacatgacatgtagaacaaattagggtgatgcttcctcactgaggctttttgggaaacctattaaaccaaggtggaaaaaataattcaagaacatgacaaatgcagctgtcagtaactctgcaacaggcagcaaatgctgagaaatgcacttattctctatggctgccgacgttgactggaaagctgctttgcagtctgggaaacaaatccctactccagactgtatgatatggattctgtctcagtggattggcattgtctagactagcagtcaacaaactacagcccatggtacctcggccactgtttttgtaaatcaagttttgttggtactcgtccctgcctttccagttatgtattgcttatggctgcttttgagctacaaggcagagtaaagcagttctaagaaagacggtatagcccagaaagcctaaatcattcactatctgaccctttagagagaggtctgttgatccctaacttggagtatcccactgtgattacacttaaaattaagcttgaagaggacagaaaccttgtttatctgggtcagacctatctagacgatgacctacctgatttatagtaggtgctcaataagtctgcaaagaataaacatgaggccaaataaatattgaggttttaggacaggtagtgccaacagcacacagtgctaaggggatgcctgctgggctagaccagtgtcccgaagctctgccctttttgagaggatgaggatctgccactgctgggtgtcccttggttaactagctacctgagagccctctgggagccctgggctgcacagacaaccaggacatcttcattttaagaattcaatagcattgagctgtcaggacagattaaacctgactaagaagaacctttcagaatccttctatgtatatacatttacattagaaatgttttaaaggaataaacacttgcaaagcggtttaaatttaaaggttcccttatacaactgaacccaaaacagctgtcagaaaccaaacatttataaatacaaatgctcaaggtaccaagtgaaaaaaagatttttagatctaaaagaaaaagtccaatctatcctgccataacaaaagcaaagaaggaaacagaaaagccagactttctgagaatgatcctttaatgttaatactgaaagcatgtgtaagttctggctccaataaagttgtttatggttagagttaagtaagaaggggtcctttaacttgggaaacgattacatagaacttgttgcagaaagaaagaattccatactatttctctttttctattttgtcctctcaaagaactgttgcttccatgcatcaggtcttcaaaccaggcttgggcaggcgagtctcccagccctccctccagcctggctctgggtgcagacccacggtcatggggaccttgagcacgtggggtcttcttttaggagggtttgtggaactgtagctctttacatagcccagagacattctccctttaaagtttttgggtaatgctcaattccatctttaaagaggtgggagttttaatagcacagctgtaatagaatcacatttcgagtttttgagacaggatcttgttctgtcacccaggctggagtgcggtagcatgatcacagctcattgcagcctccaccttctgggcttaagtgatcctctggtctcagcctctggagtaactgggaccagcatgagccactgcagctggctaatagttttttgtagagatgaagtctcactatgttgcccaggctggtctcaaactcctgggttcaaacaagtgtcctacctgggcttcccaaagtgctgggattacagatgtcagtcactacatctgtcccacatttatatttaaatagaagtagcatcctatagtctcaatttctgatcaaatgtgaaacaatcaaaatgtcagtctgagagttgatctaatataatagtaaaggctcacttataggctaaatacttccatcaaataaatcttaaagtaacattttctaattcaggttttgttttgttttttactaatccccttctaaacccacttaatttgtatttaattcatattcccaataataaaatcaaggaactacggaaacattgcatattccactaaactgtgtttacaatattaacaaaatctatttactccatagaataagcaaaaactcagacaagaattgactcactgggttcgctttgaggactgttatattccatttagaggtaggatttccttatttctttcgtagccacacctttggagatgtggccaagcattctttacacgaaacaagaaacacttgcaaagcggttcaaattcaaaggttcccttatacagttgaatccaagactgctgtcagaaaccaaacatttatcaacgcaaatgctcaaggtactgagtggaaaaaaggttcttagatctaaaaagtccaatctacccttccatagcaaggagctggggctctgcatgatggtagatgacttccaacgtgatctttccccccatgctaccagctgagaagacctcatactgaaggtcttcacagagacaagatgcctcatctccctggccttattttgtggcagctttcgggacattgttttcagttataacttttcagactctttcaccccatgggggttgtgttcccatattagaattaatataaatgcattttcatcaaaaggaaagaaaatagaaaaagaaaattaatgactagttacagcaaattcattatttcccctaaaaactaaacacatcaaaatgctgcttctttatccaaattcttcaccatattgaaatcatgaaatgaaacgacaaccagctttcatgaccagctaagaaacgcatttgatgagatcaaaagtccagcacgtggccccctgggacccacgaccagatgcccatggcagatttttaaattgtttgacttttcttcttaaaaatctacgtcctgttttgctgttgttcatttcaaacctcctgtgtgggagtgttaataaaatctaacatctgtaaatttctcatattggtttgatgaatccttgctcaaacattctcctttattctggctctaaatgatgtgatctcagccatctcctgaaagtatccaaagattaagacaaagatttaaaagccccattgaaaccacaaacaaaaagcccctgaacacctcaagactgagtctcccaacacaggctatgatggaatcgtttcggtttcaaggaatcagtagcaagaagaacagtcagctcctgctgagaaagggccaggaggaagagtgtaatgagggagagaataaaggtatgcttcagcttaaaactaatcatattataggtcaattagaatgcaacatttccaaaaccttaaatgtgtatttcatttgagtaaactcaatcaagtctactctttttttttttttttttttaaatggagtttcgctcttgttgcccaggctggagtgcaatggcgcggtctcggctcactgcaacctctgccttctgggttcaagcgattctcctgcctcagccacccaagtagctgggattacaggcgcctgccaccacgcccgggtaatttttgcatttttagaaacagggtttcaccatgtcacccaggctggtttcaaactcctgacctcaggtgatccgtcccgccttggcctgcccatgtgctgggattacaggcataagctactgacccagcccaaccctactctcatctcaggattcaatggacaaaactgcttcctagttcaaaaagaaaaagtatgtcatcaggaacaaagcccatcaacttcacaaccatgcagcacaaatctatttgtgcctgcgcccgcagaagcacctcccctcctgtgcaagggcatgtgcactcacctgggccctggatcccactgttcctcttcatctaggacaggagctctccagcttgagtgtgcgtgagaatcacccagaaggctcattgaaacacaggctgctgagctccaaacccagagtttctaattgagtaatctgaagtaaggactggtaatttactttgctaacaatttccaggtgatgttttatgatcccagagcagactctgagaacaactaatctaagacctgctacactgattatcctctcatcctacatttttgagtctctcctttcatattgcttctttccctaagcatataaacatgttcaaatttgtcatcttaaaacataaacaaaagtctccctgacctccctgggaatgtagtgtatttctctttccttctgtacacatgtaggttcttaagagaatgttctccatacaccacttccatccgacttctccttgctctgtaatctatttgccctctcaactctgctgaatgtgcacatctcacgaccccacatgaacttaacagtttccaggccaatggatacttcttaagtccctgtttgactctctgccttacctaccatcgctcacctgaccacacagcattccctcctcccttggattttataacctctccctatcctggatctcctaccacctccttcactgcctcccttttggtctcccgtcctggaatatctgcttttcaccatccctataagtgctggggatcccttgggacctgtccttggctctcgtcttctgatgccatacattttgcctgagagttctcatccatgcctgtctttcacctataatctatatcctaatggctctcaaatctagacttctcttctaaacttcaactacatagaatgatcatcaattagacaattatatttgtccaataggcatctcaaagttatcaatacttaaaagtgaacccattaatttctaccttgttcctgttccccttcctttattttttacctaacaaaatggctcctccaactgctcactcatgcaaaccacctttatgtccttaaggaaaaacatgtccttacgtctcaagcacaatcacagttcagaggtgggtccaatccacctcttaactgtctcaaatctgctcccttattcccgtctccaagactgttgctccaacttcggtcaacatcataatacttggttcttccctttcttaactgcatttctagtcacctccttctcatattttaagctccaataacaccaaaaactagttaatgatatctttgaatgtggcatgctctcttacaatggaaaacttctatatattttattccctctgcttggaaaattattaaaatccctgcaccaacatgttctttccaaaaccttcccaaatgttcttgactttggactcctttctggctctcattccacttgaaacctgcctccattacagcaattacctgtttccaagcctaacactgcgccattcaaaggtaaatccttgaattcctagtgctgataatacctggctcaaaataggagccctactaaaaagtacttttatacaacatacatcagtgattctgaacaaggaaacacactcccctggcagtagagtaagcgagtctaccaaacattttaggatcgtttttagcgtttaattctcctcctacagaattttagataactaacatcacatttatttcatctcaactttaacatgtttcatctcttgtttacttcatttcttcaaggaactgagagaggacccactgaaattcagtttggggatgttaggaacctgttggaagattttctggagaagttttctcattacaacagtgtttcctttctagtcattagaagaatgaagggagctgagggaagcagatacttgagagttttacattttctgtacctcagtttgttctctaccatttcagtaaaagacagctactcccaaatacatttttgctgtatgcaactgtgctgttattcctgtagctggtccaagttttatagattactcacacagccccctagtgagcccagctgcttttatactattatgatgccataaacaaaattacataacattttaaggccagtaataaatgcctgaactagctgactggaacatgtagcatttgggcattttcatggtcttcagtgacggttttactgccctgaaaagccctccctgtacgttatcaaagaacaggaagtctccatgtctccactctcggttgttccagcctaaaggtgacccacccacgcccacatgcaaggctggcaagaacgggtcatcgtcaaagagaatatgctaagtgcattgaaacaggctgtgtacaaccttcatcaagcttcaagtagttaaaatcgtgccttacaagtatttttaaagaaaactggtataggtggatacagcaaataaacatgtatttgaaaatccagagacaaatataagtaaaacttgatgaacatatttgcattttatgtaaatgtcaatgtacatgttgtggaacaacttggctctctgctggagagcatacctccttttaaatgagtcaccacttgcggatgaataggaaaacgctgacagatccatgcgagataaaacggatcacagcagtcttggaatcaacacacttttatgatgaaaccaactcatattcatgcctccaaacacagcttaggcttgaaaccaagttgcagaacgtccaaaaattcttgaagaatccagatgttcccataatcagccactgatcaatttcccaggagaaaaggacttaaacaaggatgggaaattccaagacgtttaatacccagaggatatctgcacccagagaaatgtcacactcagaccacaggaagctatagctctgctgttgactgatgtagtcaggtgtctagaattttatgccagcctctacccactacacaccattactgttttgagataaattagcaaacaccaaaaattagaggtaaaaaagatctagaaaaaaaacaattgaaacgaactaaagaagccagagccagggaggtttaacaatcattagtaacaggtgatatccactgaaacttttccatgttcttccagcttcacgctaagaacttcacgttttcttaacttattcctcacaacgatttttaatttaaattgattattcccactttataaatatgaaaactaagacttagcaatattaagagatttacccaaggcacacgacttatcaacagtggagacggaatctgaactcagtctttctgattccaaagtcccggcacttaagcaccacactggagcctgaagcaaaggctcatgggtgaccccagtcttaaacatctgagggtttgtaacatggaagacagaacagcttcgttgtattctaaagcaggagtcctccaaacctgtttgtactggagaatcatctctgaaacttaaaaagaaaaaagaaaatccagtttctacggtcccactcacagactctgcttcagctgatctggcatggaggccagaaaactgtatttttataatgctctgctgggtttgagaatcaccgctccatacctcagaactagaataaacgcagaggaatcactaggaggcaggtttggctttacgttattaaacagacaaaccaaaccaaacacacacacacacacacacacacacacacacaccgccacccacaaaccagtcctaaccacagggctacacaagcctcccctgcccagtcctaaccaacagagcttcccaaatggagctgtagctgcctgctcaagcgccacgatataatggagacaacccagtctctggaaacagaggctgccatttccagttctgattcagccattctcaggtgtgtagctctggtcaagttattttctctgagtctcagtttgctcaactggaaattattggagaacacttacctcaaagaattgttaagaattagagacaattaggtaaaattcaaagaaccgtggctgatgtggctgatggtgctcataagcaaacggcacctgcccacttgaaatgtaaccatcttcttctgtagcttctgtagcgagcctctgcatgtggacagcgtgggccgcctctgcagcacccttccccttattcccaccattgtcccacccactgacatggccacgtcctattggcttcaagcccagattttagcaatgggctctgactggcctaatccaatcagcccacacctggcccccttgccacagccataggcagggaccagagcccaggccaatcagcagatggtgttcctctggcagagaacggtttgggaggaggctgagcatgtgtccaaaattgggccaatcagagtgaactcaaaggctttttttgtcagtaggaggaaagggagtatctcctcttccagaatgtatgacacatcagcctgagagctgacgctcagcagccattctgctaccaagagcctttatcaaactatgtctgaagcctgggctatctccatatttttgagatctgtgaaccaataaattccccgtatcatattatttaagccttgaggttgtttttctatggccaaggctgaacacattgtaacttatccagaatcccctggctgggagtggtgagatgtaaccacttagatcatttctaacttcatgattccatgacttcttagactttatccaattaatacctgtcttcacatttataacacttctgacgactggtttctgcagcctggaacatcctgtccccctttctcttcttaagaaatcctgctcaccttttaggacccaactgaaatgggtccactgctgcaagatctttgaagaggagtcagttaatccatcttcctgtgcactcccccagtacttgaccatttcctctcttatccttaatttcattgtgtacttttctcactcctatcttcacctatgtttaggctgtgtgcactttgaagacaacacccccttccctaggcattacttgttaacaggccaactgtgcagcaaagtagcacaaatccagcttgctgcacatgtccaatgcctaagatgaggctgggcctgcagcaggcttgcaagaaacaaccactcattcattcaatgccacatgagtggttaactggatacaaaggagaagcaaacacaacgaaggcttctgccttaaccttctaggtgtcctaccttgtaccttgaagggattagagagaaaaacattctccatcttgcactgctgatttccaatgacaagtggggcttcccccctcccacagaggattacaggccaacttgggtatggtagggttttggggactggaggtggtttagagttttttccaatcttattaaacttactcagagcttaacatctattaatgaaattatgttttctataataaaagtagagactcaaatcctatagatgccctgaccttaagatataaaaattcaattttaaaaaatattacacataccaaatacaaaagatctattctgtgacctcttctctaacaccaacaactgtaaatttaatatcatcctgtgttacctgaggtagttggaaggtgtttcttctacgtttgttgtatctagctttttcttttcagattttattatttatttatttttgagacagggcctcagtctgtggctcccaagctggagtgcagtggtgtgatcatggctcactgcaaccttgacttcctgggctaaagtgatcctcccgcctcatcgtcctgagtagctgggaccacagggatgtagctgggactacaggcctgcaccaccacacctggacaattttttattttttgtaaagacagggtctcactatgttgcccaggttagtctcaaactcctgggctcaagcaatcctcccgcctgggcatcccaaagtgctgggattataggcatgagccaccatgcctggccagctttttctttaagtgagaaaaatggtgagagagaactgtctcctactcctacttccttttggtcacacagctatctcgaccttgaataaaatttctggatctgacatggtttcagtggctgcaatgagaaaggaagtatacagcacaaactaggagtagatttgttattcatactccaacacctgattaccttctcaaaaaccagggtatttcctgcaacccagattcctcattgacaggaatcatcttggtctgaaggaagggatcaggagccaagaaataagagtggcctctagaagctggaaaaggcaaggaagcagattctccctagagtgtccagaaggagccggccctgccaacaatcttgaattttagtccagtgggactcatgtcggactttggacctacagagctgtaagataacacgtgtgtggtttttaaagccattgatttgtggtaatttgttatgacagaaacagaaagtgagtgcactgacttccctgtaccagtgaccactaactggcatctacactagtccctttccaaacagtagtgctgtttaaaaaaattgttatgtttatcaacatgaagcatcataagaagtcacaatcgtaagttgaagtcaattagaaaaaagaaaattctaacaattaccaaagatccaaacaagaaaaattcagtatcaaacattcctcttatattcacaaaagagacctgaatacacacatgctttaactaaaatgatttctttcctatatgtggaaaaaatgcacttattcattaattcaacacataatttacagagcctctcccacctgccaggcactgtgaagaatcctgagggtttcctgccatctatctgagccagggcaggtgtggaaaaaaattttcacattagttcattaatggtaaaataggaaaaaggaatagagccacagcttaaaagttatgtcgttatagacagagataccagcagagaactaagccacgtgcatttgttatctgtttctgagcagcttaaagcaaccagctaagtgacttcacacagttctgagggtcaggaatccaggagtgtcttagctgccatggttccgcctcagggtgtttcaggaggttgcagtcaaactgtcagccagagccacagtcaactcaaagatggacaaaggctggggcatctaagctcactcctgtggttgctggggaacctcagtcactccccggctgtttgccaggggcttgggttacttgccaggagggcttccccttagagctgctacaagaaggcaggtggcttcttcccaagtgacccgagagagagattctgaccaaaacagaagccaatgtgttttacaactgaaccccagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggtcacacacaccaactgtgatgcagtgtgggaggggagtgcccaagggtgtgaacctcgggatgcaggaatcattgggatcaggttgaagcctgactaccacaccatgttcttccaaaacatttcaacaaaggagccatgtagtaaaatcagcatggttctagaatggcagtcatggggcctggagtagccatggatcggccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcagctactctacaatctatcaaggcctcggtttccaaagccgcaaaatgacaatggagtcccatctattaataaaactttgggaggtagaagggctgctgcttctgcactcaacgtttactgggtgttcatcatgttccagatactgtttgaagcgttacacccttattaactcactttcttctcatcataaccctctgaggtggttacaatgttcactgctgtgtaagagctgagaagactgaagcaaagagagttcatccatttgccaaagcctcaccattagtaagaggtagtcaggattcgaacctaagtggtttggcatctaagtccacattataacccactgtactctctaacagagggtatggaaatgatgcaagtcagtacactataaaatcatcagcaatactaaactttaaaagaagaaaccacgtttaaaaaattggttaaaaaataggagccaagcatggtggtgctcacctataatcgcagctactagagaggctgaggtgggaggatcacttgagcccacgagttcaagaccaggctaggcaacatagcaagacgttgtctcaaaaaaaaaaaagatagatagatagatagatagatagatagatagatagatagatagatagatagacagacagacagacagacagacagacagacagatatagattccatttacatgagggacctagagtggtcaaacttataaagacagagggatggatgccagggctgggggaatagggaatggggagttaaaatttaatgggcattgaattttagtttgagatattgaaaaagttcgggggatggatggtggtgatggtttcacaacagtgggaatgtatttaatgtcactgaactatacacttaaatgatttaaatggtcatttttatgttatgtatatcttaccaccataaaaagaagacattaaactacaatatccaatattccatccaggggcttcctcaaaatggaaaatccccatggttaatcgctttagatgcatagaaaatcgttccgttctaaggtgtaggaagaaatccaaaaggacttgtcttttctggttggtccatcatcgctctctcaacttcttttcattgcacttttcattacagaaataaaataaaatgtcggaagagtttctgttactcttatctttcccaagtcacattaagtaggaatttttaatttaagtgcattccatttctaaagccaggaaaatctgcccacacgaggtgcttcatagcatacacattaggaactcctctatggttctcattatttacacccttcctcggatgtgccctgtgtgttttgagagtcagagattggcccgacaaaatgaaagcgaaggcgtcagctgagagggacgcggggctttaggtaaaggacacacgatgagaggccctggccatcgggttactgttgtccacgtgtcggatggctagagacgctgtgagagttactctctctagaggtcagcactttggatgccctcaccctctgaaataagcattttctcccgggacatcaaggagctggggactccaagcattttcctcaccactctggtcatctcccacatttaggaggaaagttctacttccatgaggcctttgcttgcctcatttcagaaataggggagggccttctcataaaatgactttttatgccttagttaagagcatatgtttaatttaccactcacttccctctcattatccatctatgtgcggatcacagtactaggtggtatgaagtgagactgagaaagtaagagatgaagaaacttaaaaaaaaaaagctgtaaaaaggacacaggtaaaatctaaccttcggctgggcgcagtggctcacgcctgtaattccagcactttgggaggccgaggtgggtggatcacaaggtcaagagattgagaccatcctggccaacatggtgaaaccctgtctctactaaaaatataaaaattagctgagggtggtggcatgcgcctgtagtccaagctacccgggaggtggagcttgcagtgagccgagattgcgccactgcactccagcctggtgacagagcaagactccgtctcaaaaaaaagaaaaagaaaatctaaccttcgaagaaatggaatgattaagacacatgaataaataaaacaccacttacctagaagtttctaatgtccagtaaacaaattgtcatgcttgttaaagttacatatcacaggtggcttcataagcctcaggacaacctgagaagcagccctgtgctacacggaagtcatgggactagagtagaaacaactaggtccaaaccctgaattccgcattaattcatttgttgattacgacgtccacccatatgacaagtatttagcctaagtctgtttatacacctgagaaatggagaacagtaacaaatgcctgagggtgctataaggattaaacaggtaatttatgccaacgtgtttggtaaatatttacagatgatacaattatgaactgtagggctggatgatatttcaagatatcaatttgtgctcttctctttgcattgcctttctttttctcccacagatcagactctgctcagtgcctcaggggaggcatgtggcagtagagaaagcagaaaccatctgcaaaatctgggatgcagtagggggtgggggagagactaatgcagcctgcagggctgacggagcaggggcctaggccccagttctaagcagggctgccacccagaagcacaacttccccaggagggggatttggatagacagagacacatgcaactcctgagtcctatgtgtggcaaggatgcatcagagagccaatagacatgcacagggggcaggccaagagagccatgcccctaacagcttggtcctggggatgagcccagaaccctgagaagggagatgaagttttccaccacaccagtggaaagacaatcagccagaaattgggcagatgtatagaaaaaaaaatgaaatgttatttttggcacattagagtttggggactgagttttatacccattataatatttaacttcccaacacctaaaatcctcctggcagttaacaacgaatgcccaatggaagaaatgtttcttgtttaatttcataaatacatatagagaagccatcttctctgactaaaaagaccacagattgtgctgctctaatgaaaagagcattggcagggcataaattctgaaacgattttctatatgttgctagccacatagaggatgctaaataaaaagctgttggctgatgggtgacaaattgtccagggcagctcataacttccctagactcttgagatcaatggcacacacctgccaaccagtgggctgggattaggggtataatgtgttgtgatgaatggaccttttctccatgcaatgctaatgggtttatatagaatagaattcatgatacaggtgttattttaaacactgtgctctaaccccttgaaaactgaacaaatagacacatactcattaggccaggaccacatctatcaagttacctaatgcattcccagagcctagaagactactaggcacagagtaaaaattcagtaactatctggtgaatgttaactcacagaagacacaatactgcctctaacttcacctatgaaatgcaaagtagaggcgtaactccaacaaataaagccaagcccagtatttaaaagcccaaaacaaatgaagtgcaacaacagaacaagagctggctagctttccagtgtccccatccaaactagggacacctacagaaacacagaaagttcaaagcctatgggaggggaacgtgggggagggagagggacttatttaccagccccagctttacacttcctccatctcctcctcttctttagcaagatgcctctgtgctttccatgaagaagtcggccccagaacatgacctgcatctcagagaagttctgatttatgaattggcactgaggcgacgtcgctggtgcggaacaccatgacgtctgtgtctagggtatgcgcatatgctgcgtttttccgcaggtgcctcgcagtctgctctggctcttagggcttccgaactcagttcagggcatggattttaattaacgaaatgaaacactggccctacacgacgggacacttaatgaatttatttaatgatgccaaatatggggaacccctttagggagagaagcaaaaggaacaggagaaaaagatcaatttgttaaaagacagtcaaagcaactgagtgttactctcagacaggggggatgtcaactggggagtgatccccagaaaatcaacttcattgtgaaatcagaagtacgagcatctttctttcaactggaattcattgagcatctactgagctgctatttcagcacgcttgctgctgggagacacagaagacatccttcctcctcaacatgcttctgatagacattattaagaaaaactatttttttggctagcaatgcagtttcacctcacatgatttcacttccttggagccgtgaatcagcagtggcagggattatctcccctgaggaaaaccaagatgtgggctggctggctggggtagggtggtgagaggcagtgctgtgcaggaaaggactttctccaggccagcaggctatgcagttacacagaggagcaagccctgcacccaccatcgtgattcccaacccttccccagacctcagcacctccaccaccaccagggaaacaagacacagtcacggcagcggacagcactttaggacaaagggggaaggacaaaggcaggatgtgaggatggtcagggagtgatcagaactgctgggagaaagatcagccattgctaagtgtgtcttcaagccctacacttccctggagagatcacagctttctctggcagatgctcagacaagaggtcacggataggcactgttctggcaattgccagacaaaccaacctctttctgatcccactgagaggctggacaataacacagtctgtagacaaggaaattcaaagcatggcattcctccagggaaaacgctgtgctggaccaggaccagggcctgccaacacctgtgagcagacagattccaaaatgtacagtcacaggctggctcctctgaggcttggctcacagtgcttcatcaaaagaaataaagataaggaagtatcttcctgctatcagcccctgcttcggtggcaccccactcatctcttacccacccttggggagggaatggagatctttaaccctgggtaaagagtacaatgaaacttcattttctgagctcccagaggttttggaacgtgatagctcctacagagacatgattcttgctgaataaataattctaagtcagtgacctgactagggactcatgtctgaagcaccgtttgattcttcaattttcaatttttcctccttttatttactagccaatatttccatgtgacaaccacatgcccatcccattaggagggctattacaaaagaaatgaaaagtaaatattggtgaggatgtagagaaactggaatcctcgtgcattgctggtggggatgcaaactcctgcagctgctgtggaaagcagtctggatgctcctgaaaaagttaaactaccaaacgatctagcaattctgcttctcggtatatgcccaaagcaaacgaaagcagcgactcaacagatacttgcccaccaatgttcatcgaacattattcaatttccaaaaagtggaaacatcccaagggtccgtcatcagatgaacagaaaaaatgtggtgtagacagaaaataatattttgccgtaaaaaggaaaggaattctaataatgctacggcacagacaaaccttgaagagattatgttaagtggaagaagccagacacaaaaggacaaatactgtgtgattccacttacgagaggttctgagagtagtcaaactcacagagacgcaaaacagattggtggtgtccagggttgaggtgaaaggggagtggatgattgtcgcttcacggggtaggaatttctctgaggtaaggaaaaacttagaaatagatatggtgcacaagactgtggatgtaattaatatcactgaattatacactcagagatcattcaaatcacaaactttatgttagatatattttaccaccaaaaaaaacccacaaaaacaaccaaacatgaaaccaaactataaagaagaaaacaaggtggaaataaaaaaaaaataagagcttaagaaataaaaggggaagattgcaaaaagcacacagaataataacattagcaatgctgccatattaactgcatgtagatagtatttactctgtgccaggaattgttctgggtgctatccatataacaacttgtataaccttcatgggaaccccttgatgtaggtttttattattatcctcattttaaagttaataattctgaaaaccagcaaggttaagtatcttgcccaagatcacagagcaagacatggcaaaacctagatttaaacccagaaactcttgacctggaatctatgtttttaaacaactaagctggttgccagtataaaagacctaagagtgagtcaaaaaaagaaaaaaagaaagaaagaaaaaggatttaaggatagggatgtataaacaattatatactacctaaagcaagagagagagaaagagagataaagactaatgaaaccaacatactgcattcttatttcaaaagtcaaatattaattgttccataaatagtacaggatactactgatcttttaggctcacccaagtctctcccagaaaacaaacaataaagcagaaagagcacggaactcgaggttataaaatctgctttaaaatcctggctcaatgacttactttgcttacttcttcatttagcgagtatgtaatgagtacctgctaggcaccagggaacatgctggctagttcactcaacgttttgaatcctagttcctcttttataaaattggaataatatacctacttcacagggttaagaaagctaaatgagataggctatgactgttcttgactcctagtttacactcagtaatggttgactgaagatgttttctcttgcctagtttctcagaataaaaattcgtgatgatgataagatatataaatcatgcggcttgggttttcaatggaggcattgtgactgccaggctgtagacaaatctacacagctactcggctccttgtgccccaccctctttcttacccttaagctggcaagatgatgacacatggcagggcaccgataagtgtcggtttttttctgttcttcccagaaggggtgggaagagacaacagaaaggagaaaggaaaaggagacaggagaaaaaaggaacatggaagaaaaaaaaacagaatgtgaagatggagataggatattacttccttcccttctctcccactggggtagaaagggctgtggtctgcagggggcgtccaccttccatttctctctagaatgtcccatagcatcaaccatgcccctaaaccaaaaatgacacaaaccttctccagactctaaaaagcccctttggaccacacaggacttctctctgtttccccctcccctggacaccaccatacacacagttcaatgatgaccttttattttgcatcatggccaaaacagttattaaggagtttcatttccagggcgctcactaatcaagataacagagactaaaatacaaggcctacaagccttacactcatcactggtgattcgctgagttcaccttgtcaagtaaactgtaagatgctggaagacagagaacgtatctaacagaacatatctatcagtgagtatttgctaaagccacatcttgacttatgacatatggagtgtttggaaacagaagatcacatttctacattccacatagatcgaaagtctagctaacttagagactgctttattttgtccgagtaaggttttccttaatttctaaagttctgtgatggtaagaagaagcccaccaattatcagcccatttacaccacttcactcaagtcttacgaaatgaggccgctgtcctgcgcccccgacgaggagggaaacgagactgatgcaaatgatactctaaggccaacagacagaaccatatttaggatcctatcgggctagctccaaacgctgccttcccacctattcacctgaagttccttgtaatttgttagtgtgaattaaatgacatctcggaaagtgttgcttctgactagtgagaaagttttatgtcaagagaagatgaattgctccaaggagaaaaatatgccaggcaagtccaaacacgtctgcctacctacaagtatgattcccacaagcacgtcctcctcttgccaacccatcttcaaccttatagggtgcagatgtttttgaaagtttctccttgctccaggtactatggaagagacagtgtctggcttcatcctggaaaccatggggtatgtggcatccatcatgttttggagatgggccgtttttacattagccacccttgccaaaatctaagaagcatggctgtttctcatcatgtggtcgctggctctgcgagctgtggtttgaagacggaaacaataataatcctatacataaatgactaacattttatggggaagacagaaaatagtttaaatgttttccatgatcctctttttgaactacaaatgatagtcaaacaggggtcattgccctggctgataattttcagaattgcagaccctacagtaaataacattcacagatggttcctttctttgaatatcaatgctctgccttttgggagctggcagctactcagagaagagcattaaactggccagaaagagacctgggatcctctggatctctttcctttgttcagaacaagagattttgacagattctccggccgccagtcttccagctctggtttccagctctggttctgggcgatccccaagagatcacagatactttgtatactttccacatccaccactgtaattgcagagtccctatcttccttacgattctgtttactagaaccaaacccatcatttttgagacattgccaaattcactgcaggaacaagtcataagtccactgagaagcgcatgccagttgtgaggagactccggtctgacgggcaagatgaccacctcctttttattttattatttttttaaatggagtctcgctccgtcacccaggctggagtgctgtggcgcgatctcggctcactgcaagctccgcctcccgggttcacgccattctcctgcctcagcctcccgagtagctgggactgcaggctcccgccaccacgcccggctaattttttgtatttttagtagagacggggtttcaccgtgttagccaggatggtctcgatctcctgacctcgtgatccacccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcagcctcccaaagtgctgggatgacaggcgcccgccaccacgcccggcccattattatttctttagagacggggtcctgctctgtcacccagcctagagtgcagtggtgcaatcatcgctcaccgcagcctcgacctcctgggctccagtgatccttccacctccctctcccaaagtgctgggatcacaggcctgagcctccgcgcccggccacctcctcttacagtagttcccaacccattcttcggcctcactgcatggctcacacggaaacatctcagtttaccaccgcacgatgtaagtgcgttctacactcaccaaagagaaaagaagtctgaaggataaggcagagaagagaaaggttgtaggtaggaggattggtgagcagggaagagatatgatggaagaggcggagggaaagacggtaaaggggcgaagaaatgccaagtgaagatgtgtaggcacacagaagaaccgaacccagaaccagaaaggggaaaaactctattgttctgtggggctccaattcacaggtcattaggctttggaggatccccacagaaggttgtcatctgcttctcaaacctctggcaggggcatcaggtgtagctatgctaccacagcgccatctggtggagcggtgggacttatcatgacctaatcaaactcttttaggactaattccgtcttgcaacaattccaggcaataaatacaggtgacaggatatattattgaggaatatggacagctgaagttcacacattgttacgtcctatggattatctcctctcagaacaattgtagagtaactttacaatccacatactgaaagattccctccccattcctttttatctcttcccaccccattttgaacggctcagctatcaacaaaattttcaataagaaatacattgcctttagatgtacctttttcagcaatgtaaaactaccttgcttattattccaatgatctgaattttgagcatctctttaaattacatacagatcaatgtcatgaagcattaaatttattataatatgtaatataaatatctcacacatctagtcattaaacactaatatttactttgttgcctttctttctccacagttttcccatgtgattctcttaagaacaaaatataatacagtcgtgtaaatctaagtgatttattacacaagtgattatcctagagatactgggacccacgacttggggctccaccaatgttcctctgttatataagctcaggtatgagttctgggaagccacagggcatgggagcaaaaccacatgctttggctcagacctcgattggaattcgggcaccgccacttactaaggggccttctcaagcctgtctcctatctgtaaaatgggaatgagcctaccgacttcataggattgctgtgaggattaaatggaaatcggtacgcaaaatggccagcacagtgctaacatctagaaggtgctgcccagccccaaagagatctaccagagaaataataattctcatttttagtcaagctacaaaataagactcctcatttctgatttgttttataaaaatgcaaaaaagagagagaagaaaagccttccaagattctgataccgctcaccccagttttcacttgaaagtcaaccaatgaatgagcaccagggtgaagatggaattctgccagccacagtacctgcaagagtccacaacacacttgactttcattcatgtgtactacaatcctgtgggttaaagggccataaaagttgtcctggtttttcttatacttcaaaggaagcaatttaatggccatgaatgacagcctcccgattacactgtaactatgaaacacgactgttctggaatgatttccaggctggctccctcaccaaaggaacttcaaggtaagaatttaaacaaaataacctttccaggctttcatccagcttcctcatgcaagaggctctatccttgggagcccagggaatgtatgtgcacacaaagggttacgtagggttgaggccagacagagggtggtctggagagttgtgttgaggcagggcaacccagaaaatggacagcactgttccctggggaggcctatatgctacagacactataagaaataaaagaataagggataataattttttttttgagacagcgtctcactctgtcacccaggttggagagcagtggtgcaatcatgactcgctgcagcctcaacctccttggactcagctgatcctcccacctcggcctcccgagtagctgggactacaggcgtgcaccaccatgcctggctaatttttttgtatttttttctagagatggagtttctccatgttgcccatgctggtctcaaactcctgcgctcaggccatctgcccatcttggcctcccaaagtgctggtattatatgcatgagccactgggactggcctaattttaacattttaagggggaaacattacatgaagaatgttggttacaaagaaaaacctcaaaaatgtgggctctgcctatcttactgccattgcttaattagccagatagagcaagccaaaaatattcccattgccctatgactcagcagacaagtataaatgtttctcacagtagcaaagcaaacgcttacagctggaagaccatcacatatggtggagccaacgctgtacttggaactggatttgattttcaatcctggtttctcaattaactagctctctgaccttgggcaacttccctgaacattggtttgctcatctaaaatgcggatagtcacctgtctctataaagggctacccattaaattagaggatgtgaggataagcaaatcaaaactcccttggtatgtcctatgcctcctctcagctggaatacagcagggcctaggaaacaggtccagttttctgcagagagtcatatgggcatagtttaagcatgtaaaggggcacgcttacagtgatgttataaaagcaaaacacaagtacctgcttactgcagaatcctctcacaaacagagaatcctatgaaaactgcaaaagggataaagaaagaaaaagtgggggaagccaggtccttcaaacctccagtcagcagtcactctcaatcattaccagacgtcgtcactgaatttagggcccctgtcagaaccagcacacatatggagccgtggttacaggccagaacacacacctcttgacatttaaagatgttcatcttcaattggcctccatatgagatgtggagtttgagaacctaattgttcccaagctctgtgaatgggttttatatactccgaagacagctagatattgaaaggggagaaaaggcgggatcttgacatttgggaagcaattctactacactgttttaggattggttttaaaaattaaagacggtgatttgatgtttgtgttgaaagcacaaccacgtcctgactgctaaaagaaatctaacctatatgtcatggtcccccaaagccccaaagtggattttaaagttgttaaagtaaaaatctactttgtaggaagagcccgccttgctattctaccttaaaactgatgagcgagttggagggactgggatgttggaggggctggggtgctggaggggcggcggggggcgggacaggggagacacgggtggtgaggaacagtccagggatatccaggctggacccacgtaggttcctcttcctaccaaaggggaactgggacgtgctccctgtttcccagacggaactcctgggtgataatgtgagaagcccttactgcacatctgtctttccccacatacttacaaagttagggggaaagctggaaagtgatatgcagcccctgtataattctgacttattctcagaagattttttaaaaaactaaaaaataaatggaaatcagctgcagccttcctgatgtgtgaatagagacaatttaaaagacatcaagtgccaaatactgacctgtctcgcctaacaaaactgccctgtctttcagcccactgagaacagagggacacacaccacagggaggtgagctgtctcggaaggagccctccacgcagaccccacagctatattaactgtgcttaacgtaatcatgaacacataatcgcggggctattgaagactccataacaaacaagatcaaggagcctggagcctctaaaacatgaaaaccaattagcactatgaaatctaagagcagacacagccagagctcgagaaaaggcatgggcaggagctggactgctcaatcctgctcactcctcccttccttcctgttacacggttctgttctgaggtgctgctgagaggggcttcctctcctgggccagaactgaggctaaggcccgaagctgaggacagaaagtgatcaactccccacattctaaagaggctgctggagaagcggccacgactggggcctgacatccttctctagggattatcaggcagcactctgctacccatcccacaggaccgtaacttatccttcccaatccgtagaaagcaagactctgaagcatgtgcgtttgtctttggccttgtgggaggtttctattcaagaggaaaactgatgccatgaaggatgggatgaggtgctttctcttcccagaagggaaagatttgggtgcctcgtgaaagggagtctggagtcagctccctggtcaatgatctacttgcagagacaactctctgatctcaccttaataaatgagattcattcacctggcactttgggtttcatgtagggggagagatggaagagttaggggaataaaaggagatgaaaggactaaagaaaaggcagaaggaggccgggcatggtggctcacatctgtaatcccagtatttcgggaggtctatgtgggtggatcacttgggtccaggagtttgagaccagcctgggcaacacggcgaaaccccattctaccaaaaatagaaaaaaaaaaaaatttgccaggcatggtgccatatgcctgtagtcccaactactcaggaggctgaggtgggaggatcacatgagcctgggaggttgaggctgcagtaagccgtgatcacaccactgcactccagcctgggaaacagagccagaccctgaccaaaaaaaaaaaggcagtagggcatgacaaaaaatatactgtggggcaatttgtactcagacgtgggaaacaggattaaatgcattagaaaagaactaaactgaaatatttaaaaatgacagtaatcagttaacaatccattccccatggataagaaggctgtgatttttacaccaaaggaaaagtgtttaagtcatagtccctaccataggggcttcaacaaagtgatgccaaagaaagactactgtcctacgaagacagccatctggaggaggtcctaatggtatcacaagcgatgtgacaaaaatgaagtcccttcatttctctcagcctttccttacctgtaaacagggcaagaatggaaggctgaaatagccagaggttccaaacctcaatggtaatgaagaaacacaacctgtgcattgtattctgaaaggcctcggagaaactgtgtccttatccacagacgcacagagcggtgttggagaaacatcagttaccacttgcctaggatgtctaagggctcttgacacatcctgtaatgcgacgtaaataagaaataaaggtgggcctcactgaaagcagaactcctctcagccgaggactggcttagcctgagtttctgggaggtgatctgccctctgggcttcccctccctcggcccattaacatttctgtacttagaagtcggctgggatcctggagggcataagagctgtaagaatgccatgactatttttaaaattttgaaaaataaatactagaggctctggcagcaacagcgcttggggagtagccgtacctctgaagttttcctttcctttctcgagcaacgcagggagggagctgtttaatgaggagtctcaacaccggggaacaaagcagtagtgtttgcacacaaagcttggtgctggcaattttctcggtttcgttttttcatgctgccaaagtcatttgttttgaaaataagagcctctcctttgccctcagcatccctattaagacactaaaccacaggattaattctgtttaggcctgcagagtgaggtaaatcctctgagacacctcagcaccttccccaggtgagacaggagagtccggggatgaagaattcggctctggagtcacagactcaagttcaagtgccagccgtaccgcttgctagcagcgtggccttgggcaagtcacttggcttcggtttcctcctcttagctgcaaaatatgaaaaacgggcctgctatgaaacgactggcccatagtcaacactcagtaaatgataactatataaaataatggtggtaaaaccagcaaaaatcgacaggtgtgtatcgttgggccataatgtgaaaccacgctcaaagtactttaatatagcatccttcaaggcgctcacaatgctgcagactgtaggagcgaagtcagcaatacaggttggaattcatgtattgggggctatactaacatatacaaagtatacgtgatttgtctaggttgtttttgatgcaaaatagcctgaagctagaggacaccacctactcttatctacagtgtcccttctgtttctaggaagagtctacaatcctaactttaatgcatttttgtctaaactaagagtcttcacattttttgaagtcacagaaatatttgtgaatatatatttttaactgggacttgattactttgtaacatgtatgtgtgtatacacatacacacacgtacataaaagggtaacaacgcaaaaggcaatactggtttgtgtatatatcatatagtggaaagaatattagattcaagttagatcatctacttccaacactgcagatggccagagccgtaaggcaagtctctccaatcaggtcttagtattctccttatttaaaaaaggagaaagacattaaaataccttcaaaattattgttgtgaccccaggcagagtaactagaatgaagtagaagaagctattggaatatgacgttgtctcatgtaagatcttttttttttttttttttttttgagatggagtcttgctctgttgcccaggctgaagtgcagtggcgtgatctcggctcactgcaacctccgcttcgtgtcgtgagatcaagcaattctcctgcctcagccttctgagtagctaggatcacaggtgagtgctaccatgcccagctaatagggaggctgaggcaggagaatcgcttgaacccagggggcagaggtcacagtgagctgggaatgcgccactgcactccagcctgtgcaacagagcaagactccatctcaaaaaacaaacaaacaaaacaaaaacaaaaaaacaacaaaaaccccaatattttaaaacataacagtagaaattgtgtttgtgaatgtcataagaagtttctttacttcttctagttctctgttgagaaacaatacagaatcgtatgctctgtctattggggcaacaattcaatcacagcaggataaaaattgacttttaaaaagtgaccccctgctcttgttttctcctctccttcatcagttcactaccagacctcacaccagagatgaagcttctccatgcagagaaagacctaaaactctagcgtgatgtactcatggataagaattgatcaacatgtatccagagcccaatgatgccaggaagaaagcctaaacataatttaataaactccctctctgttttcttcatttcctactactttggtttacttaaaaatgagtgtttgcaggagaaatctgagtgcatttttggcaagcagctgagttatctttgcttattcattaaacgaacagtgtgacggagaaagtccaaataggaaagacaaggaaaaatggggaaaagttgacttctcatcccaaaatatttcttggattaaaaggcaaactcatccaatcttaaggtttagagggctaaaataattgttccatatgtagctgttagaaggcattagatattaactatggcatggtgtctatggatatctgcgtcatctatttagatagtatgtgctgaatatcaaaaacattaagctaaagaaggttaaggaaagatggtgtttccccaaggaaaggtgtgcttatcctagtttgacagtctcctaggaaaacttggatactttcttacataggaaggacatataacatgcttccagagtcacagggtttgaagacggctgaagacgtcatcttgtccccatatgcggcccaggaagagcgaagtctagcaccacattgggactagaaatctacattttaaatcgtattacaaatttagagatctaatggtgtattagcaagataagtttcaaatacatcaacaaaatgataggcagaaggaacctcaaaacttttgtgatctgaattccccatttcatagatggggaaatcaaggccctaagagctgaagaaattgccaaaggttgaaaaacactcctcaaacaccaccttcctcctctctgggacttcatattatttcattttcttttactattctgcctgagctttgactttctggaattttaaataccaatataggaatcatcagctggtgtcaatcctcaataagatgacttaaagtttactcataatggtttagcatggtcagaaagtgaacattattcataacggtttttcatggtcagaaagtgaacactacaggtttggcctatgtgcctgtaaaatttagaaaaaggacataaaaaggaggagaatttaaaaatcacctagaccactgtcgatgctgtgagtgggaattcctacttacaaaggccccagtgcaagctccctcttagttagctgccttctgacccagctatctcaacagagttcattaactctgttaaaaccactaacttatgccatggtaattcacataggagaatggcataactaattaatatgggtggaggggcactggctctagcattaaagtggattgataactcactgaaatctgcatgatcacacacaaactccttatcttgctaagtttacgcttgctccactacacaaactgaacaccagctcttagtaccctcaatagctaccctttcctcactgcagaagaactaagtttttcatcagacacccaaatgaaactgatactggccgtcagtatcattatccactgataccagctaccaattgcttgctggtactggctgtcaatatcattgtccactgataccagctaccaattgcttgctggtactggctgtcaatatcattatccactgatactggctaccaactgcttgctcgatgactgaacataagccaacgacactagccccaagtactttcctaccttttcatccaccattagcataaggaagagaaattcctttgttgtcttcttgagggaaaaactacacaaaatagaaagccttaggctccattacataaagcgttgaaaaccacacaccatgacaataaagacccaagcatgttttcaataaattattttcctcttatttcacactgtgaaaacccacatttgatagactattttatagcaaatgtaccggttatcaataaataagtagagtttccacgtgaggagagaggagaaatctactcccagcatttgcccccttcatgggtgcaacagaacttgtagcaattctctggtttaaacaacaggtggcagtgtcatttctacattttccctggcaagaaacctttgcagtttgtgatttcaccttccaggaggcattaacagttttgtaaccgcctctatcgacagcgtgtgcatatgttcctatgtagtaaatgcaaatgcatgcaggaaaacattgagatttgtgtaaatgcagtttcaccaagtgctactctccccatacccacgcccctccccacacaatagtctatgcacaggcatcatttcccttgaggaaacagcaaagcagggaaaaggcagaaggaaaatcgactccatcacatatgttctgatcctcaattatcatatacatgtctgtcacccacccattcctgccacacatacaagagaaaggatacactacaaggtcctggggcacactttgggcaaatgactgagaaagcgaagttctgagaaatcttaattcacatcaagaaaagcactctactgtactgacatttctggtaggcgctgttttcactcttctgctacaaaagagcatgctccatatttgaaaggaatcaacagaaacaggtcttacattcccacaaggaaaacacagaagtcaggaccattctcacatgtgccgagaagacaagaccacgtttcctagggtttttgtgtgagctttaaataggagaaaagtgccatgtcaagaattcctcattcaatatctatagctcagttttttgttcacatgcattattttattttattattatttttgagatggagtctcactctttcacaccagctagagtaaagtactgcgatcttggctcactgcaacctccacctcctgggttcaagagattctagtgccccagcctcccgagtagctgggattacaggcacgtgccaccatgtccagctaatttttgtatttttagtagggatggggcttcaccatgttgtccaggctggtctcgaactcccaacctcaagtgatccacctgccttggcctcccaaagtgctggggctacaggcatgagccactgcacctggccacataattttataatgtagcagcaggtactctgtggtttctagcctataatgtaacagttattggtttgatatgttacatttatttaattttgaatctgtggtgtttttttaaagcaatttaacaatgaaaatctcgtcaatgcagcagggatgagatcaaactgactgatgggtaaatcaccagcctaaagggacacgccaggtattagacagtctggcatgtgtagctggagaagtactcaaaaatgtataaaagtcaatgagcacatatacggagaattacacagaaaataataagcagcactagaaagagatgatgtgtgttttttgtactgtccctgtcacatagcatcaaacatccacattcctgctttctgagatgagagggttggacaagtaccctcaagaagctttctggtatacggtacacagtatcttattgttttataaatagaaaaaagagaatacagaggaaaaaattaaaatacatcacctagagttcagaggcattggaggaatttggctttcatcagcaattttgcattaaaagcaagtatctgtcggccaggcgtggtggctcacgcctgtaatcccaacactttgagaggccatggtgggcggatcatgaggtcgggtgttcgagaccagcctggccaacatggcgaaaccccgtctctactaaaaatacaaaagttagccgggcatggtggtgcagcctgtaatcccaactactcagaaggctaaggcaggagaattgcttgagcccaggaggtggagattgcagtgagccgagattgcggcattgcactccaggctgggtgaagaacaagactgtctcaaacaaacaaacaaataaaaaagtgagtatctgtcctaagcaacacattgtcaagtgcggcctatatgatttcctggtggtcagataatgttgcattcatgctttctgtaggaagtggggtttcatgaaacagcatgaactatgaactttgaacgaagagtcacgggcttatccctgactctaggacttagtagcgtggttaatcacagccgcattattaatgtctccagttctccaaaatacggtaaatgacaccataacagatcttttgtaaagctatggtggatatttttaaaggattatttattcatagtaggtgtctgataagagctacttttagacttttggacttgtagataacttcttttaatttcctattaaaatacccaggaaggtacagaatccagtgttggggctcataaaccaataccctaaaatacagcgctttgacatcctgaactgaagaagcctccaggtctctctggccttccactttacccactgtctctcaatcttctctctctcccaagcagacgatgaacttgttcattggagttcccttatctgcccaaactcccagacctgccaaagaagaaaacaatcacctctggctctttccctgcgtcttcagtaactgaactcctatcccaggaacaaagactgaaatctgtcaacacacctgaacagactcctatctgctttgcgggcccaacagatggtcccaggccatggtatgttcttcaagcccactgaattccctaaaaatcagttcctaccccgttaaaatcatccacacttccccatctccctttcccctaagaagaagggtgtatacatctgtcccccagggcgtggtaggtcatcactgtgactctccctcatgcacattaacaaacgtgtatgcttttttatgcctttagcagctgattttcagcaaaacttcagaggaaaaaggggacattttcccttggccactccactagccacagtcctataagctaaagataacagaagttcccctatccaacaatctcaggaaagtttcctttaagttcagcattaatcactgaatgttctaccatctaacaactgtatggcattttaaaaaatgtttaactgaggttaaatatatataatgtaaaatttaacattttaagtattcacttcaggggctacaaagtacatttatattgttgcacaaccatcacgaccatccatctccagaactttcttcatcttctaaacctgaaactctgtgcccattaacaataacgctccattcccgaccctctcccctcagatcctggtacccgccattccgtctctatgaatttcaaacatgaggtgcctcacagaggtgaaatcatgcaatatttgcccttttgtaactaccttatttcacttagcatgtcttcaaggttcacccatgttatagcatgtgtcaaagtttcctttctaaggctgaattccattttatatgtggcacacattttgtagatccatacatctgttgatagacacgtgggttgctctcaccaaatgtgtacaaatatctgttcgagtacctgctggattccaattttggggggtgtatacctagaaagagaactgctggatcatataataattttatttctaatgttctaaggaagtagagagcattttgaaatgtgagatcgaggcctaagcagtcattcttgctaactggaatgctggagtgctgagctggtcatggctaggctgatcccgtcagtggcggacagaaaagcattgacatgaggtctataaaaaaataagtatcagccaggcactctggctcacgcctgtagtcccagctacttgggaggcggaggtgggaggattgcttgagcccaggagttcaaggccagcctgggccacacagtgaaaccccatcacttaaaaaaaaaaaaaaaatagaatagtaaaagggaaaggaaacatcatgctaaagaaacagaactggctgggcgcggtggctcatgcctgtaatcccaacattttgggaggccgaggcaggtggatcacctgaggtcaggagttcaggaccagcttggtcaacgtggtgaaacccagtctctactaaaaatacaaaaattagccaggcgtggtggcatgtgcctgtaatcccagctactcgggaggctgaggcaggagaattgcttgaacccaggaggtggaggttgcagtgagccgagatcatgccactgctctccagcctgggtgacaatagcaaaattcagtctcaaaaaagaagaaaaaaaaagaaaaagaaacagaacaacagcattacctgtgaaaaatctttcaacacagcaaacacaagaaatcttgctctcagtaggacaaaggcaggcagaagcactgtggaagaggggccaggaggggctgagatgagggcagaatgagggagcacagcgagctaactaaggtcaaagaaaaagaaaacaaggaagctggaattatgttaccgagaataaaatagacattggaaagaaataatggaaaaacagttcagccaatgtgtggccattcagaagcatcctgccttgtcggtctaatgctaagaatgatgggagaaggggcttccaatctttttctatgattttttttttgtacctagttaaaaacccactgcatttacagttatcaatgaaactgttctgcttaataccataatacaagtgtctttccaaagttttttgttccctgaggacagaataacaaatgtcagaacatgaacatttttagggcttctgatacatactgttgccaaaagtatcagcaaggtatgaggccatcagcactgccaccattaatttttattctttttttttattttgaaagaatcttaaacttagagaacagtgcaagaatagaatagtataacttattttttcttagctatttgaaagttagttgccaacacaatggcccatcacctccaaattgtgtatttcttatgcacaatgacattgtcctacacctatgaaaaccaggaagttaacattgatacattactaccatccaatcctaggttcaccaatcattccaccatgatccttttcacagcaaaaggttccagttcagaatcaaggcttctgtttgcttgactttcatgagcttgacacttttgaagactagaggccagttattttgttgtataatgcgtctcagtttggggttgcttgatgtttcttcacgaatagattgaggttctgcatctttggcaggagcatcacagtcatgatgctgagttctcatatcctatcacgtggtacataacttcaatcagtcttattactgatgttattaattttgatcactaggttaaagtgttatctgtcagacttctccactgtgaagtttctcattttctctttgaattcctaagaatttgggagtggggagagttactctgagagaatgcatatatgacattcctcagcaaacttaggactttaagcactgaactcacaaattcctattttattcagtgagttataacctattactaccgttattttgatgctgaaattgccacagatttggctagcaggagcctcttcaagctgactcctatgtccttctgctatatcctcatctttggacatttccttactttatgaaacaagaagacatcccaggctcatcttctacttctctgtcccagccctggaatcagccattcttccaaagagcacctttaagtagcgaacagtatttagaagccaaagtcccagactaggtgtgcactaggtgttacagttcccaggtcctctcagtggacacagccgggaaatatacgtatgtggaacacacagacacaaagatctgcatctatgtttatttctacacagctctttctctctgtggaataccaagagttcacaccagtctctctaatgaacagagttttattccagttccttccctttccaaaacaaccagccgtgtctctgttgccctctcctgcccggctgccaggtttccacgtgaatgctctcactcccctgagttcagacactcagctttgagccaaagtggcttccctctctcccaggaccccacgctccacagtcaaggcactcaacttgctctgcctcatctcatgacttttgaactgagctttagagaaacagtaagaacaagacattatcaatttcatagatgagtctgaatattttaaatgtttgccatcatatttctgtaaaaattgtgcttcacgtgctttgtctatttacctatacacacctcattgattttaaactttttttctttgtttacagatggggtcttgctctgtcatttaggctggagtacagtggcaaaaatcacagctcactgcagcttcaaattccggggctcatgcaatcttcctgccacagcctcccaagtagctaggaccacaggtgtgcaccaccatgctggcttttttttttttttcctgtagagatggattttgctatttttcccagactggtctcaaactcctgtgctcaagcaatcctcctgccttggcctcccaaagcactgagattacaggcatgagccaccatgcccagcagatttcttcttgattagtttacgctgtatgtgtgttaaaggtatcaatgctttggcttaaatgttgcagataatttcttgatatcttatttggttcttgacttattttttttaatagaaaattgtattttgttgatttagaaagcctgaaccccttgctacttttctatttcctctgagccccatttttctctgagctttttgcatttctgaacttctccattactctccactccagtgattctcaatcagggctgattttgctcctccccctggaagtctggcaatgtttggagacatttctgagtctgaagactgggtaggaaagtatgattagcatctagtggcaaaggcctaggatactgctacacaccctacaatgcacaagacagcccccacgaccaaaggttatccagcccaaaatgtcactagtgtcaaacgctgctctggagtctctcaaacgctttacagctattcttttgatttcttccaaaacaagacattagaaaagaaaggctaaaagaggaatatttttcatgtaggcaatgactttttctaaatcctaggtctgagttacaaatactggtcatagaaccttatagaatccaaaagcattgtcaaaaagaccaaccaaaaaaaccctatctttgttatttccacaaaagatgatcgtagctgtgttcttgacataaagggactcacctaattcataaagttttaaatctgtgtttgtcatgtggtcaagaattcatatctagattacctaggtccatctgtgctatcttaaatgccaatgaaagaaaaatgtaattattaatttaattttttcaaatcctataaggccagtaccaaggtactaaatgtaaatatatacatacatatatataaatgtacatatataaaatacatagttttaaaaataaagaacagtattacaaataaaattgttgctttcttggaactcaggcctttgaaagaaaatacatatatagcagcatggcatgaagcaatttaacaagatatgtaagatatattagaaagaaaggagatttttctcttcacaaacacaatatatatcttcttggttatagacttgttacttgcctgccagaagagtttactatcatcttcacaagtattcaattctcagaaccaagggatttcacagcctcctctacccaatcaaagcagtgtcttatggggtccgtctgaacgtaatcctgtcctactgacggatttgacatctatttctgccaccattgcacaagaacacagcagactgctgactgcaataagacttatctagaggctaacaggcaagcaaaatctatactgatttccttttcttcagcacaataccttttaaaaagtaccataaataaaacagtgttctcaagacctgtgattttcaacgagaaattactaaacacattggggaggcttcttgtggtcttgatttcctaatgagctatgggaaattacataatgaagagaattcttcttggcttcttaggtttcaaaagcctacaaagtctgtaaattctgtttcctttccaacaaacactaaacctaacttggtattcgaaactttaacctctccatttcaaatgctttagttttggtcctgactcattacaagaaaggaggctgttagaatagcaaaataataattatgatgaaatcataacaataataacagtagctaacacttattgaactgagcgctatatgtcagatagtattctaaatgctctatcggtgtaaactcacatcattctatgataagctacaaagtagatactcatcataataatcagtcgcattttatagataagaaaactgaagcccaggagtgtgaataggtttttctaggttagaagcagaattgaagtcagaaagcctgactgtaaactcatggtcttaaccacttttctggctctctgattcccaccctctcaacttttaacgtgactgaatctgaaactcatcattcattatagcatcaaacctacatctccctcttcttaaggcctacctgcatgagcatgtacctgttcatacagctcccagaacaaacgtgtataggtttgtctaagtaaacagcaaatttgattgtaaacataaaaactaaagagaatatcattgctttgtaaaggtaacggtgaatgattctcaacgccaataccagaaacatgtgacaatcacaaggcagtcaccaatttaacagagagaaggaaagtatgaagtgtatctctcagtctctgatagaagttcctttcttcacctcgggtgaaggtcaggagttccacttctactgcccttgctgtcaccaaacagcaaagttcaaggaagacagaggagctttgaagccttctgacatgggtacagaattctactatgtctttttgtttgagtacaaaatatagctctagcctgaagaaagacttagagttaatcttcctgtggtacagatggtatattctgattcctgatcacccacactgcgccacagagcccctgacacagaattgtctgtagttaagtaatgggaggtgaggaagtggcctcagagaaggactaacgtccacagacttgagttcgtacaaccacaaaaatacctgcctggccaactagccacccagtctagcataaagattggtcatgcagatttgtggaaagaaagaggtccaggaaatgcttcttggaaggcagaacatttacttattcatcattatattattgatcagcctccctacaccctgattaattatcactccattgatgaaaagctatctcaattcaattctattgctttctcagcaatacaggcaaaaattttacatagcaagttttttgtttgtatatttttattcatttttcagcaaatcaaaacccattcaaatggaaaatggaaagatggaaaaatgaaactgtgcatttcaatgtgatattgagcataggatatcagcagctcacttcgtgggttctgtgttgcttcgacattctgtctgtgacctcttggaaggtttgactggtaggggcacagcacttcaaactgtgacataatcagcgtttcctctcctaggttaagagggacactgatcgctggaaacatgaacatccacagcaactaagagtgagcactgctgaacacagccacagactgtggtccttcgttaaacaaatgaaagtctaaatcaaatgacgagagaacgcaaattcatgatcattatgaagcaaatgcattgctgtacttaagacatcagtccctctacagagaggccatcacctctttgcacaagtcaatatgggcaaaaattgttttcaaaaaccaggttggttctcaaacattaaaatgcacatatcagagaaaaatgctctctcaagcatctctatacgaagatgttcattacagaaatgtttgttatggtggaaaatgagggccaatgtctatcaataggagattgagtatgagaactacagtgcacagcgagggggtaagaacgtgggttctggagccacgcagccttgctttaaatcctgactttgacacacactaacagtgcgacctgaggcaacttacataacctctgtaaatcttggtttcctcgtctgtatataaagagtttagtaaaacacttgacatatacgagctcaataaatgttagcaattattattatgctacattatgtatatggacattttaaaaagatagggctgtatctatcagcgtagaaagatggcctgtgtcattgttaagaaaatgtttccagcaaattgtagatgggtataactaatataactctgcatgtgcaaatattgtgtggatacacatggaaagtattctgggacacataccaaattgttacaataaatccctttcaaaaattaggagtggctgggaggagaaggctttcacttcgcactttccatggtgccagggtaataccacctcacaacagtaaatagcaaaaatagcaaccttaactctagattttcttatctaaattttaattctgtgaagaattttccatttccctttttcaaatcaggatataggatgcaatttagaaagagtgagatcacttgttagactgtacgatttttaagcatcaataaagtataccaccgaacttctctaccaatccattctctaaacttcccaatcaggtgtgcctctccatttaggacacaggcaggtttttgttccaactcacagtgtaactgccctggtttcagtatccacggtgaatgagaacagctaagagacacaagtgctgggaattaaagaagcatctacttaaaaaccaagctcttgctaatcagtgagaagagtctcaagagatgatatgctgaaggcaccgagggagagctgtgttggaatgtctgtctgtgcataactgtggtccttcaaaacgagcaattagaaaacagagatgagataatatagctagctctcgcagattaatcaaatgtgtcttgttactagattagagaattcaaagatatgacagagaatattaaatgtctgaaaatgaccaagtgtagctgcttgaatcatttcccccacagttttcagtagaaaagagttgttctttcccattttccaaaatcattactattttagcattgtcaaggaaaaaaaaaggacttatgttttgtacttttcacagtgtagaggatgatgctcagaataaattgtttcactttgggagttatatttactagaagaatgaagctcttgctttccactttaagacaaagagagggacatacaacaaaaaagacggcacgttcaggggctacaggggcgtgagttcaaatcctggatttccaatttccagctatgtatctttggtgagtcatttaacctcagaacccacttcacaggactattacaaaactgtgtgtgtgtgtgtgtgtgtgtgtgtgtgtgtgtgttactgaaaaatatcacccagtacttagtacacacctagtagttgttagctactatttcagagagacttctgtggatggcatatactgatgatttggttaaaaaaataaagaataaagacagttaattctttcaaaattattatatgactatcactgttaggtgggaggggataaaatgaggaactacagagatcactgaatttacagcaaatgtcctggccaggtaacctagaggtcaaattgagatgaaaatcaggttgcttctatcatagtccaatattttttcatactccatcagattctgctttctgcaatataatatggaagcgagaaaacaagaaatattccaggatacagtcacagatgtactatatagcttacattttatctttttcccaaaaaagaggaacctcattctgcctgaacaacaaaaggttaaagatgtattggtggacagcatctaggaagagagatacaggaagtggacagcatctaggaaggagatacaggaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagggagatccaggaagtggacagcatctaggaaggagatacaggaagtgggcagcatctaggaagagagatacagcaagtggacagcatctaggaagggagatacagcaagtggacagcatctaggaaggcagatacagcaagtggacagcatctaggaagggagatacagcaagtggacagcatctaggaagggagatacaggaagtggacagcatctaggaaggagatacaggaagtggacagcatctaggaagacagatacagcaagtggacagcatctaggaagggagatacagcaagtggacagcatctaggaagggagatacagcaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagagagatacagcaagtggacagcatctaggaagggagatacaggaagtggacagcatctaggaaggagatacaggaagtggacagcatctaggaagggagatacagcaagtggacagcatctaggaaggagatacaggaagtagacagcatctaggaagacagatacagcaagtgaacagcatctaggaagggagatacagcaagtggacagcatctaggaagggagatacagcaagtggacagcatctaggaagggagatacagcaagtggacagcatctaggaaggaagatacagcaaatctaattcagaagaaaagaaacagattgccctgaatatgacagtggccatcagaaagggagctgtaccctccacccaaatgtgtcccaaacacaaagacgtctcacatccctctaaaaaccgaaaagaggtaccagtactgtgacggtcattttctggaattcattaattgaatcatgaagagaattatgtaaggtcaaaacactcatacctcagaaaaagctgcgtcctatacactaggctagcccacaccaaccacaaagaaagcacagacagaaatttccaggacttggtgtctttgcaaagacagagactccagccataagcttagcaatgtaccctcttgatgaaggaagtgagcatgatctctccctttgtcatctgagtgatgtatgattaagctcaatagaggtatagattcagtgatgttactgagaggaagcaacagaattttcagtgacctaaggtgctatatgtgagagtcccaagtgttctaaagaaaaacctggcccagcacagtggctcatgcctgtaatcccagcaatttgggaggccgaggcaggtggattacctgaggccaggagtttaagaccagcctggccaatatggtaaaacactgtctctactaaaaatacaaaaattagacacacgtgctggtgggaagtcccagctacttgggaggctgaggcaagagaatcgcttgaacccaggaggtaggttgcagtgaaggcagagattgcagtgagccaagatcgtgccactgcactccagcccatgtgacagagtgagtgagacttcatcccccacccgccaaaaaaaagaaaagaaaatgaaaacccataccagaaaaaaagtttctctttcttcaaaaacagtccttcttttgaccttccctaggtcttgcagaagagagcataaagaagtcttagatcaaatactcatttatatcagtgacttctaagtaattacctgcatctataggatatacagagtttaatcacatacccttgaaagacgcactccactaaacaaaattataagtacacctcattgcgtgtactgagcttcactctgctgtgcttcatggatcttgtgtttactagatagaaggtttgtgaatcctttgttgaacaagtctattagcaccatttgtccaatagcatgtgtgcacttcatgtgtctgttgtcacattttggtaattctcacaataattcaaactttttcactgttctatctgtgatgcttatcagtgttctttgacattactactgtaattgttttggggcaccatgaacagtgcccatatgagacagttaacttaatccatgaatgtgtgcattctgacagcttcaccaacttcattcctgtctctctccctctcctcaggcctccatatccctgagacacaataatactgaaattagcccagttagtaaccttacaatggcctctaagtgttcacgtgaaaggaggagttgcacatctctcgctgtgattcaagagctagaaatgatgaagctcagtgaggaagacatgtcgagaactaagataaactgaaagacacatgtgttgcacaaaacagttagccaacttgtaaatgcaaaagaaacactcttgagggaaattaaaagtgctactccagtgaacacacaaataatcagaaagtgagacagccttattgctgatagggagaaagtctgagtgatctggacagaagatcaaataagccacaatattcccttaagccaaagcctaatccagaggaaagccctaacttgcttaaattctataaaggctgagagaggtgagaaacgacagaagaaacggtggaaagtagcagaggttggttcatgaggtttaaggaaagaagccatctccgtaacttaaaactgcaaggtgacgttgcagcaagttatcaagaagatctagctgagatgactgatgagggtggcaacaaggaaaagcagactttcagtgtagatgaaaccgccttatattgggatgagataccatctaagacttccataactagaggagaggtcaatgctttgcttcaaaacttcaaaagacagaatgactctcttgttagggtctaatgccagctggtgactttaagttgaagcaaatgttcatttaccatttaaaaaatcctacagcccttaagaactgtggtaaatctgtactgcccatgttctaccaatgtaataacaaagcctgggtgacagcatatctgtttttaagcatagtttactgaatatctgaagtccattcttgtgacctactgctcaggaataagattgctttgaaaacattactgttgattgacaacgcacctagtcatccaagagctccgatggagatgtacaagaagacgaatgctgttttcttgcctactaacacaaaatctagtcttcagcccatggatcaaggagtaattcaactttcaagtcttattatttaagaaatacattttgtaaggctatagctgccatcaatattgattcttctgatggatctggggacagtaaattgaaaaccttctggaaaggattcactattccagacaccattaggaacactcatacttcatagaaggagatcaaaatatcaacattaacaagagtttggaaggttgattccaatcctcatggatgactttgagggggtcaaatcttcagtgaagaaagtaatcagaaatgaaaaacaaggcattacaactgataccacagaaatacaaaggatcattagagactgttacgaacaacaatcttgacaatgctgacaaactgaaaaacctaaaggaaataaatcctagacatacacaacctaccaaaattgaattaggaagaaggagaaaacctgaaaaaatcaataatgagtagtggaagtcctagtcagagcaaccaggcaagagaaagaaacaaagggcatccaaattggaaaaaaggaagtcaaattgtccctctttgtgaatgacataatcctatatacagaaaaatctaaagactccaccaaaaaactctttgaactgataaatgaattcagtaaagttgcaagatacaaaatcaatatacaaaactatacatcaataacgaagtagtgaaaaaagaaattagaaaagcaattccacttacaacagctacaaaaacataaataaagtatctaacaataaatttattgaaggaggagagagaactctagaaggacaactatgaaacactgatggtagaaactgaagagaatacaaacaaatggagatgtcccatgcttataaattggaagaattaatattgttaagatgaccatgctacccaaagcaatctacagatgtaatgtaatacctgtcaaaataccaaaccacatgtttcacagaaatatttttttaaatcctaaaatttgtatggaaacacaaaagaccatgaatagccaaagcaataatgagcaaaaataacaaaacaggaagtatcacactacctgacttcaaaatatgctacaaagctataggaaccaaaaccatatggtactggtataaaaacaaacacacaaaccattagcatagaatagagaacctagagataaattcacatatttacagccaaccaattgtaaaatgtgtcaagaaaacagactgaggaaaagacaccctgttcaataaatggtgttgggaagattccatatccaaagcagaagagtgaaaggagaccattatcactgtatacaaaagtaaactcaaaatgaattaaagatttgaacataggacccaaaactataaaactactagaagaaaacacttcaggacattggtctaggcaaatattttatggctaagacctcaaaagtacagccaacaaaaatagacaaatggcactatattaaactaaaaggtttctgtacagcaaagaaaacaatcaagagactgaagagacaatctgtagcaataaatatttgcaaattacatgttcagcaaggaattaatatccaaaatataatccagttaaaaagtgggcaaatgatatgaatagaaatgtctcaaaagaaaatatgcaggccaggcacggtggctcatgcctgtaatcccagcaccttgggagacagaggcgggcagatcacctgaggtcaggagttcagaccagcctggccaaaatggtgaaaccccatctctactaaaaatacaaaaaattagccaggcgtggtgacacacgcctgtaatcccagctacccaggaggctgaagcaggagaattgcttgagcccgggagacagaggttgcagtgagccaagatcctaccactgcactccagcctggctgacagagtgagactctgtctcagaaaaaaaaaaaaaaaaagaaagaaaaagaaaaagaaaatatgcaaatggccagcaaatatatgaaaaaatgttcaacatcactaatcaccagggaaatacgaatcaaaaccacaatgaaatatcatcttaccacagttaggatggctgttatcaaaaaaagaaaagataacatgctggtgaaaatgcagagaaaagggaactcacacactgttggtgggaatgcaaataggtacagccactgtagaaaagagcacagcatttccacaaaaaaactaaaagagaactaccataggatccagcaatcccagcactgggtttcctttctttctttcttttttttttttttttttacaaaagaaaggaaatcaaagggatacgcacacccccaatgcgtattgcagcactattcacaatagctaagatactgaatcaacctaaatatccatcagtggatatttaactccataaaagacatacaagtaacaccactctactttcacgcatgaagcattaatggataaagaaaacatagatacagacatgatggagtactattcagccatagaaaagaatggaatcctgtcatttgcagcaacaggaatgagcccgaaggacattatgttaagtgaaatatgtcaagcacagaaaaacagatatcacatattctggctcttatgtgggagcaaaaaagatgttgttttgtgctcatcaaagtagaacttgtgggtattggaggctgggaaatggaagaatgggagggaggttgtttgatggatacaaaattacagttacatagagaggatggagtttgcgtgttctgcagcattgtacgctgaatatgctcaactgtattatatttttcaaaaagttagaggagagtattttttaatgttcacaacacaaataaatatttgaggtgatggtatagtgatcactctgatttgatcattacatattatatacacatatgaaaatatcactctgtatcccataaatgtgtacaattattatgtgtcaactaaaaaggaaaaaaggagttgcaccatcgccacacctgtcacatagatcataaatacaaacccgcacacaaattacgttatttactatgtatcattgatgtcagagccctaaaaagccttattaagcctcttgactacagttttcaaacttttttttgcagtggaacgcttacatcaaacaatgttacgtaaatcccaaaatagaatcccccagtaacagtgatctcatgaaatcaaggcaaggcatgtggacgtgtttagtgggggtgcacaagcatgcctgtgcttgtagggagaggacagggctgcttccccaaaacactgtttgaaaaaatcactgatgtattacaagcttcttattcccagacaaacttagtatggaatcacctgccaggtaaggaacttgcttatacataaagtgagggctatagactagaccttttatctgtatgtttctagcaatgttttatgacactattatacagggttttcataggaaatcacataaagaaaggaccattgatacgataatcattataataaatcatactaaatgatcttggtagcaaactagttgtcaagcaaagaaggattatgggtttattcagaccaacttctggaatcttatttaggtattaaatatatattaaatatcaaggtcagaaaccaaatgaagtattaactggcaaaatccattattacaatagaaataacattgatccctggaaataaaaattatttcagattaaaaagaagttatggggccaggcgcagtggctcacggctataatcccagcactctgggaggccgaggcaggcagatcacgaagtcaggagatcaaaaccatcctggctaacgtggtgaaaccccatctctactaaaaatataaaaaattagccaggcgtggtggcgggcgcctgtagtcccagctactcgggaggctgaggcaggagaatcgcttgaaccagggaggcggaggatgcagtgagcagagatcgcgccactgcactccagcctgggcgacagagcgagactttgtctcgaaaaaaaaaaaaaaagttagtgaagaagctgatttcaaagggttttactgctatgaagataaaattaggttggtttcattctagctttattgtagtctgcagagactaaattgaaatcagccattttaattcagaaacaatatttaggctgtagaaagcagagtgataaccaccctgcctttgtttaaaatctctgagacagaagggatatttcctgtagcagcataaattacagagactctaaagttacgttgaaacgacccttacaccctcgaagcaacgtgcaattttgtggctgtaattttctcaaactgcttaataaaaccttctcctttttatcagaaaaaaagaataaacaaaataccaagaactccataaaaggcatacaaggaacattactccactttcagccatgaagtattaataattaactgttgggcaggcaaactgagttagcagtcttttcccacaggacatcttcctgtcaaaatgtcacccagaaataaccctgtagattacaggaaggggctgcaattccccacagtgcatctcataaccataaatggcctcagagtttcagtacctgtcatgatcaggtcacctaacacctgggaatctctcactctccccctcctctacccacatatttgccgctaacacaccaataattgatagtatctgcatttctgagcattaccagccatgagctgcctgccctagcactgaaggagagacagatggcagccagacagaacgggatggagagctcatatccgagtcctggctctgcccttgattcactgagcaacaacctctcaccaaagatgggatcataaagctccattccctcgcattcaaatgctaggaatcctaatttgataatttctaccatgaactttggtgtcttctgtactcatatttgctttctgctcttttgaggaaaaaaatcagatacaatattgtgactatgaaatcatcttctcatttttagtgattcaaggtcaggtgaaaacagaaccgttagtttccattccaaacactgatacatgtaaaaggttatatactttagcagagtcctcactggaaaagatgtagatttggagagttcaggcagacatgggttcaagtactggctccactacttaactagttatgtaattttgggtatgtgaactaactactctaggctttaatttcctcaaatgtatataataagaatgataatcatgaatgctttagggatcgctgcaagttgcaagctaaacctgctaaatatgcaactagcatacaaccgagcaatttgcattcctgagcatttatcccaaagacatgaaaaaccatgttcccataaaaccagtgcatgaatgtttacagcaactttatttatagtaataaaaaactggaagcaacacagatgtccttcaaagggtgaaaggttaaactgtggtccatccacaccatggaatactaattggtaataaaaaaaaaactagggataagggcaacaacctggataaatctctggagagttattatcctaagtgaaaaaaaaacccagaaggttacacactgcattttctatttatacaactttcttgaaatggcaacattagagaaatggagtacagattagtagctctacaggttaaagagcggttgggatgtaaggaaagtgaatgtatctataaaagggcaacgtgaggaattcttgtggtgatagaaatgccctgtttcttgaccatatcaaatgtcaaaacatcaatgttctggccgggtgctggctcacacctgtaatcccagcactttgggaggccgaggcaggcggatcacgtgaggtcaggagttcaagaccagcctggccaaccatggtgaaaccccatctccattaaaaatacaaaaattagccaggcgtggtggcgcgtgcctgtaatctcacctactcgtgaggctgaggcacgagaatcgcttgaacccaggaggtggaagttgcagtgagccaagatcacgctaccgcactccagcctgggcaacagagtgagactctgcctcaaaaaaattaattaattaattaaaaaataaattaaaaatttttttaaatgtcagtgttctggttgtgatagttttacagttttgcaagatgttgccatctgaggaaactagataaaggttacaaagtcctctctgtgttctatcttacaactgtatatgaatctataattatctcaaaaataaaaggtttacttcaaagaaattaaaataatcatatttcagaatatcactgcaaagattaaatatatagaattgagcaataatttaaaaattattacgtatatgaaaaattgcctagcacagacagttcttggcaataacagaagctcattaaatgttaatttctttcctctaagaagttgtacatagacagaatgcatcctagtagatttttatttgtggatcaaatgaagacgtaactccatgaaagggtctgatcataacatacacactttttggaacatttagcctttttttccctatgaatctgaactttgaggaagtattatttcacgctaaataacattcatccacattcctacagcaaaactgtacaactcaggtgccaactaatttcttccatcaaaaaatatgaccagtggagcaggttgtaggggattatgatccagttggttaagagtcacagtcaaaaaagatgaatcaaggccaaaaattaattggcatgctcttttacagacaatgaagaaagaacatgaaaagaataaagcttggtttcatgtgctcaagagttcacagctagttaagacaggaaaagtctcatatatgaagactcagagaacaagtggagaacagaccatcagtgcaaaaaatctgcagaagaggtggaggtgagcatggctgggggcaaatgagtgcagaagagggaggtgagaggtgagcaaggctggggcaaataagggaattgggggctgctggctccacacagcactgtcggactgcgtgaagaactgatggcagacgcacgaccttggccttctggaggaccgcggcaatccttagtactttgccgacgctgcaatgtaatcccacctttcccagagttctccatcccctgctgccagatccctgccgcacaaattcgcttgtatgaagctcctggctactttataagtatactttataagagaaaatacagacacacagacaccttcctcccccaatatatgcagacagtatgaagcgtcatagtgttccggcctcaaaaataaaattaggaggaaagcctgtggcacagcaaacgtctccccagcctcccacctgaccctacccttccaggtcactgcctcaggagataaaatcacccaggaggccctgtttaaactcaattctaagttaaggcctgaaaggatccatacactgtccaactctttttcatgccaaaattaatatagtaaacatatctttgtttcagcaatcaaaacctggcaatttgccatgtcaacccccattccacagccacgtgtctgaagaacatatgctttcagaatggcgtttatgatctcaatgccatcttgctgcaagccttccagctaggatgttccctgtagttgaaataaacggaaaggaagtttctgagttgaagtaaaccgaaaggaaggagggtcacagccccgcggcacagttcccaggatgactgctgtgccactcacaaaatgagccttttgactgactccagcagcaggacgggactgtcgtttcacgaggtgagctacgggcagacagatgtatccgaatcgcattaattggaacatcttgtcacaggataagagaatttccatttctctgcggatgcctgtatgctacacatggtatctggcaggtgtgagaacctcgtctttgattgcctatattcccaatctcctttctttgcctattttcctgctgcaaagcaattacggctgaaaatcagtctgcaacatgcgctcatccatattcaactctttccacttcaggcaaatcttgcccagaaaaaaaataataaaagagagagacttataaatccagatttgtcttttattttgatcctctgattgtccaggtgtttacttgttgataatccaccattttctccacatcaaaataaatattctaaagatgcagctctaaacaactaaagcatgtacctgtcttaagtgacaaggagggatgacacacctacaaaactttcaataaatcgaaccaacagatgggagcagccagaaccagttgaaagtgcaaatgacggagcatttaaaaaatatacagtgtcattgattttaagtatgttgaagaaaaaaatttaagaaacagtacctgggacttataccaacaggccaaggttaaaattgggttgaagaggagacagggcttcctcctggaagtccttcaagttatcatttcacattggatttgccaatcagcttttcagatcttatctgataattattgaaagccacaggcagggactagaattttgagatgtttctcaaattttcagatgaaagctgtttacctggcccttaaggagattttaaacttattttaatcagtattcaaaagacacaacaggatgaccatccccccatccacccccgcagtctccttctccagaggcatccaatttcatcatttcttgggatgttattttatacatacacaagaacatgctttatatcttccttttcttcattttttacacaaataaccataaactacacatcctattttattttctctgtactcttctttctctcttttttttttttttgttttgttttgtttttttgagacggagtctcgctttgttgcccaggctggagtgcagtggtgcgatctcggctcactgcaagctccacctcccgggtttacgccattctcctgcctcagcctcctgagtagctgggactacaggcgcctgccactaagcccggctaatttttttttttttttttgtacttttagtagagatggggtttcaccatcttagccaggatggtctcaatctcctgacctcgtgatccgcccgcctcggcctcccaaagtgctgggattataggcatgagccaccacgcctcgccttttattttattatcatcatttagttatgaaagccaaagctgagacaaattctctgtactcttaatggcataactgagcgttgatttcatatgaggacacaaagagcttcctcatcgttttttatggcttcagagaattcccttgaatggatgtagcataatttatataaccagttccctacagatagacatttaggttatctccattgtattcctattacaaacaaggttgcaataaataaccttacacataggtcatttcatgtattagctaaagtatcatgtattagctaaattcctataaatgtaattgctgagtcaaaggatatatgaatttataattttgaaagatattaccttcatatatacatatctgtatctatatagtacctgtttccctatacccttgccaatacaaggtgttaacattctgctgtttgccaatctgataggttaaaagtgacatttcagtatcatattcatttgcactgctcttattatgaatgagctgaggagcttttcatctgtgtcataggaagctcacccctgaggacagcatcacctggactccctcctctgataacttctgggaggcactagcaggaggttagcaggtggaaggagagatatctttcccatttccatcctgcttcaaggacatatttctcacagtggctacatcctccatgatcacagccttcttcggatgacccatctttcctgctccggcaatgccgttctctctctttgtccctgccttcaatcccagggatagtaatagcttcccacatttgcaggtctccgagcgtcacaatgtcattccctttttgtccccaaaatcctgccctcacctctgtaagttgccccatttggggagaagaagcatttgtggagaaacctgtttgctattgctttgttttcctgagacactaacaaacatatctcctgcctatttttctactggtttgttggtcttttcatattgatttgtagttgtagcaactccttattcatcagagcaagagttggcaaacttttctgtgaagtgccagataataaatactgttggttttgtggaccataaggtccctgttgcagctattcaattctgccaccatagggtgaaagcagccacaaacaatatgcaaacaaatgagtgtggctgtgttctaataaaacttgattgataaaaacaggcagcaggccagatatgggccttgggctgtagttcccaaccccagcattagggaaattatcttttctctgagatataagctgcaactatttttctcccagtttagttttttacttgtcttatagtggctttgccatgcagagttttaaagatctcttattttacgtagtggaatttatccgtaatttatggcttctagtttttatgtcagagggaaagcaaagagttagtaaaaccacaggaaactcaaagaggaaagactgtaccttaagctagtcagaccatgctaccaccaagagtcttcttaatgagacaactactcatccttctaagacagaattatcaaaaactctttcttaaaaagcaaacgaacaaatgaaaactttcgacggaaggctgagacacaaaatggagcgagcatcctggtgggagccaggacgtacctatccacatgtgcctcgggtaactctcaggccactgtattctagacgttaaaaaacacttctcgacacaaatacgaatcctatcaaaagaaaattagaaaagtgttttctaggtgatcgctgtataaaaatttcacaaatcacccattctatcaggctttgcctagctccaacatctttccgacatcagtgacatgggggcatctgttagagttcttacaactaggggatctctcgggatttccacttcatactcattcttctgttcctgcatgactgtgctccagggtctaaaggctcctagccttagtttgtaatgaatttagtttttgcattctataaatttaaaacaaatatctttgtggaaattttgtaagtagaaacagggaaagtaaaatgttgccaattaaaatacatgttatttgcataaaataggcaagactttcaggaaaaaaacactggggaaaggatgggaaaaagaacaaacaaataaacaaaaattggccgttcaagtctctaccagagtttaatattttaaagtcacaatttcctttccttgttttctcctaccatggagaagcagacacagttataagtgaaggaacaaaacatagaccgtggaaatttggaggtttcagcatggatttgcatcctaaaaaatacaaatagcaatgtgtaataacaatttaaaatctctcttgttgaattacaaaaattatcctggcaattgtagtcggttgctctgtcctgaccaaaacaaagttattcatatttatatgccctcatccccatatacatgcatattgagatgtatattttatttatatgttcatctagatgtaaacataggtatatgcagatatgcacccaccacacttcactatactgtctacaacatgcatattagaaaatgtgtatttaccgaaaccaacatataaaaccaaagtggcaaaggctttggggaataagaaagacacagctctgtaataagtctaacacctgtgaatgatctgtagcagccttcgaaatgtgggattgctgtatccctcaaactgatactacaaactgagatttcatgtctccatttacacaaattgattccataaattctactaagcgccaatgggtaagactcacagcatgtgagatcaaaagagtaggagtaactggcgacagtttagttgagccacaagatgacaaacatcagtcacagggtagtaaggaggggagaatcatccagagaaaagccgtggagaggcgttttctcaattgattaggtcatgctgtaatggagccaagggcgcaggttcagtactctctgccaatgacctatattgtatttcaaagacacagaccaggcccaatagttctcaacatcttgccactagatcaaaagggatatgagaagaagagtggctaagcccaagcttatttcaagtactagaaaagtaacaacattaacgcagcattgattagtaccattgtcttagcgtaagttacagttaacgtccgacatgatctgtgatgtaatagaattaagtaagacatttctcccggctagtattaaactgtatttattcagtcaaccttacaagatcctatcatgaaacagaaatagcattcacttttcaaatagctgtattctaacacgtggtttgcaattaatattgggctgttttggatatttcctgtattacatatacaaccgggatattaataacaacaaagatgaaaacagaagaggatttatgtagctccggaggggttcaataagtaggaacatgacccggattcaagcttcctggcacagacaccccaccatcacagcttattcagaaattaaatacttgtgcttcgccaccacaaacgcaagtgctgccgcttatcttttttctcacgaaaatgtgaccttgggctcagaatggtgctgacccaacgtctcacttctcttagaagaagtatctcaatgaagctgatgctgccgtctgagcactgctttctcgtaggaatttgccaaattaacccaaaatgcagccagccaccaaacagagaaacaatttaagtttagccacgtggggataaatccttctggatgtcaaggtcctcagctggggcttatattaaaccagtagttaccgactccattccccagaacaaaatgactcatggggctcccgtatctcctttcatttgaaaaggtgctgaggtggtaaaatattctgaaaactcctgtagtcattgattcctcagttcttatagagcgctagaattttgtggtctacatgtcactgattgtaacacatcttaatatttgctgcttagaaatatgtttgaaaatcatgtaaaatatcgcacaaatagcaaataactagaagatagatggttgtgtctttttccctctctgatatatataaattctccaagaaccacatggtagaaaaaagacagatatatagtcacgcactgcataatgacatttcagtcaaggacagaacacacatacaatggtggtcccataagattataatactgtatttttactattccttttctatgtttagatacacaaatacttaaccttgtgttaaaattgcctcagcattcagtacagtaacatgctgttcgggtttatagcccaggagcaagagacgatacttcacagcccaggtgtatagtgggctataccatccaggtctgtgtaggtacctctatgatgtttgctcagctatgaagttgcctgaagatgcacttcccagaaaatattcccacccttaagcaacacacgctggacccaccatcctgagggtggaaagaagctctttagagtccccacagagtgaaatgacttcatgtttctcactctctctcctcagtgcggacttcaaaataaaaatactaatcatcaaaagacaaaattctgcatatgctgaaacctacataacagcattctgaagtttctaatagtaagtttcttattagcttgtcccaagttaaacttcttttgtgaaaggaaagtctctgtgtgtgtgtgcctgggcatgtatcccagtgttgccagggccctacgtcgtatgcacacgataagtccaagacctgtagtgggtaaactcagcaatgttcatactctctaagtaggtaacgctaaaggaagagagagaaaaacattcatagcctgagtgatcacataaactgggtatatcagaaaaatcatgacttctggttctggaagagaattggagggggtataacctctcttccaatggacggactcagagttatacctagctcaatctagatggtatgtaatctttattgggaaaaaaaaaaagggtgactaaatacatacgctttaatcataatttgtattcctagatgaaactaccaataaaaattgctacctgcgtatttcctgggcccttatgaggtacactctgaaacactttttctaacactctccaccacaaaattggttttattgctttcatttcatagttgagaaaatgatggattcaaaaagattaagcaatttgttcaaggtcttatgactgataagtcacattttgaggatgggaccccaagtccatttgatttgaatgcccataatcctctaactgcagaaagcttcaagttttctgtgtgttctggaaggcacagctacaaagaaaagctaatatttccctctaaattctacctttatatagctcatcatttgaatttataacactctccagcagtaacaaatacttacgtttctctggattcacagatatatactaaatattttaagaatggagagaaactaagattggaaacaaattaatatgacaggaaaaaaactgtggaggaaaatccatgggaacgtataagaatataactgtaattcaagagccacatactcagggtttgtaaaaattcctaactgcagattaagcagtgaggagctcagcaccttccacaggttcacactccaagccacggagcactcagtggcaccggtctgctctttgggaacaccgttcaattacctctctccatgtaaggacttcgcattattagtgaaccgattctaacacaggaacctcctatgatgtcttaagttcagaatatttctccctgatcaccccagaagaaatcagagctgcgttaatcaatcattctcttacacggtttcctttgtatagaaccactttgcaccctttttggtaagttacctccttcttaatcttcaggactaagctcaacacacacttcaaagcctttctgaacccattctagtatggctgccctgttttgtcttcccccaaccccagaaaccctgtatttaccttcaacaaagctttgaccacacattctctgctatgttttttactggagattaattttttactcattttgttgaggctatttccaggggctctgaatagtggctactcttaataaatacgtaaatatactcttagggataaatgaaaaatcaaatggtccgagtggcctaacacaatttccagaacacactgggaaatgtttgtctcttttttcagccattgtcactacttctttatccccacctctatctacacataaataaacacatgccaacacctgcacttaagtatgcacatgtacacatatacacagcatcgattactccatggattaactctgcttcatctactacctttcatgtaaaaacaagacaaaggaagaaatttaagaatttatgatattcacacaaaatcacataatctaccaaagtctcctcatgcattgcctttattcagactaatatttactgagcacacagtactatgtaaagcagtagaagccaatcaattaaaatgctcatatgttctgaacataaaatgcttcaacacccactacagacattcagaaagatccaaaaaagcaaaattaagtcctgcccatattgaaactatatcttgagatagaaccaacacaaccaaaacaaggtgactattttaagatgaggaatggctgggaacacaggaaataacccaatgggacatgagtgtggctctcagcctttggacagatcatgtgacaacaaataaacacacacgttctcctgcagggcataggtttctggtgaagaatcagtggtgacttggagcaagacaccagatgataatttgataaatgctgtttacctttaaaatgtgattaaacagcatttatgatgaacatgctcagccaatgatgaataatatgtgcagtcaagcacaacagaaagtaattgtctgaggaggtagttcttccctggcagcttcccaaagctctcacagcgtgccttccccttcctcccaaacactggagttggagttagagccctgccagaggagaaaacctggctacagagagtggactggataatgactcgcaccaacagtttcggggatctccaggtacagggaagcctgttcgcacattcacctttaggaatattcaggactcgctctacctgctgcagtgtccgcacgtggttcctggtgtggtttatttttctctcacacctcagtgaggttctttcacagcctctttagtctaagatttcaatttttaaaacggagagagatcattccacaaaatattatatattccagttttcttctaattcaacagttctacgaataaagaccaacttgaactgattcacagtgcatttttataaattaagaggagtttctgtgcaaaaaaaaattcattacctcaatttagttctcagtgcaaattataatgattcctggttcaatttatagaaaatagtttaaacaactccatgtccatacacaccaaaataacatgttctgggtaagatacacaggtgttcatacagtaaacatgagaactccatgtcaaatggagatatcgcatgatgtctattttaccttcagagaaatgtgcacaaactgggtaatgatgatgccagtacaagaacttgcaaataaatgggttgtttgggcaagaaattttgtaggtacgtaaaaccagaactaatttatagatcagtcaggctccgtctcatgcttggcagagaggctagaggtcactggtcactgaggaaaaaaatgcttacaaactgatttccagcccagttagcaattttaccagaactctttattctatcaaggctgcagaagagaggtaatgaggtcccatatgtacaggtgtgcaacaaattaggtcaataaatatgtctgttaaaaatacttaaataggaaaggtaaaaattacttaaacatgataagaaccattcagcaaaattcaatagcagacttaatgctcagtggtgaagtgttaaagccatttttattaaaatgacaaactggactaggataaccattattgactctttataaaatattgctttgagagtataaaatacctaggaatccaacttacaagggatgtgaaggacctcttcaaggagaactacaaaccactgctcaacgaaataaaagaggacacaaacaaatggaagagcattccatgctcatggataggaagactcaatattgtgaaaacggacatactgcccaaggtaatttatacattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcatgctacctgacttcaaactatattataaggctatagtaaacaaaacagcatggtactggtaccaaaacagagagatagaccaatggaacagaacagagccctcagaaataatgctgcatatctacaactatctcatctttgacaaacctcacaaaaagaagaaatggggaaaggattccctatttaataaatggtgctgggaaaactggctagccatatgtagaaagctgaaactggatcccttccttacactttatacaaaaattaattcaagatggattaaagacttacatgtcagacctaaaaccataaaaaccctagaagaaaacccaggcaataccattcaggacataggcatgggcaagacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttataatctacccatttgacaaagggctaatatccagaaactatgaagaacttaaatttacaagaaaaaaatcaaccccatcaaaaagtgggcaaaggatatgaacagacacttctcaaaagaagacatttatgcagccaacagacacatgaaaaaatgctcatcaccactggccatcagagaactgcaaatcaaaaccacaatgagataccatctcacaccagttagaatggcgatcattaaaaagtcaggaaacaacaggtgctggagaggatgtggagaaataggaacacttttacattgttggtgggactgtaaactagttcaaccattgcggaagacagtgtggcaattcctcagggatctagaactagaaataccatatgacccagcaatcccattactgggtatatacccaaaggattataaatcatgctgctataaagacacatgcatacgtatgtttattgcggcactattcacaatagcaaagacttggaaccaacccaaatgtccatcaatgatagactagattaagaaaatgtggcacatatacaccatggaatactatgcagccataaaaaaggatgagttcatgtcctttgtagggacatggatgaagctggaaaccatcattctcagcaaactatcgcaaggacagaaaatcaaacacagcatgttctcactcataggtgggaattgaacaatgagaacacttggacacaggaaggggaacatcacacaccggggcctgtcatggggcggtgggagtggggagggatagcattaggagatatatctaatgtgaatgatgagttaatgggtgcagcacaccaacatggcacatgtatacatatgtaacaaacctgcacgttgtgtgcaggtaccttagaacttaaaatgcaataaaatatatatatataaaatatatatattttatatatttttttaatatatatattttgctgatgtaagaagaaattttatatacatatatgtagcaggtgatctttatttacagataagattacataatttgaaaatccaactttaataaaaaatccaactctaataagagaatgtacttagatacaaagatgtaagacaaatatacaaagaaatcattagttttctctgtaccagagataaacagctagaaaatcaaatgaaaaatattttataaaaagtagcaacttatatcaaatgccacacagtataaatttaacaacaaaatatatataaactctatataacaaacagaaaatattattgaaagatataaaataccatatgaacaaaaagataaacatatgttcctgaagaggaggttactttcttaaaatgtcatgctttctaaacttaatacatacatttaattccatatattccaattagaatccagtggtattttttcttctccaacttggtaaagtaagtttaaagctcatttgcaataatgtccatacagaacagtaaagaaaagtgtgcaaaagaatagtgggagtggaattgtcttgccagataccaaacttactacaaaccatggggaaaaagaaaagaaaagagaatgattctagaacagggacagaaaagttgaacaattaaccagatagcacagaaaaaagccaagtgttatgataactttaagccaagtgttaaatcactcaattgtgacttttcaattgagtggggaaaagaaccatttgtataataaaaaggcattagcatatgtgcatctccacctgtggaaaaaagaaagctggattgtattacctcaaagcatacacaaaagaatttctagatagactaaatatctcaatcttaaaaattattcaccagcctgggcacagtggctcatgcctgtaatcccagcattttgggaggctgagggagtagatcatttgagcctatgagttcaagaccatcctgggcaacatgatgaaactacatctctacaaaaaacacaaaaaaatcagccaggcatggtggtgtgtgcctataatcctaactactcagaaggctgagacaggaggatcgcctgagtcaagggaggtcaaggctacagtgagccatgatcctaccactgtactccagcctggcaacagagtgagaccctgtagcagaaggaaaaaaaaaaaaatgtgaaaataattatatagctttgatataagcaaagatacccacgacaggaaacccacagggcattttttaaaaaaacctacatagtcatattccagtgtaaaaaatgtaaaatttgttagtaactgaagtcaagagacaagtgacatcctagcgaaaatatccgtaaaatgttgaacaaagtgttgatgtcacaaagaacacctataaatcgataaggaaaagaccaaaaattcaccatgaaaatgaaaaaatgaatagtacacgtgaatcacaaaaaaggaattgcaaataaccagtatataaaatggtcttcaacctcaagaacatgcaaactcacgttagttaacactatttacccagtagattggaaaaatatttcatttcaagcatttcactggtaaaatacattgtgggtgaaattataatccattacaaacaatatttcttggggaaatttggcaacaccttctagaatataaaattcacgtggccttgaagaaaagaaaattctactttgaagagccttttcagtcaaaataaaagggccagtgtgcaaagctgtatgcactagaatgtctatcgcatattttagtgacaaaaaagtaaaaatactgggtccattaatggggcatgactgaatatatcacattacagccatttctacggaacataatgcacacattatgcaaaaaaactgtattttgctgcagtgagatgtaatatagtatacagtagtaagggctctagaggatggaagcccgacagcccattccaagtctgggcttcaccacttcctaaccttgtgaacttcagcagcctccttaagttctctggacccgtttcctcatcagcaaacagggagaatgatagcaacttcacaaggttattgtaaggctcaaatgagataaagtatttaaagcaaaaaaaaaaaagtgttcttaaaatcaatttcaagaaaattaagtcacaaagtaatgtctgttgtgggattccttttttgtcaagataacagatcttatctcacttaccattgcctgaacaaaccaggacattgtccatctgggatggtttttgtccaaacaggaggcgatagttattaattaaggaagcgagactgggtttggactgtggcatacgacgagaggatttggctagttcttagtaaaaggagaccatagcaggcatgcagcattatgtacagatgccctaagagactgagaaacaaggaaaatggggttggaggcattttgaggggaggagcaagtgtgagcatgagcccaaccctgagatccttcaagagcccagttctagttgcaggccacaagtatcctgacaataaacgactctgtgcttcttagactctgcaaggggaagacttatcaaagccacctcacaaaaaacagagtcgttaaatatatactatgtgttttttttgtttgtttgtttgtttgttttgagatggagtctcgctctgtcgcccaggctggagtgcaggggtgcaacctcagctcactgcaagctctgcctcccgggttcacgccattctcctgcctcagcctccccagtagctaggactacaggcgcccgccaccacgcctggctaatttttttttttttttgtatttttagtagagacggggtttcaccgtgttagccaggatgatctcgatctcctgacctcgtgatccgcccatctcggcctcccaaagtgctgggattacaggcgtgagccaccgcgtccggcccatactatgtgttttaaacacaaaaaacacagtatgtatttaacagacgtcaactgcgctgtgccagttcagctaggctaggcttctgcctgtaactgaaaaacaaactagcatttcaagtaaaatgagtaaaaaatataaaaacacattgtaaattatcattttctaatacttaagtcagcttatgagattcctcccacacctactcagtggctcacaaaccctcggaaggaagaagcactgcataacccatctcaatgtttcagtcattacttaccacttcaatagcccactaataaacagtggtttccaccaagataaaatatacaaatttttcaatagacgtagtaaatactgaacaaaagtaaacagaagttgactataatatcaaaaagcagtaccatttagtattagtctgaaagcaactagtgaacgcattaatataaccaacaaacaacctttcacgaaatacttagagattagggccataaactacaagctagtgttcttttcactttgaaatgaaagatcagaggttccatataggccttaattagactcatagtctagaatttttctttctttctctaattaagaggatcacgcaaaaacactgaagtagtagtgccaagatgattccagccaggtagcccagtgcaacacacacaaaaatagttcacagagataatgttacccaattatgaattcagagagactcaatgtacaacatatttcttaagacacagctacaagacagagagtagggcatcatccataaaaggttgggcaaaagatgagggcctcaaagccaggccaaactgggtggtttttcacctagaataatataaggtagtctgcctagaggaacaatctctatcactgttgaggaagaaagccaaggtatataaatgaagaagaggttctaagtgtcaggtccaacgtaaatggtgaggtcataaaaagcaaaaggaatttctaggccagacatgatgaagatgagaaattaaggggtatgaagataacaaattgggtctttgtaagcaggttagaactaaaatggtgaacgctgagactgccggaagatttttgttgtgttgtaccagttggatagtgtgtttgtttgattatgcaggtgcacacatgtatataaacaagctgggaggtagcgagctcctcccaagaggaggtgtaagtttcatggcttaaaggagtcaggcaaaaccaatgttccacctaatattaactatcaaattatattttaatattgtcccttactgaataacaattcaggattgcttgggaccaatagtaaactgattgaaaaaattatccaaatggggataagctatgaatgttactaggatcatatgatgagaggtaaaaggatgggcaaattcaaggctacagacacaacttgattcagaaaatatgaaattacgaagaggaagacataccaagtactattctttggaaagatgagatgtttgttaagcagagcttaatattaacttctttttttttcttactcctttttttttttttttgagacaaggtcccactctgccacccaggctggagtataatggcgcagtcacagttcactgcagcctccacctcccaggctcatcacctcaacctcctgagtagctgggaccacaggtgtctcccactatacccagctaatttttatatgttttgcagagacagggtttcaccacattgcacaggatggtctcgaactcctgagctcaagcaatccacaagcctctgcttctgaaagtgctgggattatagacatgagccacctcacccagccaatattaacttattttttaatataacagactagggagtaacacagaagttggtcctcatatctaaaacagagtaaaaatactcttgactatttacattcaaataatgtaactaagactaacatgagtcactttccgttttccaatcaatttatagattaaatgcttatacctgacaccagaaaaaaatagcaattaaactgtaggccataaaattaatttcttctgcagtacaaaaaaaaaaaagaaaaatgtaatttcatttctttttgacctagattatgccaattgcattagatgttttatttcccatatgtatcagaatgttcaaatagtatataggctactaaaaagaatcattcccaaatggtactctccccaaacaacaaacttctcttattaatcatgctgaaactgtatgcttacaaaaaaagtgagcaaaattggaagcaagagccttccaaaattaaatgaccaactaaatcagataggcagatttgaatgttttttaatcaggcactgctggcatgatcacaacatttaaaatacccaaatgattctacataaatctaactcatcatctttcttacaaaaagtccagagctctaatgaagtccataatgatctggataaaatacacttaattagattataaactgcaacataaaacggctgcatcatgccttttaacatttttctctctgaagatcagaggattgaaagggggttataaaacagcccattcatttttcttgtcttttaaaggaaggaaaaaaccattaggcagaactaaagttccagacaacttttaacaagtgacatccaagtaggtcacattcttagacctcctcagagatgcagggaacgatgatggggtcaggtgaccaacacatcaatgggacggcatgtgatcagacaactctggggaatgctaatgatttcctatgtgatgctgatagtacaagatgtactttatgcttgatgatatctagatgagatagataacaggaaaaaaaaaccaaggctaattaaaatgcatttcaaagataatcctaacatgattttctaatagtacgcaagtccactgtgagtttgagatggtgaattaaagacgaatctattcatccacagatacatctatccactcatacaatttatgtgtttatttttggttgagggagacaggaggtgagaaacaagcatgcaacaattgctaaaaatgtctttaaatatttatctacagaattctcaaatgtgttatcttgactactagagactaagagcatggcctttggagtgaccagatctcctttgaatcccagttccaacatttgttggctctgtaacgctcaggtgcagttatgacatctgaacacagtgagaacaatccatgttcaggaagtaattatgggagattaagtgtaaggcactttgtactttgcctgtcctagaataggtgttgcatacattaaatcacaatcaaaacagacaagcacatttgggataaactaaataagatctctaaataaatgaaagggccagcctcagtggctcacgcctataatcccagtactttgtgaggctgaggcaggaagatcgcttgataccaggagttgaagaccagtctgggcaacatggcaagactccatctctaaaaaataaaaataataataataattagccaggcacggtggtatgcacctatagtcccagctactggggaggctgagatgggaggatcgcttgagccctggaggtcaaagtgagaccctgtcttaaaaaaaatttttttaaaaaaagggacataccatgttcacgattcaatattaagatgtcaaatctcccctaagtgatctacatttcacaccatttcaatcaaaatagcaggctttttaaaaagctaacaagctgattaaaaaatgtttatgaaaaggcaagtgaaaatagccaaatcaattttaaagagagaaaaaaaaaagttagagggcatacactacctgatttcaagatttactaaaaagctatactaatcagaatggtgtggtactgaagaaaggatagaatagtgagtccagaaacaggcctacacaaacatgggcaattgatctccaacaaagatgaaaaggcaatttaatggagaaaggaaagtctcttcaaaaaaatgatgcaggaacaactgtatatttgtgtggagaatcaagaaaacccttatgccataacatattcaaaagttaattaaaaatggattatagttgggcatggtggcaaatgcctgtattcctgctactcgagaggctgagacaagaggatcgctttagcctgggagttggaatccagcctgcataatgtagtgagacccgatctctatggaaaaaaaaaaaagattataaattgaaatgtaaatgctaaaacagaaaactcctagaaaatatttgtgactttccctaagaaaatatttcttaaataaaagaagaaaacacaaactataaaagtaaaaattgatcaaatgaactttattaaaattaaaaacttcggctcttcaaaagatgccattaagaaaacaaaaagacaagtcacaagtaaggagataatatttgcaatgcatatctgacccaggacttgtatccatgtcatataaagaactcttacaactcaacaacatgaaaacaacccaaaataatataggcaaaagattgaacaaatacttctcaaaagaaaagatacaaatggcaaaaaagcacttaaaaagataagcagtagcattaactaattagaaatgggaattaaaaccacactggactgccaccgagcacgtattagaatggctgaaattaaaaagactgacactaccaggtcttggtgatgatgcagagcaactggaactctcatatactactggggggaacacgaaaagtcacgactacttcagaaagcagtcttgtagttttttataaagttagatataatactaaccatataacgtagccactgtgaccacagatattttcctaagagaaaacgtatgtcatacaaagatttgtacatgaatgttcacagtgaatgtccatcaggaggttaatggataaataaaatgtggtatgtctacacaacacaacactattcataaacagaaaggaatgaattactgataggtccaataatatgaatacatctcaacaccattatgctaagcgaaaacagttggatgtaagggtacatactgatttcactttatgtaaaatgcaagttgatgtacagtgacaaaaaggagatcactaatcagctggggctgggggtgggtgagggatagactgaaaaagggtacaggtacaaagaagatatatagatggccatttttatgcacataaaaagatacttaacattagtaatcattaggaaaatgcaaattcaaaaccatgataaaataccaccttaacactcattaggatgactataaaaaaaaaaaaaaaaaaaaggccaggtgcggcggctcacgcctgtaatcccagcactttgggaggccgaggcgggcggatcacgaggtcaggagatcgtgaccatcctggctaacatggtgaaatcccgtctctactaaaaatacaaaaaaattagccgggcgtggtggtgggcacctgtagtcccagctactcagtaggctgaggcaggagaatggagtgaacccgggtggcagagcttgcagtgagccgagatggtgccactgcactccagcctgggtgacagagcaagactctgtctcagaaaaaaacaaaaaaaaaaacaaatgttggcaaggatgtagagaaactggaagccttgtgcgttactggtaggaatgcaaaacggtgcagctattgtggaaaacagtctggcagttccttaaaagactaaacacgagctgggtgcagtgatacatctgcagccccaggtactcctactctgcaggctgaggcaggagactcatttgagaccaggagttcaaagccagcctaggcaacatagcaagacctagtctttaaaaataaaagaagacaagaaaaaattttaaaaaataattactatatgatccagcaattccacttctgggtatataacctgaagagctgaaagcacagattcaaataggtattggcacacctttgctcgctgcagtactattcacaatagccagaaggtggacataacccaaatatgcatcaacagatgaatggagaaatcaaatgtggtatatacatacaatgcaatattattcagccttaaaaaggaagggaattctgatcaatactatcatattggtgaactttgaagacattatgctaaattaaagaagttagacacagaaggacaaatattgtacgattcaacctatagaagtacctagaattgtcaaaatcagagagacaggaagtagaatggtggttgccagaggctggggcaaaaggggaatggggagttatcatttaatgggttcaaagtttcagttctggatgatgaaaaagagttctggagctggacagtggtaacgggtgcagaacaacatgaatgcacttaatgctactggattgtatacctaaaagtggtcataatggaaaatttcattatatatacattttactacaataaggaaatagtaaagaaaaaagtggcacagaaatattttggaagtaatggaaatgttctctatcttgattgtgactgtggcttcatgggtatataaaactgtcaaaattcatccaattaaatagattcatttaactgcataaaattattgctcaataaagttgatgaggggaaaaaaagacactagcaaattagcaagaatatattttatgcctctcctccctgcctttcctcatttcatcctgcaatgcctaccagttttctatttcataggaagcaggagaaaaagaaaaaaacggagggagtgcgggcagggggacattcattcaacaaatacttagataacctccatttcatatgttactccaataagcctgagtgttacaggtttatggatgaggaaactatatgaagtttggtatgaagtcgtttatccaggtcacacgagattaagtggcaaagctcagtttgtaaccaccgtgtttctaagccttcacaaatgtgcattgtaaaaatgttctccctacgtgtgatttcaccagacctacatacatgaggggaaataacaagaggcaaagccatgaaaattgtgcactatcaacaagataaaaagtgtggcaaaaatgataaatgttcaagctgatggatatgctaattaccctgatttgatcattatgcattatatacatgtatcgaaatatcactctgtagcccataaatacatgtaaactaaaaagaaaaaaaaaggacataaaatgtgtggaaaataggtacttctgttcacatttaaggacttcttgcaaagagttattgaaacctttgtcttttgtaatttctccttacttaacaattgggcacacagattaagaacacacactccacagtcacacttcccaggtcccgtcctactgctgtgacctgacgtgatctccctttgcctcagttttctcaactgcaaaatgcggattataattgtaactatctgggcacagtagcacctgcctgtggtcccagctactccggaagctgtggtagaaagatctgactccaagttcaagtccatcctcggcaacacagtaagacattgtctataaaaataacaataataataattgcatctacctcaaagggcttttgtgatgattaaataatggatgtgaagtgcttaacatagcgttagaggcatacgaaattctcaataaatattagccttcctcttccatatagtctacctataacagctatggtctatctgtaatagctaggtacaggtagagttacatgcagaactgaaaaagaaaaagctacttttacaggtagtggtttgaattcactaatgttgtccttccttccttctttcctccctcccactctctctcccttaaaatgcattgctgttcctcaaatatagtttttgcattaaaaatgtatgatggatacagatggcaaatacgcatatgaaaagatgctccacatcacatgtcatcagggaaatgcaaattaaaataacaagaagataccactacgcacatattagaatggccaaatccggaacactgataacaccaaatgctggcaaggatgtggaataacaggaactctcgttcactgctgatgggaacgcaaaatggtacagccacttgggaagacagtttggcaatttcttacagaactaaacatactcatcacacaatccagaaatcttactccttgttatttacccaaaggagttaaaaacttatgtccacacaaaaatctgcatgtggatactgacagcagctttattcataactccccaaacttggaagtaacccagatggccttcagaaggtgaatggataatcaaattgttgcacatccagacaatggacaattatttagcactaaaagtaagtgatgttatcaagccatgaaaaggcacggagcaatcttaaatgcatactactaagcgaaagaaggcagtgtgaaaaggctgtatgatcccgattatatagcattctggaaaagataaagctatggaaacggtaaaaagatcagcggttgccagggatgagagttgagagagagatgaacaggtgaggcacagagcacctctgtataatgccataaaggtaaatacatatcagtattcatctgtccaaacacggaatgtacaacaccaagagtgaacgctaacagaagctgaactttggtgataatgaagagtccatggaggttcatcagctgtcacaaatgtcccactctggtagaggatgctgagaatgagggaggctgtgtgttttgtgttggaggtgggggaggagggcaggagggatatgagaaaactctgtaccttcctctcaattatgctgtgaacctaaatttgctcttcaaaaatcatctttttaaaaaacatgtatggtggaaactatgaatgatgaaagaaaaccccattcagtaacctgaagcagcacgttatcttacgaaataataaatgattcatttatctttggcagaatcgggtcattttcctgcctttctctttctagggaaataaaaattttacactttctcaaacatttggaagattgtctttcaaaagccagtacaaggaagcttgaggaaagctttttatagccaagtataacagctggcagtctagaagccatatacaacattttgctgttctacagaacttatagcagctcacaaaagcaaaaccatttttattgaggaaacaataaaaattgttggaaattttcaaaattaaatagtatagaaggacttttattgtaataaaagtaatctatagataatgtttctcatagttaacaaaggtgcccatttacctactcaaatccacatttcttttttttttttttgagacggagtctctgtcgcccaggctggagtgcagtggcatgatctccgctcactgccagctccgcctcccgggttcacaccattctcctgcctcagcctcccgagtagctggaactgcaggcgtccgccaccatgcccggctaaatttttttgtatttttagtagagacagggtttcaccgtgttagccaggatggtctcaatctcctgaccttgtgatccgcctgcctcggcctcccaaagtgctgggattaaaggcgtgagccaccgcacccggcccacaactccacatttctaatggactgcaaattcaccagcggtaaaagtaaacgagggaggcaatagatcctttgggtctgatgttacagccaactcaagtggcaggcttttgctagattttctaagccagcagaggcagggataataaaacacatttacctagagaaaaaaaaaaatcaaattaagatgactttaagtattctatactaacagaagaactattaaaagtagttaaatccattgttctgaaaaactgaacagagatatgaccaactggaggtgttttgtctctctcgactccactggcactaggacctttttctcctattttattatcaagcatggtgagccagccattgccatgcccaagtgctgcatatcttgtgagtctaaactgaaaacaacatatctcagacgttatcttagacttgaggctgaggaacagatggatttaagaaaaaaaaccattcctttccttttaaaaggtcttaaaaacttttgagaagcttcaggaaaaaggcaagtaagatacgattattttgtggcataataagatttcattttctgaaactcaatcaggagaactaatgaagaagaaatgtgccccttgcttgtggaagccagcttaaactggtaagagcccaatcactcacagtatttgttaagcaaaatccatttatgttggaacagtaggcatttaagcattaatatgaaagttaaaatagagaagacagtacagaatacttaagttacaatttcaaattcgacagtgttgacagagctactccagagaccactaaatatattgctttaaaaaaaaaagttggcggggcataatggctcacacctgtaataatcccagcatattaggaggccgaagtggaaggatcacttgagctcagactcaggatagaccagcctgggcaacattacaagaccttgtctctactaaaagaaaaaaacttagccaggcatggtggcacacatctgtagtcccagctacttaggaggctgagatgggaggatggcttgagctcaagaagttgaggctacagtgagccacgattatgccactgcactccagcctgggcaacagagcgagactgtctcaaaaaataaaaataaaggttgcgtttttttttttaaacattatatatctgagaagatctccatatataaatatttcattttaaacagctaattgaaaagttccatacatttatatgtgagaacatttcataaggttttaccttatcctaatcatatcttaactctaaatattccgtttaacgacaaaaatggcataacattcccaaagcagcaaaatgtctttcttgatttctgaagataaaaaaggaaaaaaatagaaaaagcagaaaagcaataaactgttattcattttaataaatttttatgatccctcagtcattactaaattggatcatatgataatttctcctttggttatcatttttattgacaagttttcagctgttttttcttcatttgcaaaatgagtcctagatctcatgtctggcataatcactcagctcccataaagaaagacatccaggacccactttatcttcatgttacttttctaagccagcccatcaaaagtctgaggagacagtcactcttactgctactgacaataccaactggtttagtgtacactaactggctgactacacacatctattccttttcattcctaacagaatgctgattttattcacatattcattctcattagaaataaatgttttaggccaggcatggtggctcacgcctctaatctcagcactttgggaggccgaggcgggcggatcatgaggtcaggggtttgagaccagcctggccaacctggtgaaaccccagctctacaagtacaaaaattagccaggcgtgctggcaggcacccataatcccagctactcgggaggctgaggcaggagaacggcatgaacccaggaggcggagcttgcagtgagtcgagatggcaccactgcactccagcctgggtgacagagcaagactccgtcacacgcacacacacaaaaaagaaatgtctcaagtgcttaaattcttgtaaaaataactgcaaaaagatatatgagtaaggactggtaggtaccatatgactatttcagcaaacacatatcacctggaaaaaatgtgctgatagagtttctttaggatcaaatgcgtggtagggaaatccacatcaagtccaataaaatggtaaaagaaaaaaagaaaaagccaggcacagagactcgtgcctataatctcagcactttgggaggctgaggtgggaggatcacttgaacacaattcaagaccagcctgggcaacacagcaagacgccatctctacttaaaaaaaaaaaaagaaaagaaaaattagctagtcatggtagtgcatgcctgtagttccagctactcaggaggctgaactgggaggatcgcttgagcgaggctgaggctgctgtgagccacgatcacatgactgcacccagcctgggcgacagagtgagaccctgtctcaaaaataaaataattttaaaagttaaagctaacaaaatatacacaaaaacccagaaacagtgatgtgaaagaagcttttgattcgttagtgatgaaatgagagctgccttgatagaccggcactattacaaagacgtgcattgcctgatcaagaggtggtgcttctcagagtttctaaaccaaagattgaattcttatttttcttcatggagggaaaaaaggccacaacgttacaatataaaaatctgaaaaagggaagtgaattgatttttcatctaacttaataaaatgacttatttggctgatatttccttaggatctcaacaacctcaagccaaaacttcatagtttttcagggcagcacaaacgaatcccacaggttaaatgaagagctgctcattaggactgagaatcaggaaagagccttagttcatccacatgtgattcattcacatcattgacttaaagatcgtcaccattcattgttcctgagtggggagaaaaaaatccacagaatatttccccgagatcataaagaggttagtcactgatttggggatctttatagtctaccatttgacaatgacttggcctttctgcgagaaaaaacatccatcaggagtaccactgaaaatgtgctgaatttagagcacctctccacagtgactgcaattacagaactcctaaatcactgaaaacactctgaatcttggttttaaacatcttgtgacaccagaagaggacaaaaattgtcctagtgatgatgaacctaatatgtggtgtgtctgttttggattacaattttcccaattacaaatgctagtcatttggaccactaacccaagaatgccttggttaatttctcaaggacaaaatgtttacatattgatatattttaacatttcatttttgaaatgaatgctattttatttttcaaaggcagatgatgtcttacctacccagtgtatttataacccctttgaacacttgacccatattcctaagcatccttatggcacttaaaatgcctaaccagttccaaatgttcaataacgtttcagcaaatgcttgctgaatgaattaattaatgagcgaaggtatgttgaaaaaaattagattttcctggtaacttaattttgaaatagaaaacatataataataaatgctagctcaaaataaccctagtaaagcaatataagtgactaccttggaaaacttacagcagaatgcatcactgctcccactcccaaacctgctaccacttttgcgttctttatgctatgagaggtaccactacatccacagctgactgcatcaggaagagcccaagaccaccttcagtttcagttatctactaggcagactctcagggctcggcacacagtcgtactcacagctgcagtttattacagggaaacaacaccaagcgaagtcagcaaggggaaaggcacatggggagaagtctgtggaaacagagtgggagcctccaagggccttcccccagggagtcacaagggaggcacttcactcctcctacaaaaagctgtgataacgtgagaaatgtcccagtcagggaaacccattagagactcagtacccagggtctttattggagttcaatcgcctgtaggcagcctctaattttggactcctggaaggacagcaggggatcagcataaaccataatgttgacacaaacagtttaggcactgtcagccactcttaccagataagggggaaacacttgctgaaatctcagttgctaaatgtcagccaagggccaaacttgtgggcctgcccttccttcctttcctccttccttcccttccttcccttccttccttccctccctcactcccattccctcccctcccctcctctcccctccctctccttcccttcctccctctctccctccctttctctctctctctcttaacagtcttcctctgctgcccagactagagtgcagtggtatggtatcagctcactgcaagttccacctcccaggttcaagcaattctcctgcctcagcctcccgagtagctgggattacaggcgcatgccaccatgcctggctaatttttgcatttttagtagagacagggttttgctatgttccctacgccagtctcgaactcctgacttcaagtgatccacccgcttcaacctcccaaagtgctgggattagaggcgtaagccaccacgcccagcccaggtcttttcaaggataagcagtttaggcctgctaggttaactcttttctgcacagcgactaggccagaaaccaagaaataatcccaattcctacttcttcactgtccctcatctcttctaggccaaatcctgtcaattttgctcctgagtaacttccctgtactcccttcttcctgtcctcactatcgggctttaatggaggcctctgttctctcttgctcgcatcactgccggaactcctaccttgtctcctgcctatccttccatccattctccacaggctctttgccgggaaggctgcccactgccctcaacctcccgagcatagtggaaaacagggcctttttctgatgtgcccaagttttctctctaatttctcaacactttctcccttttgtactctctgttctagtcaaactgaactattaaatgcagttctcagaaagcatggcactttcttacctttgtcactttgttctggctacttgtcctctacctagaatgcatttccacttttgcctgggttaagaagtatgtaggctttagaagtcagctgaggcaccaacacaaatcttccccagatatccccgtctcccagtctaatacctcatgcctactcccctccacggcatttatcccactgcactgcaatttcagtctattttattgatctatcccctatactgtgtgtccttaaaggtgggactgcgtatccccagtgtctagcatggtcactgacaaattgttcatgtccaataaatacttcttgactgaataaatgtcacaacttcagcagggttcccctgaggtcagctccatcccccggccttctagaccggactgaacttagacgattttggcacagacactgggaaccgtgcatcgttcatgttatcctctttgcattggctttgttcaaaagctaacagccaaatatgtggtggtcttcctgtgaccgtgtaggtctgcagagcctataatctgtatactaattacacttttggtttcgacttaccttccccaacctcttactctgattacttcacttacactttatttgtatctttgtgtgtgtgcatggttttttccaaagctgaaattccttctggactaaagcaggatataaatagatatgtatatagtcccaaagagatgagaacactgtcccattgtttagaggaggtgaaacctcagtttttctcagtatcccattcctagctaaatccaaagtctcctaaagcacaacttacaaaaagagctattttcctcctagttcttcagctcaacttcatgcaatgaagttactctaaataaaggaatgcatacgtgcacccatattttcttcacaagacttaggagcaagactcaaaaaagtgaggacagatgcgcgccttactttatccagtcaatgtgctgctgaaaaactgggtaaaatgagttgtttaaatagaatcaaaatgtcagtttactagagatgctcactacttacagaaacaccacggcaaatccatgaagtaattatggggtgaaagaagtaatcaccctaaaacttatctgccttgtaatcccagatttacaggctgaggcaatgttaaagtatgcttattagaaaaccctcaagttctactgtgtataaacatgcaatcctcttcgtttgtttcatcacctataaacgtaactcaagttaataaccagccagaaaattcaaattaatattaaatactgaaacactgttatcaccaaattcacaccagaaattattagcacttcaaatgtgagaatgttctcaaagccctgttaattccttccttctacccctacttgacagacattccttgacaacctcctaagtaaaacattccttctctacatgtcaatagattccacctaagaaaggcaaagtccttgctgtcaaggaacttatagccacgtagagttcactctttttgttatatctgttactaacatgagacttttttcttctttaatccaaattttcatttcatttttttctcctttacatctgtttttgttgtaaactgccactcaggagataactttcattaatttgccttataaaatttctaccaaaaccaactaaaaggacaagagaacatagaagaaggacagtacatgcagagttttaaaaaccttaaggaagattaaaagctcgtcaccacataaatgtctaaagttattactaggccctaccaatttgaactttgggatgaaaactccttatgaattcattacagatttgaatttttaaggcaattcagttcaactcatctcaagtacgaacacagtcattcaaaccgggctaataaaaggcagcttagtggacatcctaaaaggttgaattttcatgaattaacagattggcaacgagcttctcaacaatttggatgtaaacaagacatttagaaagctgctgaaaactgtttcttcatgtaggttaagaattagtcttccaatattttttacattacaattcttatttttcaaatttttttttacaaacagtgaaaaggtagtgtgtctaaaattctctgcactgctaaataagtacagattgaaactatcttataaatgaatttgacaatgacctgtgacctagaggcaaaagcagacagtgctgtttaagctgctcagtaaaatttgagctaaactcgaaatgtagaagcaaatactttctagaacacctgatagatcaatgttttaaaatccttgctaattgcttaagttttcattcttttgtaatctgctccttgtgtgtacttaacctactcacaggtatttatgttaattcattagatccctcagggtgggccgggcagactattatctgaaagcactggtgcatagcttcctgggtcagggacaaataaatcttttcatataattgcatgtcgttttatgtgttgctgtcttcccactgggaaaaatgttaaaatatttaaggcttactatctggtgtgattgtgattttataattaaagtctgggacaggaggagagagtggcagaattcagtactttatctcagtaggaacagtctttctttgaagcggtaaacttttagatagtcaataaaagtaaaaattccggtgaataagagctggtagagtccttttgaagtcacgtaccaccatttgatgacaatctagtttaataaagatagagctaaaagaataagaaggactgtatatgtcacaaagatcgtgattctcttcagtgataaaatcaagtaaatattgtcatcaagctaaaatatacccaattctaatacagcaactgtttacctatttccaaatttgtctacataccagacagccagtgggggagaatggttttattttgttcttaattagaacagtatttggagctggaactatctaatgggcaagtaagccaagcattctctcatccactcactcccttcagcattcttctcttacccctatcttctggaccaaaaaataaaaagtctagtcaggaagtggggagtgggagttgcgggacaaggtatgagttggggagagcatctgggttttatcaccaggtgtgtcaggatttgcagtttcttgaaaatctaaatcttcaggttgctgtgcagacttgtgcctcctggtacaaataatagctgcgcccacacacactaatgcccccccacagcccacagccttggggcgctccaaggagagtgagttcaataccagcagtaagggcgactcgctcctggacgtgaatctagcatgcaagatcattttcattaaacacgtaactgcacagcgacgatttacatctcctcttatttcctttgaatgagaagcagacgcataacagcaatctggaatagaaagtggagcttttacaggctgttgtatgtgcaccaaggccgggagaggctgaggtccgtcagcatcatgtggcaggaaaaccgcaaatagttcgaaaggccacactctccggcaccgactgagtagctgctgcaggaagggggacaaatggtcctcagcaagaccctcttcagaaggaacaagagaccgtgtggagggcccatgagaatgaatttgtggtttgcaactggtttgtcatgtctcaaaataagtaaatccagtatgtgtgactgtttagaaaagcagttaagggcggttgagtctttcttggttaattaagtgattttcatctggaggtatgtttggaggaaggagcctcctggaaagtaggatcagaaagaagtgtttagtgtgaaaaaatcagttccagatgattttgtgtatatgcctcgtgtttaaattcagactgttaagtctagacactggaaatcaaactacaggtcagcaaaaaaaaaaaaaaaagaacacccacgcagcaaaaagctgtcatttcactgccacctctgttaaaagggtacaaatatgctatgcttgcttcaaatctatgttttataattctcttctttataacaaaaagtcttctgacaacacaatcaaaaacgaatagtcagaagtaatgatgatctaaacctaaatggttaaagtctttgctgatggatgcagagctcaggagggaggctatgactgggagggggcagaaaggctgagggaagaacaagaacatagagacggagcgcagggtgcctgcaacctgctaccagtcaaacccctaccacagtttcctcatctcgacaaaaagcataatcaggtacatgagtttactgttcataataatgaactacagaagcatttgttattgttacactaataaaaaccacaataaaaaatactactcttattagtaacaaatcaaagaacctccttaatatgaagtcagtgtgaatggttcttggaggggagccagttccgcaggcataacagccatccttttgcaaagccatcaatccagaattaccagtcatacctccaacttatgccttaccttaccccttatgtcttaccttatgcttctgctgaaaaagcgaatgaaaagctggtctcccttttcaaaaatgaaaccatcaaaaaccaacatgggaaggagaagaatcactgactaggatatgtctgtgcagaaaacaaggtggctctcatctgaaaatataacatgacaaaggcgaccaactacatagaacatcatttagattctctccaattttgagatgctgtagctggagcacagagataaccgcccccagtcacacagcctgtctgcttctggactctgtattcttagtcatgaccttgtagctgccttatcatgttctaccataaaaatgaaaattgtgaaacagaaaatctaaatcaaaatgttttaatttgtaataaaagaaaacaaactgagaatctgcaaaagttgtgaaaattttcttctgtgtgaggaaagcttcgtgccagatatcttaaactcaacataaatatccaacacatttcacataaaacagaacaatactgccatggtaatgacgctcctcagttagacaaaaatctcaagagcaggcctgtctgctgatgttcatcactaacctacagtgtatgtgcatttgtttttgccaataaactatgctgttgccagagattaaacataagttcctaaatgcatgtatgattgtttgtaattacttaatattaataagccgaactgataaacacaatcccaaatcaagaaagaaagccaacataaaacagaaagatggcattgctaaatcccggaagacatcacctcgagcttttcatcatgccactttgaagttcacccccatccaaaccctttgtggcttcctctgaagaatcctgaggcagaggcagcagcaggctcactcctccagctgcctgcgaaggctgaattccatttattccatttggggttggtggtgggcaggacgaatgagactgttgtcattcttcccaggaatgcttagatggacagtgagctattggactgccccagataccatcatctcccccacatccctcctacgtggagccttagtttggggggaagtgaatctcaattgcccccttccctctccccgtcaatgaggcaggcttgtggaggtgctggccacttcttaggcctaaatctgtgttcagagagtggatccatgctttgagagatggttgccctgcccgtcctagactatcttgaagggtgagaggcacaggaacttagagagtcaaagactaccaagagacacaccgaaaactagtgaggtgggaactggcaatttctaaacctacggcaacagcagtctctggtccttcttttcatttcccgggacctccatcctgagggctgaactgataacattcatcttacttttatggatgatgaggaaaatgccacaagtgagtttaattctcaaaggagaaagagaaagtggtatctaatatcgattaggtccaaatatactctcttggtgttttagccagaaatacatctgggcatttctgcagcaatctgtaagagactttatacacgtatccatctcaaaataatgcgcttttagttattagcttttattcatttccattttgtctttttaaagtgacatccaaaatgatgaaaagcttcagggtactacaacaccataagataatcttcctgtattcacttccccaaagtacccagagatgggccccaagaggagtcctcctcacgaagaggtgaagcaccgacctgaggatctgtcagaaccctgatcaaaaagcaacagaacaaagtgaatggcgagataaagtggagagggagccattgtgtttacgttcacctaagcaaagtcctaattagtgcccagtcctactggaggatggttttaatggcatgcaccttttatcgcctgcaaatgcttaagggtcagcagaacaagccactgccttgttagataatgaaacacagataaaaatttatgtgtaattggtatgttttaaactggtatttaaaagctatttatctcttagtggggacaaatattcttttaagtcattaattggcaaccataaattttaattctattctaggcataattattacagatttcaagtaagtaggctccaaaacaatgaggctttactggttcgatcagaaatacttgttgaagggtttcctaagaagattacaataggataaattaattctatcagcagaagcactggagtatagaatgtcaaatacagtaaatccatatgtaataaacatagatatctaagatgtgtaagtaagtaaaaataaggatgttgcagatatatatacaatatggtgctgcttatcaaaacaacacaaaacaattttttgtgtgtgtctgtaaaaaaaaattgtgggagtggggatgtgtaatgctgaaggtgaggtgccaaaatgccagcagtggctacttctaggaaggagggtaggacggtgggagaaaacagggattaaggacaatgatgaaggggaattttgcctttgttataaaatgttttaaattatttaaaataaagttattgcatttatacattatttgtgcaattaaaatatttcaaaatttcagacttatttatccccactataatcacaagtagtgattactgagtatgggaagagcctagtacctaggggtggtgccattataatcccaaaggacacaatcctgaatgccatcatccctgaaaatattggtatacaggcctttaaaaacaaaaaaggcctgagagtaaaaattagcctgaagtcgaaatctctgaaatcgaaaatcctgaaaatcataatccccaaacactgaaaccccaaatgctgcaatcctgaaagccaagttctggggagggattcgagtgctttccgctgtgctcactgtcgctgcatcctgtagttctggggagggattcgtgtgctttccactgtgctcactgtggatgcttcctgttagttctggggagggattcgtgtgctttccgctgtgctcactgtcgctgcatcgtgttagttctggggagggattcgtgtgctttccactgtgctcactgtggatgcttcctgttagttctggggagggattcgtgtgctttccactgtgctcactgtggatgcatcgtgtagttctggggagggattcgtgtgctttccgctgtgctcactgtggatgcatcgtgtagttctggggagggattcgtgtgctttccgctgtgctcactgtggatgcatcgtgttagttctggggagggattcgtgtgctttccactgtgctcactgtctttgcatcctgttagttcgggggagggattcatgtgctttccactgtgctcactgtggatgcttcctgttagttctggggagggattcgtgtgctttccactgtgctcactgtggatgcatcgtgttagttctggggagggattcgtgtgctttccactgtgctcactgtcgctgcatcgtgttagttctggggagggattcgtgtgccttccactgtgctcactgtggctgcatcctgttagttctggggagggattcgtgtgctttccgctgtgctcagtgtggatgaatcgtgttagttctatcatgttagacaggactcttatcttgtggttgtcttcatctggaaattagctatggtttaagatgtgtacaggtgccagattcacaaggggtagacttgtagacttaattttcggtgtcagcttgactggattaaagagttatctagtaacttggtaaagcattatttcagatatgtctgtaagggtgtttccagaggagattagtacatgactctgaatggagtaggtggagatctgcctaaaatgttggcgggcaccatccaatcagccttgggtccagagggaacaaacacagatggtaaactgctttctctctgagagatgagacagacttttcttctgccttggacgtaagaaacattattccaagtacacgcattatcacaatgctgctttgtgtataagcatggtgcatgtacataaaaacactgaaacttcttccataaatgaagaactgccttttttctgtgtctccatttgtgaaagataaaatttcttgagaccttggctctttgagtgactgtatttgtggcagtgaccagaggtttttgatccatctcatcaaaacatgtctgtcagggtatttttgatgactgcagttacaacgatggatgcatacaatttccaaccatagtaataagcgttcacacatttcactttctgacctatttctttataaatacagtttgtctgttcatagctataatagctgagtgactcccattagtatatctgtgtgttgatgcttgcaaagagaacatgtatggtattgttgcctattttactgtgtaaagtggcctataatgtgttcagtcatgtatttatatgtctctaaagtcttcttttaaaattgtaacaaatgtattttaaatatttttaaaactttattccacaattatatttttgaaattttggtctctcagaattgtgatttggggattttagaatttagggattttaggctggagctagtgaatcacacctataatctcagcactttgggaggccaaggcgggcagatcgcttgagcccaggagttcaagaccagcctgggcaacatggcaaaacccgatctctacaaaaaatacaaaaattagccgggcatgatggctcctacctgcagccccagctactcgggaggctgaggtggaaagattgctggagacccggaggcagaggttgcagcaagccaagatcacgccacggtactccagcctaggtgacagggcaagactctgtctcaaaataaataaataaataaaactagactttagggattttaatctttcaaaatttcaacatttggaattatggcattcaagatagtgtctctcaagattatggtccaaacctccatagaggtactggaaagcacaacgccagatactacagaagttccgtatgactccattctggcgcaaccatatgcccatgtgtcaggcacaatttcctaagaagaaatcaagtgtaatagatggcaaattggtctcggcctaggtcaagcttgtccaacctgtggcccagcatggctttgaatgtggccaaacgcaaacttgcaaactttcttaaaacataagtttttttgtgtgatttttgttcttttagctcatcagctatcattcatgttagtgtattttatgtatggctcaagacaatttgtctccttccagtgtggcccagggaagccaaaagattagacacccctggcccaggtcagtagcaccagaaggatatctagataagatcaaactaaattaataagcagtctgcagctccaaagcattgactttgaccagtacttttgagaatccttaggctaattcctagtaaagcatgttttgcaaataaaaaaaaattatcttccttttttattggtttgccaaaaaaaattaaaaaaaaaaaacaaactgtgaacatacactagaagcaacaaccataataaaacttctggtaataataaggcagctcctcccatatataacataccaaatataacaactataagctctggattcgacatttaaaaaaactaactgaaggtactagagagtggccaaaagcagacagaaactggaagggagttaacacttgaaaataaatgaaaaacactagatgagtttcttgtttataaagctttttaaattgaagccagaaattttctggctgtgccagctggggcaactgcaagttggatagaaatctgcagcttcttaaagaaacaaaaggaaagtgacaggaaaaaaatcccagtgagggccagagtctagtgcataaaatgcctgaatctctgggtgacccctactatccacatgcattgaggagaggcccagcagtccggaaaagtctaaaagaactgaaaagtgatttcagttgctgcccttcacaggggtaacaaagttggagcacacatctgccaatataatagcatgctaaagcaatacacacacacacacacacacacacacacacacacacacttcagaggaatataagagaatccagaaacctataacatattaaaaatgttctgaataaaacccaaaattactagacatatgagggaagaggacagggtgacccattctcaagaaaaaaaaattcaatcaatgaaaaccaacccaaaatggcccaactgcctcaaaaactaggtaagaatgtttatagtcagctttcattactatgcccaagaaaagacaggaaaatatgcttgtaatgaacaaataggaaatatcaacaaagaatcttaaaaatgtgatatgaataaaatgtgaaatgaatgaaaaataatccaataaaaatggaagaggaagagaaagacacaaataaaagaaccagagagacggcagtgataagaactcagtcttacatggtaagaactcagcatgatattgttgcctgtgaagacaaaaggaattttccattttcttatgccactaagtttgtggtactttcttacaacagcaataagaaacagaaatgtgctgaaagagaaggagaagagaagctgccaatctagaatcctctatccagcaaaaaattgtctgcaagaataaaggcaaaataaagacattttcatataaaagaaaactaaaataatttattaccagcagacctgtactaccggaggtgctaaaggaagtccttcaggctgcaggacaatgagactagatggaaggctgaaatttcatgaaagaatgaagggtgctggaaatggtaaatacgtagggaagtataaaagactctttctctgaatttcttcaaaatatatatggctacttaaagaagtaaaatgttgtattgagggagctttaaaatatgcaaatataatatatatgacatctgtaagactgaggagttcatattttacatgaaatgggacaatgttaactttagactgtgaaaatttaattatctgttttataatcctagagaaaccattgaaaaagaacacagagacatatagcaagaaaaaaaaaaaaaaaagctcagccaaaagaactttggcaaaagaaccgaaagataatatacaataaaaatttttttcatggaaaatagttttggaaatgctactatgaaatctcagcaaattctatttcttgccaatgtattcatctgcataagaaatggtaagggatacatctgtagatttaaacacgcacataaacacataagtccactaaaatggtcagattttctactcctcattcaattaaaaaagaaactatataaagaaagcaccaaaagacaaaataccaaacccgtctctacttcagttctctgttccattcacaattctcacccaggaaagagaaattcaaagaaaagacagagctggaacttcatttcctatatatagttagccagcattcttcagtgttgtctacacattcacccacatccaaatgtactgccaacagaccaacacagagaagtgctgagttaggtttcagtgtgtttctaatatatcccattttattcaagacagaataaaattttgtttcaatgtgactcctctgggtttaaaaaaaaatccaaaatcttagacttaactatatagtcaatcaactagtacataaacaaatgacttcagtacactaatgctgatagccaaaatagtaaaaaataagtctaaggcatgtcacttacttgctctttctggctcatttattttaactgctcccactagcattctgtctggttttgttttttttttctagattaattcaattctcttccctttggatgagatagaaaacagaacaaaaaaaatgaaaaaaaatgctttgcttcacaatcagtcagtatttattgaatgtctttattgtcacacagtatttattgaaatactatcatttgccaggcatagaagaagacgagataaataagatggccccttatcgtctaagacttaagtaaaatacataggatatatatacataatagatataaaacaaagctgactgtttcatgaaagcagaaaggagagagacaatcttttcagttggagaatcaggaaaagtttgtccttgcaggatgaggttttcagaggtaagctgggggtggggaaccagaagcagaaataggagaccagggaagtgtaggacaattcagggaaaggtgactggctcagtatggctggagcatacaggctacactggtggaagctgtgagagaaaacatggcatgtctaattatggtggctcttgaagccaagctaaaggtcttgagcctcatttgataggcagtgaggttcacagaagatttttttaaattgtggagtgacatttttcatcatttaacaataaacagcctttggaagtattatgtgccaaaaacatgcaaacaagtaatagtacatcaaggaatcccacaaaatccaacctcaggcagactgcagttgagtagggagctaactatgtaaagagaacaacaagttagaaagccttagtgaggattatgctattgttctgtctaagccaagatggcaagcctgggattgccttaccaaattcaagctcccagactacatatgacacatacatgaaagaataatttaaaatttaaaaaaaagagagaagaggaatcttttttttttctgtaatcagaatacctatcatccaggaaaaggtcataaaacagtgcaaaataacaccacaggactaaaaaaagatttttttttaatgtggcaaaaattaatacaggatttcctttgcaaattatccaggctttttcccattctggcgtagatgccactactctatgtgcccataatgtcctgattcttcctctctgtaatgacagttctcatcccacaggattcaagttgcctgtttatgtatctgacacctctgctattttatcaactctttaagggaaggaattgtgttttatgaatgacattctcatttttaaaaagaaaacaatcgtttgtcaaataaaaacaaaatctgtcttcctttctttagactttcaaaattagctcaaataaaaatatattattgttgacattcagtaaagtacatgttggcagcctcttttaaagtgcctttcataaaacaagcagaagatatacacacagatacacacatacactttttaaaatttgaaataatataagtgctcttactgtaaaatgtcagacaacttttatctgaagcattcaaaaatttctcccctgccccaaacactccttattgggctattgttatcccagtttcactcttagaagacttaaggagaaaaagcattaaatagaatttatgggaggtcattgatttggactaagctcctacactaggccccgagacacgaagccaacatggagttattgagactaaagttccaaactgaaaccaacttgtttaacctgagaaagtaggagagagataatagtctaatccccaaccaggccacttttaggcaccgtgataaggaaggcttcttctgttttaatcttctatgaaaaagtaactttgaaatgaccggccttcttgttccacttctgcttcttcagccgtcttctgcctatctagaccatctcctcctgcgaggatgtgaagtccatccatctttcaaggtcaagaagtttagactttattaggaggcaatggagagtcgaagaagaatagttcaattcactttctgtagaagtgactgaaggaagggtacttccacaactgcaagcacagaagccattaagaggttgattcagcgacccatataatggtggcctcaattaagggactggcagtgtggctgaagaaaaacacctagctaaaagagaacaggaagcagaactaaccagatgtattgactgactgaatgtaaagataagggagagggaaaagtcaacgatgatctataggtttcctctaaacagtcattaaacaattatttactgagcaccaagtatctaccatggttccaggtaccagagatacatcatcagacagaagaatgtctcatttttatggaggttatagtttagcagaagatagacagtaaacaaataagatgtctacaaaaccttctctcatcattctttttttttttttagagtaaagtgaaagcaactttattaagaaagtaaaggaataaatggcttctccataggcagagcagccaatgtgatcattctggccaataggcttcttttgtcttaggtgtgccagagtacaccacgcattttggaactagatggcacagagcagattcacatcatatgtacagcttcactgggaatccttcatcccaatgaagctgataaagtctgaaataggacatacacgttaaaagaatgtctgaatgattgtaaggatttttctggcttctagcaaaaaagtaaaatattgtttgtacttctgaacaatttaaggaattttgaaaagaactctgactctacttttttcccatcacataatgaagattgatgtatttattacttggtggtgtgaattagaaatatgataaatttaaagtctaacttgtttcccatccaaacttcccaactagactgcactgtattttttatttttctctaattgttgtacatgggtaagtaaaactcgtgtaagtttccgcatagttcacactcatgggaaacaaaaactgcgccttgtatatcatcatcccccgactgtctgtcactcacagaattcaaggcacatatgaagtgctcaataaacaagagcttagaggaaatcaatgaggcttagtgcatagccttattgcaaactgtggtctccaatgcaaaaacaaaataaaacaaaaaccccacaactaaaaacaaagtaggggatgttaacaagagaacaaggatatgaaacctatctcatgaaagaataaacatttcacacagaaatcataaatgttggtattaattttaaatgacatttgtcagccatagaaagtgatctctaataactcacgatagagcagtttaatgcccaaataattgaaaaaagaattggagaggtaacctaacggcagataagattaagtaaggaaaatttcaatctgtgtgaagaagagaaggctttaatttttcaaccctttgggacaatttggaacatcagggctctacaccaaaactcgactttatttatcctatatatatcctttatttaggatccctaaatttattttttactttcttcatgaactcgtaagtcagtctcctagggcaggggtccccagggctgcggactggtactggtccatggcctgttaggaactgggtcacacggcaggaggcgagtggcgggtgagcaggcatgaccaccggagctcagagcagtggcagcactggattctcatggagggtgagcaggcatgaccactggagctcagaaaagtggcagcattcgattctcatgagggcgtgaaccctattgtgaactgggcatgtgagggatctaggttgtgtgctccttatgagactctaactaatgcctgatgatctgaggtggaacagtttcatcctaaaaccatccatcccctcctcaccgccccatccatgaaaaactgtcttccacgaaactggttcctggtgccagaaaggttgggaaccactgtcctagggcaaccttgcttgtgtgggtaaagttctttaagaaaacgggagactctaggagaaaaaagaactattattattgtaaaaagaaagattaccaaggactcttcttttaccatacaaaggaggaaatccttactacaccttagtgtccaagttcagtatacctttttgatataaaatacacagaaaagcttaatatttgatttatcttagtgtattatctatctcccccctctagaatgcgaactctataaaggcagaaattttttatctgtgttgttaactgctgtctccccaatatctacaacaatggttaacaacactaggtagtcaacagtagctaagaatggacgaaagaatcaaggcttggataacaaaacagctcgtttatggaatgcatgtatattttcataaggataattagtgtgtgtaatcaaaagcaaagcccttctgaaagaagtccatcaccaatacagataagttaccactttgtttgattatcataaactatcaaacaatgcaacccactgaaaggaaaatgtgagacaaatttaactcctatgaccttagcgttgaggaaggaaagatttacatagcgtccattgattcgctctgggaagagtgtggttaccttcaaaatctaaagtcaaaatctaaatccctaagtcaaaacctaaaacctaagagctgaaagacttctctgtgtttaagcaggcatcctgttttcactctgtggtatctaaatagaagcttcaaaaggagactctgtgcttgtgtttacaaactgtgagactgctcaaatatagaaacggaagactttttgttgttgtttgtttctagtttttctttttttcttttttttgagacagagtctcactctgtcacccatactggagtgcagtggtgtgatctttgctcaccacaacccctgcctcccaagctcaagcaattctcatgcctcagcctcctgagcagctgacactacaggcctgcaccatgtcacctggctaatttgttgcatttttagtagagacaaagtttcgccatgttggccaggctggtctcaaactcctgccctcaagtgacctgcctgccttggcctctgaaagtgctgggattacaggcatgagccactgcacccagcccctagcttctattttttttaattactagtgtaccagctcaggattgaatacatctctcctcctgctagaaaaaatttaaaataacctgagcaatgtagctcatacctgtaatcctggcactttgggatgccaagggagaatgattgcttgaggcctggattaacactccaagacctcatctctacaaaaaaacttttttaaagaaagaatttaaaatagaagtatttatttctttcaagttagcctaaaggccaaatcgagctcctggatatttgaggagttctgaaaccacgtttgccaagatcatgacggtgagaggaatctggcgtgactaactttatcttgcttctagtctcacaggctggctgcccttgctcattcctaggcacaggccaagctaaccatgggagacaggaaggatggtcatagtccctccctaaaactaaacccctctttgctcagggaccagagccgcttttgtaaaactaatgaaaggccataagattagggttatgggaggggcctgcaatttgttaaaatgtaggcgtagtttctataatcccttactgctcaggagtcatgtggccagaggtcacaagatttgtgacttcctcaattgctcctacagataacattactattgtagtacctaagattggtctttcgaaacgtttttcagacgttagcatgctggcaaccaactcacccccctggacctgtgacttatgactcagttggtcccatggcccccgcccagaggcatactcagcatagcaggaccgtttcctaccctcctatgattttatccacaaccaatcagcagcacacattccctagccccttgcccgccaaactgtccataaaaaccccagcttctgagttcttggtgagactggtttgagtaataactccagtctttccacttggctagctctgcattaattaaactctttctttactgcaatatcgtgggcttggcgaaatggttttgtgtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttcagttttgtctgtgcagcagacaggaagagccagttgggtgactacagttcccttcacacagaataaaagttcctaaacaataacacagctaatctcacctacaattcaggtaagtcaaaactatgagccctttcccttactgagtcccaagtaagggggattctggtccaaacaaacaaaaaacccacacaatacacacataaaggtcacaatttgtatttgctcaagaatcatataactcattataaaccgaaaccaaacgaaatgaaagactttattagtaaaaattatgaaaaatttgaaaatatgtcaaaaggttacctttatattcttttaaatattggaccacagtctaaacaggcccacccaaggatttttttttaatactgtagtattgtttggcttactacttattatctatcagcataaggactgctaagtaacatattaacttgcagatttttgtccaaaaggatgtaaatgatttttgtgtgatagaaagatagccccaaagacaacagttttattgccctgtaagacattaaccaactgacaattcctttttttttttttttttcttttttcttttctggagacaagagctcactctgtcacccaggctgaggctacagtgcagtggcatgatcacagcccactgcagtctcaacattctgggctcaaacgatccttccacctcagcctcccaagtagctgggactacaggcatgcaccatcatgcccagctattttttgtattttttgtagagatggagttttgacatgttgcccaggctggtcttcaactcctgggttcaagtgatcctcttgtctcagcctctcaaactgctagggttacaggccactgcacccagcccaatttactgatcttacaatcttattctagcattctatcagtgcctatatataatttatctgtggaattttctgggaatcagcatcaccattatgttgattccctcattcatcaggcaaataaatttatgacacgcacttactatgtatttacgagggtcattgttttacctctgaaaaatatattttgatatcttaaagttttggtatattttcttcttagatgcctacagaatataggaaaggtaagctgttactggtctatcaatggcaacaaaagaatgtaaattgattgcattattcattcttcagcaggctgattactgatactatagtcataccattgaattatttagtaacaaaaaatctagtaaataattacaaattatcagtgactaccatattctttagagcacattattttacccctaaagatgcgcattaacattttgtgattagagtacctagaagactacagaaaagagcagaaatgatcactaaatgctgcatgtacctcctgtgttttactcctaatgcagctttaaagctgtacatcctaaagaatattgcattttctcttttaacaacataaattttatctccagcaaagaaagtgttacactatctatagtaaattttaaacacttcaatatagaagtatttccagtgtgatttatgtgtatctgggttagtttccactcacaccctaatggtattagttaacatctgaagtaccctaatgaggaattaatccagaggtggatgtttatcatctgacacatggtgaccatctgccacaatgccagaggtagctactgatggggtccaagacatcctaccccaaaatatggtactttggcatattagatattttaagctgaaggatttgagaaaacagaccttccccctccccttctcccctgaaaaaggttataaaatctttcctacgttttatgaccttccccgaagcaggtcaaaggaccctaatgtgtgaggtgccctccctatacccagaagaaaggggcatccttatctccaaacatgcagtgacatagagacctgaacaaataggtcttactaagcatcctccagtttataacattcagctcatcccccgctttgtcctatcacatttctctaagactctccactcttcatcaaacctactatgaaacaagctcacgtttaactgcttcttcgggtcttcatttccttatgaagtctcccatgtcacataaaacttgaataaatttctaataaaataaattttattagagggggtcccagctacccaaaataagtagcaggaaagatacttttcctcccctttgctacaaaacattttcaaatatctttgtttctgatcaaccttaaaggatttgataatttgcattatagataaaaatatttttccttggtgaaacaaggggtgtttaagatatgtggatggctaaaaacagtagaaaaagaataattagtttatttccttttgcctttgcttgaacaatgtacaagaatctagcatgccgaatgactagaattaccataggttgcaatttgcctgttacagtcccagtttacatttcttatcccaacataattattaagaatgccctctttggttctcaaagcattctgctttggaccacaaattatatggacaccccaccacagcatacctttcttaaaggccccctaggcttaatactaggatggaccctgtatggatttttgtcagcgaactgctactaggttagctgaattccgaagctaacgcactgtttcacctgcttcaagtgaatctttctgtgataaatttatagaacaactggtgtgacagtttttgcgcctgcctaataaatgtttgtatctgtgcatgagtcagtctgagacttgcttttattacaacacactgcctgggactgtgcttgcaggtgagaagaccttcagttttcatttgctcctatctactagaggctacggatatattttctttttttttttttctacacttcacttattagatttattactaagtacttgatgctttttatttttatttttagatttcagtaaaatagtttaatcaagtcactaaacaagcaaatgacaacaacaacaaaaaagcctcagagagagagaagggaaatcaatatctagttgctaccatatgacacctaaaatgccaaattttctttttttttaatttttttaatttttatttttattttaagttctgggatacatgtgcgggacctgcaggtttgttatgtaggtaaatgtgtgccatggtggtttgctgtacctatcaatccatcacctaggtattaagcccaacacacattagcaatttttcctgatgctctccctcccctcgcccttccgacaggcccagtgtgtgttgttcccctccctgtgtccatgtgttttcaccgttcagctcccacttatgagtgagaacatgcggtgtttggttttctgtctctgcgttagtttgctgaggataatggcttccagctccatccatgtccatgcaaagggcatgatctcattcatttttatggctgcatagtattccatggtgtgtatgtgccaccaaagctcctctatctggcagttccttgcagatgaaagctccccccatgattcagaataagtagagcttttggccagaagagttttcaaattcttgcccttatagctacaaacccatgagcctatttctagatccttcctgttattcttattatagagggaataagcatctcttgctactttttatcactagaccaacatctttcttccctactagacataagttccatgaagccaagaccgttgacttccttaatcatctctagaaccctgggttctagcacatttggtactcatcagttagtcaatatctgctgaatgagtaaattttaaaaagtgtccttgatttctcctccagaccattagttgttcttttcctgttcaaatagtcggaaagcaaaggcaaggaaaaaaaatctcagaggctcacacaaaaaaagctacaaggaaaaacaagttcagttagttgttttccgtggtatctatgaaacttttttctaaacaaataatgtgttctgtccaaaacactttagcctaccaacatagcaactctacgtgcaataacggcatgactgcactgattctgtgtcttgattttaactttcaacaagtaaaacaaacacaatttgcaaagcagaattccaacactgctgtcattacggctttagataaagcaccactgacaaggccccctctagattctacatgaagacttacgcggactgaaacccgtcctcagtactccaactgttaaccaaaccgcctcccaactctaaccaactacatcatagcaagcaaatctttatatgtaaacatagaaaattattatttttatctagttgcacaatgactttctaactaagcttttattgaaaaaacatacatctcactaataaggaaaaaaaagagcaatcacttgtttagaataaatgagatgctcttcgtcctctgtgagcccctttgactcatgaattggtttaacttctgaaacctccagtgtagactgtccctatctacagcgagcgccatgcacttatgagcaggaaacacccatgtgacaaagctcagaactgtcacggaaaggtaacccaggtaaaagcgcatcaaaacaaggacacacacacactctctctctctttctctctctctctccctctctccttctttctctttctttctctctctctctattcaggagttctcaatttcccatttctcccggcttaaaagttaagagtaatcacgcctgtaatcccagcactttgggaggctgaggcgggcggatcatgaggtcaggagatcgagaccatcctggctaacacggtgaaaccccgtctctactaaaaatacaaaaaaattagccgggcgtggtgacaggcgcctgtagtcccagctactcgggaggctgaggcaggagaatggcgtgaacccaggaggcggagcttgcagtgagccgagatcatgccactgcactccagcctgggcgacagggcgagactccgtctcaaagaaaaaaaaaagttaagagtaatgagggaaattccatgaagtagtccaactaaaattttattttatcctagaggtaagtctgaggacattgattagtgcttatttttgttttcagtacaatatccccaaaagtttgaaaaattagctttgtcacaatacacttcctatattacatccccttctaataatttcagacagcttataatttgtataggaagatggcaaatgtttttatctttatgaaatttatgtgtacatacacacacatatatattttatatccagaaaagttttagctacatttttagtttcagaggctttgaattcattgattattgtgtaggtaattacttgaccttatatttatttgagatgatcttttattttttgagacagggtactgcactgtcactcaggctggagtgcagtggcgtaaacacggctcactgtggcctcctgggttcaagagatcctcctacctcaacctcccaagtacctgggaccacaggcatgcaccaccatgcccagctaatttttgtacttttttgtagagatggggtctcaccatgttgcccaggctggtctcaaactcctgggctcaagtaatcctcccgcctcagcctcccaaagcgctgggattacatgtgtgagccactaagcccagccactcgaccctacttttagaaaattcaatacataaagatgacatttccctggaacattctttctcctataaccaaaacattaggcatgagttacattttccatgtccatgagtagcacttcatgttattatatttcctaagaactattttaattataaattttagatgcagtgaattattttgggaaaggtgcatatccaacccatccctatttcgagccagaatagcttagattcctgaaatcacttcagttgctcctttaagaccgtgagaaaggaacatatgaatcttcacaaaccttcacagaagcttgttgaagattttggtttctaaaaatatttctatttcacttgatccagattttcatgttatatttcttttgcacaccatgaaaacaagttttcaactactcaaccaaaagtctcgggtagaaaactgcccctttatctcatgatggtatgaacaggagatgagtagacaaaacttttagacctttaccggctgttcctaccccaaatgccagccactcacatgttttctcgccctccaaattgctcagttttcatgatgctgcatttaaaacctatgtctgaaattggtagtttgctttttttttttttttctgggggaggggtgtttttacaagggagatttgggggaaatgtgggtatggagaaattttctttccattttccactggctggcactagaagaatccagtcagtttttctctgttctttttctccctctgtcctcttggtaccaaagcagtcaccatcacaaattccctttctttctattagtggatatggaattatctagcattattaagaataaggtgaaactgtctcagacccaggcttaaattgcaaaatgacaaaatatattaaaatactagagtacaaaagaaaagatacagaaaaattctacaaaggtatatatgaatggccaaactgtccaacatacataatccttgcataagcacccagtatgtcctaacagagaaagaaaccagttccagaaaaattaagtcaaaataatcacatataagagcttctctcttttagcccttcagtgacagctgaacgttggtcattaaatgggcatggaagaaacagagagaacaccatcttctgtttgaacaaaatcctgatctccaccaagaactgaaattgggtcttctccacttggaagactcctctctctatagagaaagagagagagctgtttttctttctctctctcttttttttttttttagatggagtctagctctatcacccaggatggaatgcagtggctggatctctgtctgctgcaacccccatctcccaggttcaagtggttctcctgcctcagcctcctgagtagctgggatcatgggcgtgccccaccacatctggctaatttttgtatttttagtagagatggggttttgctatgttggtcaggctggtctcgaactcctgacctcaggatacacccgccctccgcctcccaaagcgctgggattacaggcatgagctaccacacccggctctttctcttttcttttgcctcttaactccgcttctaaactcctcttgtgtgttcatgtcctaaattttgctgacgcgaaatgacgaagcccaggtacgtaccccagacaacgtagccacttcatactgggaacctcgtcggggaaaccaaggtacagcagtcaccgaaatggtgagcagaggaacggactccaactctgccctttcatttcaaggctctcggcctaaatgttagaaccatatcaaatcagtaacaggcatccgtcagccagttagaaacgcggttagcacggctgctgttcaaagactgggatgccaggcgtactggggaaaacatggagaatctcccagcacccatgggttgctgggcatgttggccacgtgtgaacaagcttcctttcatgaaggacttagccatcgcttgaagctggaagaggttctggagcaactgaggatttctggctggggctaccgcccagtattacccaaaccctcctggactgaccccagcctccaccgctggatgggttgtgggcaacaggattccaactttcctatgtagtttcctcctttcctgtctgcacccaccatacctcctgtcttttccactcggaagacccctctctatagagagagagctggttttctttattcttctgcctattaaacctcagcacaaaaaaaaaaaaaaaagaactgaagtcggttctggactcatccagggaaaatgtgctttaaatttggctgtggtgttctccagtggtcaaggagaatatgctattgatttgtgctctggcattaccactgcacactgacaggcagttcttttaaacacatacttgcgtggtttagacaatgtctgtgtatgactgaagcttcacttgaaatcctagtagttcttggaaatatgtgagctcaatgagctaaatatagtgccgacaggtatgagtgattagcatggtgctaactctgcatcaggaatatcaactttgtgtttccaatgctactttcaactttaaactcaaaggttttttatataaacgtttaataatacctatagcctttctattgggcatgaattcaaaacagacaagaaaataggtgtcttaaccacattatcactgctgatcaccaacaaaactgttaataatcatagacacagaaatctggatatgtcctctagtcatttaacacaatttttttttaaaaagtatatgtagcttttactaataaatattatataagattctgttatccattcaaatcttactttaagaaaaaagtcaatttagactaaaggccatgtatgtggtattatacttcacttttgataaaatctgattaattataaggcataatcttactttttcaggctgagggtcattttaagtgcttattttttccaaagaagtgaggaaaaaatgctgaaatgatttcaaaattcttacatgcacagtgcaaatttaaattgctgttcgaaattacccaagacccatcagaaaagaggaaaccacaggagaactagaaataaacctatttccattcttggaaaaccatcctgtacattaaaaaatgtcacgcttctcataaaaactggcaaataggccagtggaatagaacagagaatccaaaaacaaatctgcacatttacggtcaacccatttttgacaaaggcaccaagaacatacattggggtaaggacaccctcatcaataaacggtgctgagaaaactggatatccatatatagaagaatgcaagtagaccccacctctcaccacatacaaaaatccaatcaaaatggatcaaggacaaatgtacaacccaaagctatgaagctactagaagaaaacattggagaaatgcttcagggtattggcccggcaaagatgtcttttgagaagaccacaaaagcacaggtaacaaaaccaaaaatagacaaatgagattatatcaagctaaaaagcttttgcatagcaaacaaaacaatcaacagagtaaagagacagaatgggagaagatatttgcaaactctccatctgacaagtgattaataatgagactatataaggaactcaactcaatagcaaaaaaaccaccaaaagcaggaaaaaaaaaacaaaaaatgggcaaattaactgaataaactgaatagacatttttcagaagacaaatgcccaacacatatatgaaaaaattctcaacatcattaatcattatgaaatgcaaatcaaaaccataatgagatatcatctcaccccagttaaaatggccattttaaaaaagacgaaaaagaacagatgcttgcaaggatgtagagaagggggaactctcatatcctgttggtgagaatgtaaattagttgagctgttatgcaaaagaaaacattatgaatgttcagtgaaaaactaaaactagaactaccacgtgacccagcaatctcacaggtgggtatgtatccaaaagaaaggaactcagtgcctcaaagagatacctgcactctcatgtttatcacagcactattcacaacagtcaagatacgtaaccaacctgtgcccatcaacagataaatgcataaagaaaatataatgcatatatgtgtggtggaatattactcagccataaaaaagaataaagtcctgtcatttgcagcaacatggataagcctggaggacattatgttaagtgaaataatccaggcacagaaaggcaaatatgttatgttctcactcacatgtgggagctaaaacaatttgaggtagagagtagaggggtggttatcagcggctgcgaacagtagtgggggatgaagagagcttacttaatgggtacaaaaatataattattacgtacaattattatgtatcaataaaactaataaattgaaaatgatttaagttcctaaaacttgataacaaaacctcagagtaataatttttcagtttatttttttttaattccaatagaaattctattagcagaagataaaattttaaaatggtaacaaagggttctgtgcatatttggatacatttaatatataaaaacaatcccattcattggcagtccccttcttacccgccaaatacttttttagaaacagaaccacacagcccatacaaattcctggtttactagaagtcggtgtagcgtgtgtttcactatcctgcatatatcccctatgcggacaggggcagagctgtgtctaactaccaaaaacccacttggccataagggaggtggggccgaacatgtcctaggaacacagctgtattctcactacaaggactactccagccgctgtcatgggggcagctgcctgcgggagaccaccaagatgatgcagtgtttgtgatattcatgttatttctaatcaaaggaaaaaacactaccatgagggctggtgataatgttacactgaaactaacaaagacagggaaaggtacctcatgtgccaggtcctgtgccggggactttccatacactgcgtcctttaatccacacaccaactccgtgtgggaaacacagcagtctacccagcagtatactaccctaggagggctctgataggttaagtaactttcttaaacttagaagagaggactgaaccataagcccagtccttgcacttccgcctgctgtgaaagactacaggatttaagttttgtatcattatgacttagtgtatctggatacttggggctctctcagactgatcttccagagagcatgtcccccgcctcgccaccaacagtccataactttccagacttttaaagccctctgggttgtaacaaggtcaaagaattgccgttcaatgcccaggcagatacacaaaggtccagagccactgctttttctatagcaaaacgcacaggatcactcctggctgtccctcaggattttaaagtgacatatcacatgagccatacttcatttcttcacggctaatgtccctccagaaataccagaaatcagtatcataacaaacctaacacacatcacagttcccacttttcatatctaacctgcatctaaatctgctgagcgtatctcggagcctctctccagtttgcctccttgccattccctccctccatggcggactttcctcttctgtggccctgagtgtttacggcaagccccgcattggtatctctattagaccctctgcccctcccagtgacgtcttgatcctcttctgctcgggcaccatcttcttcaaacagccttctctggtcccctcagctgaactgcaggctcctcttctgggcttccaaagccccgtgcacatatcatcgcatcaatgatgcccagcactggaatgtgtttgtctgtctctccccacaccatgggcttgcgggtggctagcacaaatacaacttcatacttctttccttcacaggaagcaaaacaattcgaaacaggagttaagactgtccaggagaaaggggaaggagcccatggccatttcgtatctcttcatagctactcaatcattaatttaacaaataacttatcgaacttatactgtatgccagataatgtgctaggcactccaagggcagaagtgagtgcacacaggggcaaacaacacagcagaggagtcagcacgcaaatgtaatatgcaacgataaggtgcagacaagcttctttgggagcacagattaggaagacaaatcatgtctaaaggattcaaagaagactgcacaaaacctggacatctgagcttgggactgatgcatctgtgggagttaaccagtaaaagacacaaggaaagggcaggctgacatcaaaaacaccagtcaaatcaatcaagccataaccaggccttaaacccagctgctttctttcaaaggagaaaagcagcccgagcaacacagtgagactctgtctgtacaaaaactcaaaactaagcctagcatggcggcacgtgccacagtcccagctactcaggaagccaaggcaggagcatcgcctgagctcaggagcttgaggctgcagggatccgtgattatgtcattacaccccagcctaagcaacaggcaagaccctgtgtcaaaaaaatacaagaacagtaaataaaggagaaatggcctgaacatcaacttcaactcctatttttcatagagcagggccattactaaaactcccttgaaatatccatacaaagacaccttctatcaagccatgattatagtattttcttcaatatttattggaaattacataaaatatttcccccatgaacagcacacgtgcaattctgtgagaacagagtaaataaaaccgatatatatcaaacagtaccttttctgcagttgagaggtaagcaaaagcatcctctgtttaataaacaagaaaaaaatgttaaggaagaatgtagaataggttgccaccaaatatgcaaatgcattcacgcttaatacctattcttagctgaagtgtctagaggttgctttgtgtcttgcgcatcaatctcagagcaagcagaatagatgatctgaaatattaatcctaaacgggtcttgccagtgggcagctgtgggctcgcagaacctctgtgtagacagtctcattacctacttgttcaggcctctttgctggcaaaaagtatagctgaataaacagaaagacaagatctgcaatgcctcagcgctcagaaaattatgacgatgggaagaatgaagctctgaggtcaaaatcttttaaacagcaataatctttgcactacatcagacacctggcaatctcagtccattgtacttatgggaatgctttttagatgttctgattaatacgggtacttgggagcctaaacacaaagacctaactagaatacattgcaattctgagcctcaggcaatgtatatgaaaaagataccagaactaacttttgttgaataaaaggattcacggttcttgcaaatggttatgattgtaacaaatgtttatcattgtaacaaatggttatcattgtaactctaattccagttacgtgacaacaagtacagtttatgggaaaagacatgtgcaacaaccaccaaatgatctgtccatcttaccaaagacaatgaaatgatgagtccctgctagtttctagatattatttatccaagttgttgatttgtaggtgctcattccattttctcctacataatccagtaatctataatccagtaagaaactcacaacatagacatgcaatttacagtttctgcatagggtcattaaaaattctttcattacaaagtatttcttggattcttaaatatttggaaaatgcacaaaacacgtgaaaaatatagttgttcagacaaagaaacgtcattctgatctcatgttttctccccaggaacagacttcacagcaatccattccctttacatttattgtttccttaacttgcaccaagcctgaggaggtcagtgcttggcacacattaagaaaacaataaatagggagggggttacaaactatgctgattccctgttctatgcctcactctgggtgaattcaaccgtctgaagggatagcaaagtcagaagtatgtggcaagcagcaggatgccgagatggttccagctcagacaaggttccaggagagagagcctacccatctttcccaggccaaaatgttttccatgtaataaaggtcaccagtggttgccaatatgcgtatacgaactatattggcttggtcagagttagctggaaaagcaaaagctctgtagtactccagagttctcagatagacctgtccaaaacctctcattcctttgttccaacctttaatttccaacccccacaatcccaccccagtttccaaccagtactttcaccgagagggctgtaccactgcctgagaagtcacacaataccttctgcttcgtgaccaactcagacttggatatctacctgctacctatcatatcaatatgatgtagaggagtgtccggggccctagacctaaatcactttgtgtggcacctgcatcagccttccttagtgacaatcttaaatctagttggttttctttgagaatttatttccttcccaagtatatttctgtgattaaaattatgtggtgtcagaagtttagtttcaattatattttacagacacccgtctacattaaatttaccttcttgcttttccaccatccttagttttgtcgtagtgtttttgttgcaaccctgttcttccttcctgtgtctaattatttaaaaattaccactaaactgatttttatattttatttccatcaagataaacaagatacaaatagatgccctcaaaaaagttaatgatcaattgggtaaaactatatctatacccgcacccaaaaagacaacataattcaatgcacacatgcaaatcaagaacaagaaagatgatggaattagctccaaaactactaaccttcacattaatctgcctcttgcatgtcaatagtttatttcaaatattcggtccctgtcaatctaagaaagtcctaaatccaaagccctgcgggaatgacatgagtttcctggtgtccagcacacgttcgaaatcctgctgtgtgaagagggttcagagaggccaaaaggcaccattcatggactttaggagaaaatattttgtattttgtgcatttagaaaaaggctacaatttgaatgtttaaatatttaaagccaataaacaaggagctattatttaatttttaaaaaatcttttttcaaatttccctggaatattttatttcatttacaaaataaatgtatgaagatgacaaaatcttagaacttttttgaggctgagtgacacactttatctatactgttctaaattttacattaacaaaattatgttcatcacttagaatgtgacattgtatttagaaagtcagcttcccttgtcctattaaaatggtatttagattgtaagtattttattatactcaacttttcaaaaacataattattatataaagaaagatatgtgtagttatatgtacatgtatatacactcacacacacacatttgtaatcctttcaggcttacacataaacacatgttaaaatattgaaaagcagctccaaaaataactaaaatgtcatttgccaaactacttctaggctatctctgggaatagtagaatttttggtcataaaaggaacaaaacatttcctattttgcttttctcccacccttttccagccaacctcttctaaccagtctccatctttaaataatgctagagacctacaatagttttcaactatcagatttaatctctttggttgtatcagactgataagttgaaaataaatggtaatagccagtttgtgtcgggcctatcgggcaagttgtttcttcagaataatattcaatttgatacgtattttgaaacaaacatttactttgtttcatggccggctgtgaataaacagttctctaagttattagtgaagggacagcaaaatttgaccattctatctacccatctgcttctctgtggcaacaaactgatttccatgggacgcttgaataaagcaaggctgtctgtccaaaagaagtagaactatgtcctcaataggcaatggaacaatgactgacactgagtcctagcactgtcaccaatatcccgaacaatcaagcttcaaacccaaaaaggtgcaaataaaatttaagactagtttgggtttggtcccaatggggctaagaaaaactagtgattgttgaacactggattcactgacaactggagagaaaaaattaaaattccaacattatgatgtcaataataatttcatctgcagcaacattcaggaagctgatgagatgatcctaacgggtgatttaaagtgaaagggaaaaaaaacacccttggcataatttaataagatcttcagactgaagcatattcaagggtttcatgaaagaccttctcatggccttttaatagctctttccaattccaattaactggttaaatgccaattctcattacctcatcagaaatccaaagccagtcttttctgattaaatcattaaataactgttaacagtacaatgactagtaagtatttatggacagcccagcactgatatgcagctttcagttctccgtgccaaaggaaaaactggagtgggcgatttaaaatcataataaattctattcatcttcggaatgtgctaggatatatttatctaatatattcactcttcttaattgttttactggcactaatacatagattgggaagacaggcatgatggctcatgctggtagtcccagctactttggaggctgaggtaagaggatcccttgagcccaggagttcaaggccgtggtgagctatggttgcgccattgcactctagcctggtgacagagcaagacttcaacgcattaaaacaaaaaaaagtttattttagattagtataagcttttcatactctctaaatagactgcagaaatgatgattaaaagggagttcatttttgtggaaaagccaggtaggtagtgaagaaatgggaaaacatgtcaactgtgacctgccgctgcctggcagcatgacgagtcagatggccccactcaggagtcactccaaggcctgtggacgtctccactgggcaattaccacaccaacaggcaatgcctatgtcaactcataccaaagctcactttttccacagatctgcctgcaacccttgctttccctcctccctgactgcttgctgacgctcaggactggacaaacatggctcaagagaccagggttctggttccaagtccaagcttgtcaccatcctcccaagacagaagatattcaccctcagagttggaaaaggtcggctctgccacgtcctctttccttttgcacttttattttttatattcctgagcatcctgggacagagctcctctgagaaaatgaatgcgactctccagaggacgatccacagcaaacccaaagcctcctttgcttacaagttatagaaagatcccacgaacactctattctctatgcaacttcttgtccatgcagtcttaccatgaggaggatattatcatggagaaaaacaggctttgacttaaaaaacaaaataaaataaagcataatcaactaaaactaccatttaacttatgctgtaggtcactgcagcaaagaaatgatcaagtttcagtatcttccagaaactagataaatcgtcatagcttgtttaaatgaatacatcactagtaatatgtatttttaggggttttttgtttttttttttttttttttttttttttttacagagtaagacgcttataatatgtgaagttctgtccacagttacctgagatgttagggttagttgagcttaaaatagatacttccaattagaagcagccaaatataattttttatgtgagaaaataactgcaatgctagtatgaccctttattttcctagggctaaagtcagaaaacagaaacaaatataaaagtatcacattcatgtcaatggcttagtgaagacaggaccttattatcctttaaatgctgcttaaaatgctcccagactcgcccgtttatctgctcctcttccagcagagtgtctggcacaaaatggctgttccttcaatctctgccaatccccatccacatctttcaactggcaggaatttccctaattaaatgctacctgcagtatttttatcacactctcaatcatcactgtacttaaaagcttagctcataactgtcttttaatactttaaaaaatatggcttatgtaaattttataaaaatcatttaattgtacattgaaaatggtattttatggcatgtaaattatgttcatatgcggttaggttcttgttctcaagttatttcattttgcttctttttctttaaaatttattcaacacaacagttcaaggaatgaaaagattccctctttttctttaacatcttttcactcttcccggtaggcaagcgtaagataaacattaagtgacacataaattgcctctttctgtcttttgagctcaatgccctgaaagcagcccaatctcctaccttttatgtttgttggtaaatttaaactgaagaattaaacaggatgcaggtgtttgaaattctctttgttcggcctacgtaaatacctccattatccattttaacaatctattcctaaatgctgatgattcccaaagttctatccggctttaatttctccacagacctttgcatctgagtacataactgcctgctaaagatctccaggcacctcatatggtttctggagctgaactcatcatccttcttcccagcacgcacaggctcttagcaatgcttccactatgtacgtagctcaagcttgaacctgtgtcacctcgaactccttgcctctctcctactttctgacttgaatccacctcgatgtcctaccaattttactttctatttattaactctttagtctgtccccaatattgctgctctagttcagattccaaatatttctcacctgaaccactgcaccgtctctcaggtgtctcccttcttctctacatctcagatccccttctccataatggccagcacaatcccactgaaactccatttggttgcttacttctccattaaagggtaaaccctttaatcgctgttcctctctttctcactcaaccacaaattctcacatgccatatagaacccagcctctgagaatctggccccagccatctcttcctctaaaccctacagtcccttcttggaatgtctctcttgttttcaccggctagcacgttctcatctcctaacagtattctaggccaggcatggtggctcacacctgtaatcccagtgctttgggaggctgaggcaggaggattgcttgaggccatgagttggagactggcctggccaacaaagtgagaccttggctctcaaaaaaaaaaaaaataataataataataatcctacctactccggaggctgaggtggtattaaacccaagtgtttaaagcagcagtgagctatgatcatacaagtgcaccccagcctgggtaacagaaggggaccctgtctctatcaaaacaaaaaacaaaaactattctccttcactgacattcatggccccacattctcagcaagatttgctaattttgctacggctcctgtgagcctatccactccaaccacactgctgtatttaagtgcctgtcctccactttaaaacgtgagctacctgagggcaggatttatgtcttgtatttctatccacaactcataatacaatgattcttacaaggtaagctgtcaataaatattgaagaatgaacaaatgaatatagggagttcaaacatgagaactaaaggtctatatcagaaaactgtcagtcaagattctagctgttataatacagaaggccccatcacattccccaagacaaatttatattttcccactgtccttaattttatttcttatactctcattcctgaaataatgttgattattttgagaacagaatattaaggctatcgagagtgatgcttctctctcctcttggatgcaaaaattatctgtatcttcatccacaggaaaacatgtccctccctgtgattcagtttgtccatgtaaaaagaaaaaaaaaaaagctcgtgctcctcacctggccccccatctcttcccaaaccccactcattcactttcacctctgagacagccctcagatttattccctcctctaaattcccagagccactgctatagttgaggtcgttatcatctcttatttagactgttttgacaacctcttaactaatctctccccttctagtctctccctttcataacccactctttatgcgcctgggctctaaccaaaactgatcatgccttaaaatcttctcatgtgaataagaaaaagctcaaaattattagtgtgaaaatcaaagccttatactgtcttgcttcattctacctttctaacctcacctccctgggtgcattctagaacccacccatctgctgatcacttctcagcaggtgctgtgtgccatctctcctcatttgtgctcatgcttttttcctttgactttatccctctgtcaccctgaaaactccctactcatccttgaagaaaaccttgttcagatgggccattcttctataaaacctttcaacctgcccaattacaaatcatgactcttttcagggtttctgtagcatttatcttatacgcctggtatggaacacaaactattagttctagctccactctaaaatgggagctcctttgaaagaaaagtctatgaattacacatctttgaatattcactggctgagataaggcaagaacaagtcttaccactgaattttcaggagcacctaacaaagctccaagatggagataaatttgtggaataaaagaatcacccacttgtaagagcgaatatgcagaactgggtaaatgagttaacataaaatactttgaaaacataaatatgtccaaaatgatttaaacatttactgtgaaacatccctggtatacaaagactagaacggtgctactcagagcatgctgttcaccagagactgttgtggatccactgtgaaataagaaacaaaataaaaagaataagtatttagaaatttctacagcaatgtgacacggctgatccatcaaaatgcaggctgagtgggctcgtctcctgggagaaggtactggctggttcgggtcttgtcgaacttgtgtataaaagtgacacatggggcaagagctgcaggctggtcatgttgcaataggacgatattcgtctgggacagactggaaatggggggaaaaataacacaagcctttcgcgagacagtttaaaaagcaaagggagtaaaataagaaactccagtgtaccagaaccaatttcctcatgtttaccttccatattcgcttgagacctttcctccccatgataaaaaaaaaattatagatacagttgaaaccacctctatgtccttccccaacccttgcgttccccctcctgctcctatatcattttttaaataggctactgtcaaaggaaaagcagagctggagagcagagcaatgaaaatattttttatcaggactacagcaacagggggaaagagatctcagtcaagaccccaggctgaatccaaacacagcatcggcaagtgggaatttatagccaaagaggagggtggcagtcggtgaatgaaaaattattaagaggcaaaatcacaggtaagaggacattctggccacaccatcctaacaggattcttgccaaagacaggccaagatgatgacacatcacccgatgggggatgaggaagccgatcagacactgagactgatcagatatgaaggactggggttctggctaaattgacttagcagggtccttgctaaaatgcacagatgggccctggtggggacagagttcaggaacctgactaaagtttagaaaagcaaagaatctttgtcagcaccaaatcccgtttaggaggatgaaattttcctgttgaggattagggtcatgttttatttcaccaaaaaaaaagcactaaaaatgaacaatgatcaatgttattgtacagactctagcctgctaaatattatgtgaaaaggtgctgtgcccccttgtctgtgacccttcagccacaactcatacaactcaactcctgaactccaagtgaaaggccctgtgctgccccaacctgcagagggagaaacaccttactgaaatgtctacaatttggaaagaaagactaaagagcatgttgtatggctgtagaaagaataacacagacaacggatttattgctaataaaacagactaagaacaatgggctgatgagacttaactaaaaagatgtttattccaatgttagaggttacctcagagaagacacacagagaaaagaaatgcccgaaatgccaggtggaaagtaatgggctttccacggttaatcaaatgggcactgccatgccaacgtgcctcctgaaattcaaaccctctatttttgcatggctgccaactcatttccaaaacatccactgctaatcaaacttgtttggctgcctccttatcgaaactttacaaaactttaatttcagcctcatgagccctgcagctgtaaattaattgaatgaaattgacaaacattatgcagtgagataaagcactttcaaagtcttttccctattcagttgacttagctgcccagcatgccagttttgcttgacatgagttcagaatccctggaaaccttcctaatcctactctctaggccttgtgcctattcatggaaccatgttaacccatatccggaaaattaataaacctcggatgggtttaagcactcaaaatactcctgatacttcttgccattcattacattgtagacatcctttgcaacaggagaatcctcctcaaaagaccacgacggcagcagataaaatccctgaggttataagcatacaacaaaatgtctcatttaagattactgcagtctgaagccaggaattaaatttgctgaaggtgcagtcacttatgccttagttaaataaagatagtcccaaaactgatttctgaacttacccatttctcaaagggagtgcaaaattatcatgatttttaaacagcaaggcgagtaaactgatcgcctctgtatctgccaactgaacaaatgagtcagctaatcagtggttacatacatcacactgacagagaggagagaagaccattaactttctgaaatgagaagtcctaatataccgaggtgccacaagtcacttaggatttccgtggttatgaaagaagaattgaaacgtctcttccctctggtgggttttcacagcacaactgccacagcttccaactgaggtctagtctctgaccttccctcttcatcaatgttatcagcatctggaagccctctggcctatgtggagccatggggacaatggaggcagtttcaaagcttctgtcttatgacagaaaacctgggtgtaaaacaacctctgatatgaactactaagggacttgtatagattccttaaactctccgaaacactgttctcaacagcaaagtgaggagaaaaacagctctcaagtagggttggtgtgaacgtgaaaaaagagaaagtaatacaagagttgggcatataataggctcttaaaaagaattttgaaggccgggcacggtggctcacgcctgtaatcccagcactttgggaggctgaggcgggcggatcacaaggtcaggagatcgagaccacggtgaaaccccgtctctactaaaaatacaaaaaattagccaggcgtggtggcaggcgcctgtagtcccagctactcgggaggttgaggcaggagaatggtgtgaacctgggaggcggagcttgcagtgagccgagattgcgccactgcactccagcctgggtgacagagcaagattccatcgcaaaaaaagaaaaaaaaaaagaattttgaaatggaaatgtatctatttttcctttctttagaaaacaaacagaaaatgaagccaacatatctcatcacagattgctctttaaatatgcgaccttataccaaaagcagacaagttcacaaagagattatttttataatttaatcacagaaaagactagactatcaggtagttggtggctacagaagtgactgctccccactgaagcaaggaatggatagaataagtccttgaaataaatgctcaggtcttcccttagtaattctggacagtggggaaattagctcattcaaacaaagtttattaaataaataaaatcccagcacttgtctctttagacaaaaaccacatggaaacaatacaaaagattgctaatgctttggcaaatgaatcactcttccaaatgccatttacaaaagcccaccagacctccagctgtgctgatgccatgggaacccctagggcaattataagtggatttaactcaagaccagaaacacaggagtaatttttaaagacccaaaaacttccaaataaataaatctggaaaggaattactgtttacaccacagagccacaggttcaaatagccaaacttaaagaagaaaaaacacacatgtatatatctacttcatcatgtaatctctgaacaataggaactttactgagttgtcactaaggaaagagcaaaatctaagataggtagtttctggaaaatgaaagtccagagaaacttggccataaaatgaaaattataacggacttacagagctcgtcttctttgggttaagaaacaaaggtcttcttgtgcaaaggaagaattcgaaagaggaattcttaagtagatggctgatgcatccacgtctaaacatccaaaatctaccaagcacctattacataactaagccctgtgtcagaggctgtggaacaagaaccactaaaacttatctctgacctcaagaagtttatagttcagggaagtgactgacaatcataatacagaggcataagggctatccaaatagggtcacaggttacgctatgaatacaggtatcacatcagaaaattaccgtacttaaaatctcagcaaagagatcacaccctcacacaattaatgttatcaacatccatccagtctctcaagctcaccctcttcaacaatctttgctttactgagttccgggtggactatttaaatatcatacaaattgattctgacatcacaatcactgcctgcttcctaaaacttgccctccaccgtctattataaatgctttccaatcagtgctcccattcttcattctattcaccacttagttactagaatgtttttctcaactatgaatctgacttcactccctttcttgaaaacctcctgtagttcctgttgtgtacgggataaaggtcagacaacttagtatagcccagctcagtccagctagcaaagcaaatactagctttattccctgcaagcaacgtaagacaaagacaaccacactaaactcagtattagcagaccaccatcctccctgaggcctccactgctttgcacacactcttctctttctcagaaggtcctttcccctcctcctgttggtgcagccaattctttctcttccttctaatgcaccatcttctgtgtagtcttctttgacactaggtagggttacatctttgctctgtgtttctataacactcttcatatgccatggaactgcattcattatattggtataattttatttgtcttttttcttcctagactgtgagcccctggagttcagggaccatttcttaatcatattccagaacctatcacaatgaatgacacgaagaatatatttgataaaaatctgatgaatgaaccactctaaaatgcaactctaataaagaaaattactgcctattcagttggaactgtaccatgttacaaacgtaaaattatgtatagtctgataaagaaatactataatagccttggaaacagctcacatacaattttttttataaatggattcattaccatataactggaccagcttactgaagagtagccctacagcagtcacttcgcagtttgcaattcatttgaggttcaaagctagctcaagggaaaacaacgttagtattaacaaacttatttttaagcttaaggtcagaatttaagggaaaataaataaatatagtatgttctaagaatccaaaggaatttttaaaaattgccccctgcagctgtaatttctgcatggatgagaaaaccttaattgcttgctggcttccaagaaagccattaacctgcatttaaaaattcagctttcatcaagaacaacctcacatatccagctctcatggaaaaaggaatagaagcctctgacctagttttcaattattaccaaactactgataattgatctcctggtctccaggtttgtttgttttactaaaataaattccctctggagctgcaggtgcttaccatggggctgcgcaggtggaaagcagcccagtcttactatgaggatgtccgtttgccatctgggaacaaggaggaagaagcagagacctgggcaagacctcagagtaagtgtcctttttggcggctcccaggggtccccatcatgtgttataggaaggcagaattatttgagataaggataggagctgaaataagcagtgctaatactggttaaaagttggtgcttcagctgcagtcacaacagataatgtctcttcagttatatttccaagctatttctcatttggcaatgtacacttacaccaaaactgtgaaactctcggaagtggcagaccttggcaacaagtgaatggaaactgtgaattacagtacatgccactgagtaaggggtgcacatctagaaaccagaaatcaggttctgtcttggctcagcgtctaactagatgtgtggacttagacaagtcatttaaccattggggattcagtctcttcatctgtaaagagttcatttagatgatctcttaagtccctaagatccccattgttaggtccagggtcaggttccagcccatgctgaggccggaagggagtgggtagatgaatggcagacagctgaaagaacactcagggggctacgggtaggtgaaatacaattttattcagcagctctcttacactgtgtgtctcggctgcttgttccagccactcccaagcacagatctctgctggctctctctccctttggggtcaacagcttaactctttccctctgagcgcaagcaagctgagctgtgtcctggctccccgctgcaagacagacagatctggtgctctctctctttctttgggtgcaagcacgcctgcacagtgtcaccagggcaattataccttttaaagacaacagtggcaaagagccaagtgatggccctcccatgttatggctacatagctgtttatattacacatggagttgcgcgcctgcgctacagacttgctgagtcacccgggatgtttacctcagcccatcctgcctggctgcagtgcagccatgttccttacacctaccaatttaaaagtactgtaattccattttaagggttctaaaccatgaaccatgttcatggtttaggattttagatatttctcatttaaacttaggagcgaactctgcattaggacatttctcctttcattgtccataagataactcaccaaatccttgcgcaaagagaaacaaatataaactacataagaaatgacaggtgagccttaccaaggaccctgacccatgcataacatcttagtatagcatatatatatatagtatatgatagaaacatgccgtgggctttcataccctctacaatagttcattataagtttcatcccccaaagaaggcaacttacatacttaagtttttctaaatagaatccaggtgctttcaccagtgatgctctccaagggatcccatcatagtaatcagtctagccagtgccaacttcagttctactaaatttaatgccctcttattttgactcaggaataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaaggtgtgtatctttcctctttataagccctctggcctcaggaagactggtttcattcatgtggtcatgtttttgcacagcttaagactaaactgtatgatccttccttctgggctcctacaagggcatgccaaagtcccctcaaataaccaaaacggtgcacatcccctttgcgtcccacagcagtctgctagtttatgtaataccataatgacagctatctggagtggaacagtgacactgctttttcccagactacttcaccatgtgaggtaaacggtagaggcagcaataggtctgctcagtctatggctaatacaagaccttgcttatgatagacttcaagagcttcttattagccagctgttaattcatacaaactgcacagaaattcattctggagcaatattatttgtttcacattatacttaaccttgaaaaggttagtttttcaatgggggatgattatcctggatagatgcataccccctacaaacatgaaactggcaagttcactaaagatttctcaagagccaccaagctagcaaaagtcgcaaccaaataatattatatactctgcccttcagagcaaccttcttcatgctgaagtcttcagttcacagaatgactgacttattttcaaaagaggaaggctgtattgcatattgtaactctctccaaatctatacttatgagctaattcttcaaaaggtaagatcaattaccacacagaaggagaagccatccattttcttgaagctgtcaaaatttgagctgtctcccataggatttccactgacagttaatgaaaaaaatcagtatctgtcaattttggaagaaatttaaaagtggtaagatattcttataaatcgatgttaaaattttggtataattattgtatatttggattactttatttgctttcctccaaatcatttctttactaaatttccctaagttagcttaataatgaggttttcttaaggagaaatctgttggttatacacataaattgctaacaaaaaagggatcagagctaaatggatccaatttttcctccttcatatgctacaatacaaggctactgcagaatttacaccgtgaataatgtgtattttgaaaacccaagcttagaatagtagtattttgtttcactatcaaaagacaaagcaaaaaaataaaaaataggctacactaatgtacttttaaaaatatacttggaaaagaaacgaaactatttcatttaatgctgtcttatagaacagaaatgccaatatatttacacagaaataattcagcatcttgaagtataagtaaaaacactaatgaagaccaaatttttagagttatttcatacaaatagaataaatttaggcggggcacagtggctcacgcctgtaatcccagcactttgggaggctgtggcaggcggatcatgaggccaggagttcgagaccagcctggccaacatggtgaaaccccaactctactaaaaatacaaaaaagttagccaggtgtggtggtatgagcctgtaatctcagatactcaggaggctgaggcaggagaatcgcttgaacccaggaggcggagcttgcagtgagccgagatcacgccactgccctccagcctgggcaacagagtaagactctgtctcaaaaaataaataaataaataaataaataaataaataaataaataaataaaatttaataaaaagagactacccattgtttccactagaattgctgccaagggaaatataccttttaaggatcaaggcttagaattgcttttcgcttattagaataaaatctatcagcaatctgaagaaatacataaacaatcagcaaattctagttagatggctacaaactaggtaaattactaaaatgtgccacatgaagataaagttagtcttggtaagaacaaaggtttcaaataatttttgctcttagatgtttgctgacagataaaatagagaacttcattttcaccaagtaacgcaaagtataaaaaggcatcggtatagtgctgtgctgcttttgttaaaatggtacaaggaggaaaagagagtatcttctaaagtccttgaatgggaaagccgtagtttatcacgtcgtattatcactttctatttacacagcatttgtttctcccacagacagggaggttcctgtggacagaaacatctgcttcctgcttatcctgtatctcagcatctgaatggtcatgactggaacacaggcagacttcagaaataaatacataaatatctcatactcctcgaatcttttagaaaaagagtgtgggtaacaataaacatatctgctgagaaatgaccacctcactctactcttctgcagacttcccattctgtgccgagtcaccctcagtaggcctaagtgtgacgatcctctcagcactccctgtaaacctatttaggaatccgcgaaagaaagagaagaccaccaggcagactggtgatgatatttcttggggaggctgtgcagtttttcatagtgaagcctacaacttagattttcagcactaatagaaccccattatcaggaggagagaaaagcactaatttcagatgggctctgacaggggacagttttaagaatttatagagagacatttccgtgtccagccaggatgtaatcatggaaattggatttaccttcccatccatgtgtaacaccaacatccagtggtttttcatgatactgaacaaaggcagcaatcactgagagactgggaaataaacaaaaggactgccccaatttattaagaaagcttccagaccacaatgaaggtaggtggtgtggagtcctgacaaggtaagttagcaccaacaaggaagaggccagcccccgatgggggagaacaattgttctgagagacagctaatcacaaacaacctgcttgtacaacatcctgttcccaaataccttgctctgcatataccccagcagcacaatcctctctgcacataacccctccagcatggccctagaaaacttcctttcagcccctgcctcttggcagacagcctcttctctgctgtgccggccattgcttcccgctaataaacttgttctcgtttttgttgttgttgtttcgagatgaagtttcactctgtcgccaggctggagtgctgtggtgtgatctcggctcactgcaacctctgcctaccaggttcaagcaaatcttgtgcctccgtttcccgaggagcttgggattacaggcgcccgccaccacgcccggctcatttttgtatttttagtagagacggggtttcaccatgttggccaggctggtctcgatctcttgacctcgtgatctgcccacctcggcctcccaaagtactaggattacaggcgtgagcctccgcacccggcctaaacttggttttaactcgcacctgtttcagtaaattatttacttcccgtgaagccagccttagccagtcacgctcacaacaagtagaagccaggcggagcctgaaggaggccctgagttaaggtgacaaagttgagagtatagggagaccaaaaaaggctagagtttacaggacagaataccagagaggaaagaagtgtacagggagagaaatcaacaaatctgcagaaggtcagccttaaatattccacggagtactaatcagcccatgcacatgaacatactgcctgaagctgggacaggaccagctgaaagagttagaggtaacagtagcaggtgctcaaataagaccacgaatactgcctgctcccatcaaccagagtagaaaacctcaaggttcaaggggtattgaatagaagacccaaagagccttgcctcagtgacttgccctacactaaatactgctctggtcccacctaagaaagattaaaagcaagaccccttcccctacacacactaaataaaactgtttccaaataacttcactgtgttacagggggaaaaaaagctcaagaataatttgagggatacaaaaatagctagtacccaaaaagataaaataacaacatctggcattcagtcaaaagtcgcagcttcaagaggacaaatacacgtgcagggaaaaagcagcatggtttcactggacggcagtgcattttcactggacagttgtccccagtgtcatagatgaggtcactgatgacagaaaagaaaaacatttcttgaagaaatcagacatattacttttatacaactagtgctcatcaaataacaactaccatacagagagagaatgagatgactagcactggaaagagataatagatgagccactgagtactttcaataagaattaattgtaatcatggctgggcgtagtggctcacacctgtaatcccagcacttccggaggccaaggcgggcagatcacctgaggtcaggagttcgagatcagcctggccaacatggtgaaaccccatctctactaaaaatacaaaaattagctgggcgtggtggcacatgcctgtaatcccaagctacttgggaggctgaggtacaagaattgcttgaacctgggaggcagaggttgcagtgagccgagatcataccactgcgctccagcctgggcgacaagggcgaaactctgtctaaaaaagaaaaaaagaaaaaaagaattaactgtaatcctatacctcaagcaccctgagatggacacacacacacacacacacacacacacacacacacacacacacacattctgctaaatactgtaccatgctataaatcctaaccagtagagtacagctaacacttcacttctcactttgtaaatcacattgaggaggtttctttcacagcttatcttatgaaatggggctgaaacaagtcaacagattaaatttatcaaaatataaaacacacataatggatttggaacagaactgcagctgtatcttcactggctctcctgcagaggaagataccatataactcaatgactccttcttttaacttgtaagtcagtgaaaagaggcactagtttcctgttaaccactaaaccttgtccattatcttaaacatagaatacatcaaaacacctgataggttttcagtgagaagccctcagctatgctatcttactgtcctgaatcacaggaaaagaaatatagaatattaatgagaaatagaacagctttcatacatagcacatataactagttagccaggcccatcaacatgacttggccatcatttacagaaaaatagtattgctttaattaattaccacattttcaaaggttaagggcatgaaaccaatcagtcagcttaaaccttgttcctttcaacaaacgggaaaattttcacaggcaatactttaaaaataaaacaaaaaaattagactgctaactgactccaaaaccaaaattcagtcaaaaggcattaactcccctgaattttaacaagaaatgaaatggttttccttaaaaactcttactccagtggataaattataaatattagaatgaactgcaaaaacccactagagcatctgcttttctataaacacatagaatgtctactggaaaacaagccccactgaaagctgtactgaattacaaataatccactctacacttgcttgtcagatcttagaacaaaacacacaaatatatccacttcgcagtatctgtataaatggacaagtagaaatccgaatcatgttatctgaaaatgttttgcaatcatttttagaatttaataaataaaagataggactttccactttcatttccttgtagtgtatttacattgcacagcaccttccgttagaaggaaccaacacagatgtgggctttctagttggtttctctgctgcccccttctgcttcaacaaaacacagtaggcaggcaacccagatgccaaaaatacctctcgaagccaggtttcgcagaataaacaaatccaggatgactgattatctcattttttaaaagcattttcatattacaattgaaattatttcacgtgctttctgaaatctgatccaggtgtctggttatacaaactcagtaatgacaaggtaaggtttccctcccactcctgaccccagtgctcgctcttgcgcactctctctctctcccttcaacttagaaacccactatgtcatgcaggcagccagaaacttcaagaaccttttttatttcaagttccagggtacatgtgcaggatgtgcaggtttgttacgtaggtaaacgtgtgccatggtggtttgctgtgcctatcaacccaagaatcttttatagtaaaaacataactactttaaaaacttggttctttcatttccgaaaaacagtagaataacattatttctttgcattggtcaaattacatattctttctgtgacagaatttctttctgctaggaacttaagagataatagttacaatatcacgatcatcacacatagtacaaacagtataggtcctaggaggcaaagaccaataactgtgtaatgctgataatgaacttttaaaggtaagggactacacaaacaatagtgattccgaaaatgctcagaatatatactgagcaaaattctctgcaacgaggtatataaacctgaagtgctaaaaaatttcacaaataattattttaaatacacactaaaggataaatttaaggtaaaaacagtagctgacttttagtttatttttccagaactcaaatgtcaggccaaaaaagtcaaagcagaaaacatcataaatgatacctttaaggttattcaaagagtgggaaatatttttaaagcaggtgagatttttccaagcagaaagtgcaccaaatactgaaatcacggaagacagaactcaactccattcctcacctcaaatgcaccgaagacccttagagacaccctagaagcctccattaaatcccatcaggaagttgcatgtgcaggtattatgtgcaatatggtgcacctgcaccccaatgatccaaatgcctcaagctagaaccatcactgacgcttactcaagaatgtcagcgatgggaaacattaaacgcacaaactgtggcgtgttcgtttctgctggtttcataccctttccaacaaatcctccatcctctgccagggaaatctttgtaaatcaacatctgatgagacacctccaggtgatgaaaaatgccagctagtctgaaatacccattctcccttcttccttgagactcccaatttttttttaaaatgtgtgctaaagagaagtgttgtatgaaacttcaccagaacttaaacttaaaaggtatgaggcacgtgctttttttttttttttggctcttctgcctttctttctcaatgcaggggtaatggctggagctccagcagccaccttgaaccgtgcaggaccttaaggatgaaagtcaggtgcagcacaaccaaaagaaagattgacatctgaggaccttctaaagatgcttctctagacttggaatacttccctctagacgtcatttatttttatttttaattttattatttttttagagacaaggtctcactctgttgcccaggctagagagcagtagcacaatcatagctcactgcagcctcaaaatccagggctaaagccatcctctcgcctcagctttccaagtagctaagactacaaacgcatgccaacatgcttggctaaattttttttttatttttggaagttggtctcaaactcctggcctcaagctatccttccaccttggcctcctaaagtgctgggattacaggcatgagccatcacacccagccaagacttctcctatttgagagtataaactgttgtatctttctgccactgtagttgggtctctgtcttgcagctaagtccaagctgtaactaaaacactcactctttttgttctttctttttttttttttttttgagatggaatctcactttactgaccaggctggagtgtaggggcatgatctctgctcactgcaacctccacctccagggttcaagtgattctcctgcctcagcctcctgagtagctgagactacaggcatatgccaccatgcctggctaatttttatattgttagtagagacgggatttcaccatgttggccaggctgatctcgaactcctgacctcaggtggtccatccacctctgcctcccaaagtgctgccattacaggcataagccaccacacctggcctaaaacactcactcttgaacaactctctatcacctaccagaagttctaagccctgctgcctcgccagtttcatctcctgccatgtacgacatacactatttttcttaagaattctattctctatgtctctatgtaggagaggaaaatgtttcttttcttacccatcagttcgtggctgagatccctataacaaaagacagattgacaagagaaaagcatataaatttattttaatgtaggttttaagtgacccaggagccttcagaaatgaagacccaaagaagcagggaaattggtctatttttatgcttaggtctgacgaagaccagagagttatggggaagtgtgattggacaatgggaatatgatctaatggtaataaattggggaaaacttagcaacgcctgtttgttcacattcttcttggtatctctctgcctttgaggataaggatggtctcttctccaggtatagagagtatgcctctggaatgaaggatttataacttgcttcaggagataaggatgagtagaagataagagcgaccttcttgcttctgctgtttgttctaatgccatattttggggtagcatgtccggaaccccatcacttatcatgctccaaattttcatagatgaggggtttcactgcctgaaaccagaccttaatccaccctctactgacctactaaattcctagtcccccttcctaaactcaagggtcgcttcccgtatagtttttgctgggcctctcttctccggccctactgaggctctcctcttcagtctttctcctccttccacagcatcccattcacagtttctacttgttggattcctaaacatctgtatatgtcttctacaaatcaatgggctcttgagttcagggagtatgttgtgtccagttctgtatcttcagcacttggcataatgcgtggctcataatgacattggctagatggccaatattttgatttataaattatgggtcacaggccagccaaacttgaatgtgatttattctgtgaaatcatctccaacccaaccatccctcctgtgtgtttccagacactctgaatgtatttggggttagttatgtacacatctgtcttccctgctaggctgtgagatccagaagggcagggagcacgtatcacacaagctggtacccccacctctaagcactgtgcctggcttacaccacctgctcaatcagtattttctcagtgttgacaaaaatgactacatgaaggatggctttctttaatctcatgttcattccacgttgctacagtggggatacaaaaacgaataaaacacatttcttgctttgagaaggatacagtctaagaatattagaaaacatgaatacagcttttaagacagaacatcatgttgtgtctgcaatctctagcccctaatatgtactaaactttaaatattttgtgatataaagacaaaacaaaagtaatattttactaggacattatcctaatacataatttctcttgctctatgagtattttttttaagccacccagtaaatgtgtagcaacaaagaaccatttggaagttattccctgtcttgcagactgagtcagatcatggctaactgatggtcggtcctctctcatgtttcttgttttgttttgtgtttagggttatttctttttctttgcttttcaccattactatgaattttgaaattccttccattttgcaaaaaaaaaaaaaaaaaaaaagctttcctaattattgttcattataactgtaatcttttaaaaatgaaagagtccaaaattcatctaaatgtctgttaaaatgaacagaagttgacttaagatacagtgtagtttttagtctacatatttaattttcagtgtattcccagagaaatagcagtgttgattatctctctttcatgtcctaaaattaatagcagctcatactgaacccgtctaatggaaggataaagacttaccctccaggccagtaactacaaaatgactgttgcaggaagtaggaagaacatatgctggaaactggttctaaaatgagtaatcagtgatgtcattatagggaaaagagtgcagcgttaatgacagaaaccgggcatatcatctgtgacaagagcatcacaatatagcaaagcgattactacagagttctaatcaaataaaatatcacaagataattaaactttccatgttcagaatgaaacttcagttaatacaacacctacatcctctggagtggtattcaaaaatagttcaattttaaaggaaaaactctcattctccaaaatttcaaatataaatatcccttgcagaatgaacaggaagaaaagactaattaaaaaaaaaaagaatctccaatattctttggagataagtagacacacttataaagaatgcagggccaggaaaggtagctcatgcctgtaatcccagcactttgggaggcagaggcaggagaatctcttgaggccaggagtttgagactagcctgagcaacatggcaagatcccatctctacaaaaaaatttaaaaaattagccagcaatggtgatgcacacttgtagtcccagctactcaggaggcgggggcaggaggatcacctgagcccaggtgtttgaggctgcagtgtgccaagagccaaggtcgcaccactgcactccagcctaagcaacaaagagagtgctgtttctcaaacacagagtcacacacccttatgaaggtgtattcgtatatgacagaactaagaattctgaaaactactacttgctaccatatggcaaattaccaaggctccgaacatctgtcatgtatttcaaaaatgattcactaaatattaatcccattacatgctaatgaaatatccctagttgccaagtaattttcaaaaatgcaccaactaattaaagaccaaatcacatatttgactaaaggacacgtttcatttaactcttagctggacactttcattgaactctggattgcccagtaaccaaatgtaagatgacattgtgtatggtgaccaggccgaactcagctgatgtcctaaccaaggacaccaaacaaacatgcccctgctctccgggactaatttcacatctgcactgaaaaacacaatgaagggcgtagccatgattaacttcaggccaatcaaatggctcccaaaagaggccaattttaaatctatggatcacagaacttcttcataggaagtttctgtcaagggaaaacatactttgagttttttgattttactttgatttccgtgaaacactctctataataccttatagagctaaagagaaaaattaagaggagataacagactgtcctttacaatgtactatcctcttttaccctgttctctcactgaaaattgaataacaattacaaagttcaaaatcacagatatctgacatttggaagtgccagaacacctttcaaaaaatgagctgaatatgttcaaagcaatccaaaattaaagagaacttcaaggtgcaagcaggtgataatctaaacggaagagccatctgatgcaacagcctacatcattctgcattggccctgcatggtggctcacgcctgtcatcccagcactttgggaggccgaggtgggcagatcatgaggccaagagatcgagaccatcctgaccaacaatggtgaaaccccatctctactaaaagtacaaaaattagctgggcatggtggtgggcacctgtagtcccagctactcgggcagctgaggcaggagaatagcttgaacccgggaggcagaggttgcagtgagccaagatcacgccactacaatctccagcctgggagacagagtgagactccatctcaaaacacacacacacacacacacacacacacacacacacacacacacacacaaatcattctgcactgactttcctaatggtggcagtccttgggttccatctttttatttttgtccctaataaaattgaagctattaaaattgtattacatgcttgtattgttttacataaggcagtatgctaagtccaaaatgcctaattaaaacattacaaagggatgcatactgtccatttttcttgtgttttttttcccctgagaaatgcacaattttacataggaaccgttaacgaaatggcaaccctagcacccaaagatgggactagtcctgcatctgctgccatcagcctttcttcctatcaacgcctcttacaagtcatgtctgtcatccttgtcactatatctatatctacgaatataccacattttctttattttaaaatctctccatttaagatcctttccacaaaagatgttgtcttcgtatttacctcactgccaatgcttaaaccatattttgtgtataacaaagtcaataagtgttgaattaatgatgaattatcctatcactattattgcaaaagcaactgttttaataagtgataaacactctctttaaaaagtacctttagcctgtgttctagtctcagtattgtcactaattggctgtggatttaaggcaagtcacttaacctctctagtttgtttcccagtctgtaaaatgtggagttggccaaagtgactatttaaaaagttccaaatgaatgaatgaatgaataaaaaaagaaagaaagaaagaaagaaaagttacttccagcaataaagactacagctgtacgagttttttttaaggttttatcaaccaaatcactaagtctttgaaggtaattaaattgcataaaatccaaagatgctgtccacaaagaaggcgaggtttgaatagagccaacttcctaacatgtacccatcacctattaggtgcaaaacactgagctagtcaatgtaagtgcaaaaaaatgcctaagactgtccctcagttttccaacctaatgagatagatgaatgagtaaaagagtgactacaataaaaggcagatgacataaggccggagagggacacaagcagcataatttaagacagaaaataaccaggtgtgatggcttcagctagaatatatcttggttgagaatgtatctgatgatcatacacagaggcctggacaggcctcaccccaggccacccatgacactgtaatagagtgatcttttctacttaaaacaaaatctgggcggatcatgaggtcaggagattgagaccacggtgaaaccccatctctactaaaaatacaaaaaaaaattagccgggcgtggtggcgggcgcctgtagtcccagctactgggaaggctgaggcaggagaatggtgtgaacccgagaggcggagcttgcagtgagccgagatcgcgccactgcactccagcctgggcgacagagcgagactccgtctcaaaaaaaaaaaaaaaaacacacacacacacacacatctggaatttcccttatggagttatgatgtctcaatgattacggaactttactacattggtaaagatgttgatggcagcatatttaacactgtgaatagtcttccttagtacttcatatattgaagttgaatctgcatcccatacccttcacaaacccctgcataatgaatactatttaagtcatcagaatataactttcatcatgttaattttatctgaagaatatgcactggctctttattgcctgttatgccacattcaaattcctcagacaaaatcccactgtacctatgtggtaaatggggtaaccatactatgtatgacaagtttctatgacaaagaaacttgagatttctagaaaccaggtctttcagatacctcttcactttgatatagataaactaaagaggaataaacaaataaaatttaaaatttttagctatttaatattttaaaagtaatctactgagtatagaacagtttttaaagttcagctgaggaccacgatttatgagctcgaaggaaagacatacttcgatggagtggtaacatataataaaagaccctttggtaaagctaagaggaataaaagaaagaatggcaatggcaaaaacaagagggatgtgatgacgatcagaagtggtgagagggatcctgaataacagacaaatatgggcaatatggctatgaaccttagataacgacagagaggaaaacagccaatcaagcaatcagtccatcaatgaaacatcaccaccaagaaaacataatttgtaattcgagtagtagtaaaaaggagtggcaactacctatccactgtatccattttatacacaacaaactttgaggaatctataagatgtattggaaggaagagactagagggttagaaaccatcggaacagcatttcagtatccccagaagctatcagccagccatctggaaagtgcttcaagcagaataattccagagcactaagaagcattacttacacacagcgcagtgccgtgccaagctaaatcatggagcaacacagcactgcagcttggacaggatccccatctgggcatgagcactgcaaaggagctttagatcagtggttctcactgggggtactagggaccattttcagtattttcaattgtcacaatggcatgtggtagactgtagccaggcctgctagacaggacagccttagataacaaataattacccagtatcctccaagtctttcagatgttccaccagacttgccggtaggtgagaaaatcctgttacttctttgaatatagagcctaactgtattttacttacagacacaagtgtttcttgcactgtttagtagtcactgaattatcaaggaatgcaacatccttaaatgtaaattgaagaggaattatactttgttttgtttgcaattgtaccaagagttgttcatcattgtgaaaaatcatgtcgacaattcatggcatttcaatcaccaacacaataaccaggcatcaatctacatacacagatgttacatttataggattctatgtatgtttatgtgtatacttatttactccttatttcaaagcttcaaatagaaagaaaagcttttgccaatactcagttgaatgttgttttactcctctttaatccaaatatattcattgcaagtaggtccaaacatctgatgacatcattttatctccaggaatagtcaacaagtaagcatttacataataaaatgcactgaaagctatctttctcttttctttatattaaaattgtaacactattttaatacttaaatttatgtgtagaggcagttatattattaatacatttcatttcagaaatgaaggggatattccaaaacacattacaaagatgcagcactgaatctaatagggttagtaaccactgctttggatgcacagagaaaccgtagagagcggattccaatgtatctacacaggaaggtaaagtgcaaaagtaccaaaaggtgatgctagctctgtaaaggaaaatatcatttgctcatgattagaagagagaaatacagattaatgccatatagaactctgaaagggcagcttttcctgttctttgaggatgcttggttattgtaagcggtcacaaggcaccagttcccatgccaacctgagtcaactgcagcaccaaaccatagactgcataaacacctcaatatttctcattcacagaaaaggtgagaacttttttgtcaataacttcaacaaagatgagcccaagtattttcagaaatactagcattttagtgtgatgatactgcattggaaagttggataaagtagacaaaagatagttgagaaatcctgtagaagaattctgtattttgttttagtattttgtttttaaggagctaatttctagtttgttttcttctatttctgttgtctgtaagcaaaaagaactaatttccttactggtctaatccctaaactcactgcagtggaaatgagtgaaatatgaaaaggaggctgggtgcggtgaatcacgcctgtaatctcagcactttgcggggctgaggcgggtggatcacctgaggtcaggagttcaagagcagcctagccaacataacgaaaccccatctctactaaaaatacaaaaattagccaggcatgatagcgcgtgcctgtaatcccagctactcaggaagctgaggcaggagaatcacttgaacctgggaggcggaggttgcagtgagccacgatcacgcccctgtgctctagcctgggagacagagcaagactctgtctcaaaaagaaaagaaaagaaaagaaaagaaaaatacgaaaaggagaggagattatatagctaaaatgagtgtaaacatagattataatttccagtattactattttaattattagtattaagtatgcatttattattatcatcaacttttacaaaatgcagtaagggtagaaatgtaggcgtaaagcaaagccctgtttggtagaacaaaatcctacttggtagtaacaataacaatcaaatacctccaagtcactgttgaaatgttgtcttctccacgaggcctaatgtgactttctatgtaaaactgcaagttgccccaattcctgcactcctcctccccatctctattacgatgttcagttttatttcatagctcttaccagtttctagcatacaaagtaatttgctcatttattatggttatagttgcctcctacctctagaatatatttctatgaggggaggaactgttcactatacagtccagcatgctgaaaagtgtctggaacagggtaagttaaccagtatgtatttgtggaaagaatgaacaatagcacataccatttactgagtgctttctatgggccaggcacattgataagtgctttacatagaaatcttatttaatttttattataaaagcctgcaaggtaaatattatgaatcctcagttcatagatgaacaaactgggatttagagagagtacaacagctgttctacatggtacagccagtgagcagtggggctggccctcaagcccaggcagtctgacttcaaagttccatactcgccacaacagaaactcagtagagctcagatactctttttctccctttagggggtgaaaggagtatctggattagtcagctccattgtgcgtgtgtgtgtgttgtgtgcttttttggttttgttttgttttgctttgagatggggtctcactctgttgcccaggctggagtgcagtggtgcgatcacagctcactgcagcctcaactttccccagctcaggtgatcctcccacctcagcctcccaagtagctggaactacaagcacacaccaccacaccctgctaatttttttgtatttttcggggttttgccatgttactcaagctagtctcgaactccagggctccagcgatctgcgcacctcggcctccaaacgtgctaggattacaggtgtgtggccctccccactgttgatcccattcttgttcattgcgatccttcaaaaaatatgcaagatggaagacaaggtgcaggcaggggacagatggggaatctttgtgtcttcaaaatctctcaattttgctatgaaactaaaactgctctaaaaaaaattaagcctttaaaaataatgtcttaatgcacttgtatttctgaatagttcaattttggggtcatgaaagctttaataggtaattgttgacttaacacctttacaacaatgaaagatttacacctaaacattacatgaggtaaaaggaaatttattcatcaaatacagtaaaaaaaaaaaaagtagaaattaagaatagagtaaagcatggttgacctcagcttttttgtgagagtttctattttctcatttggtgaaactatctttgagggactgacctttcgacattcagcgccatttcctttgactcctggcatcttctgctgcatgttcactattcaaagtagcccaaagggaaccaagacagtccacagctattgttttgccatttaatcaaacctgaataaagagcttgtacacataaggaaagtaaaaactcactagaggttacatgaaagaggctgccatggagaggactcgtctgttcacgtaacatgaataatttccccatcgagttgagaaagttctgaacacatttctttctctttttttttaaagactgaaaaatggatataagcccatagcacttgttagctagtcaagcaaagagtgtactcactaaatttgtgcatagaaacaatcatgatcccacagcaaaaaatacttccttaccatgcccttcatagcaggcattttgaaaactgaaaattctgccaagtcaaatatataactgtagctatgtctacttctgtttaaaggcagagagaagaggaaactaacaatactaattccataatttcagaatgagttgcaagtacaatattggaaagaatatcctcagaaaacaggttccccagaggcaggtgaccacagcaagtcatcaggagaaaaacttatatgttcaatttttctatcatcatagaattcatcccatcataaatggagggaactcttcaccttgagaggctacaatttaggatgaaagttttaacgtttaatatgtagacaaaattatcactaagatcatttagggttgtccaacttttcatgaagttcccaggcctccatattttcagtgttataaacacttgagctcccatttataagccctgaatccattttatgtctcccaaaaaccaaaatatttaaattaaaatacaggtagctcagattgactgtctctcacaggaagaccatttatgctaaaacatgctgattcttatagagtgactacccttttaaaattaaaaactgcatcagtgaaagaaaattacaacctatatttatcattcaaaaagaagctagaaaccttaagtaaaaacagggcatttttgttttcaaaaatccaatttttattctcgttatataacaaagaattttaatgtctccctaatcacaaaaagaaaatgctgtttggattaaaagcagtagttacatgccactcattgcactccagacagttctgacctttttgtaagagaccaattttgtatttcctttctcctgcctgaactattgcactggcttgagagttgggctccttccttccagtcttgactctctaatctatatttcatgccatgaacaagaattatcgttctaaatcgtcataatcatttcattctcctacttggaaactttaaacagctctttacttaatagagaataacgtccaaacttcatactagagcactgaagcaaccccacaatcaaacctcgtcttaacactcctagtcctgtacactacacacactctatgctccaaggactagaagcagataaagtcctttccatgggctcaggaaccttccttgtgtggcttcctcattccctccacttggctgctgctgaaatttaaaatcagcacatgttctacttttcccatgaagacatttccagttctcacagtcataattacttatgtcttcctttgcattcccaacacacatacattttatcttatcatgattagtattatagggggttgcctccattgccctatttccctctattgtgtgagatcaaaggtcttgtcgtgtttaattccagattattataacaaaacactgtgtacatggtggtggctcaggaaatgtttgctaaatgaaagaatgaatgaatcatgtaaacatccaatcagtcaatcagtaagaaggaataagggtgaaatgttgagtcaaagacaggactttgagtgcctgcactttcacttagaagaaccttaggttcttattcataaggctgaccatgcctgctctaccatgataataacaaggaaagaatatacatttccgttacttcatagtcaacccaaaatgatctgagatgtattatacattcccaacactgtgcggggcacattgagagacagaacataaatttcggctataactcttactgattgtcttttgtctattgaaatattcccctcctgactacacaaattgtttctttaaaaaggtgagtttgaaccacaattttatgatttatgcaatgataaagtctgacataaatttccggagaagtctagaactggttattaaacaatgatgaacacatatgaagacaatgaccaattaaagacagaacattttcattaaaatactttatatgaaactaaatattttcccttttttatatggttataaggctgaaggtcagaaaaagactataatgtttaaatgagaaattcttgatgtccttctgagcacaatgaagaagcacaggggaatgatatcagttatgtttgcaacacacccaaacagtatagactgaaaaatgaatgttgaaattcaatttttagcactatctctaatgggctgttattaagtcctggaattgggacaattctactaaacatgcccatcggcgacttggctgagatcataaaaggcatgcttaccaaatttagagatgacaaaaaattgggagaagtagtgtatatattaaatttatatatttaaaaaagctttacaagaaactcatcagattggaagacgggcctaaacaaacaagattacattcatccagattaaattccaggttctgaatttatgtttttaaaaaattaattgggttatgaaaaaaacaatccatgtacatggattagaaaactatatggtcaaataatctttaacaagagtgctaagaccattcaatggaggaaaggacagtctttttgacaaatgctcttgttaaaactgtttatctacatgcaaaagaatgaagttggatgcttacgttacaccatatacaaaaattaaagcacctaaacaaaagacctaaaactataaaactctcaggagaaacataaaggaagtcttcatggcattggcttgagcaatgattactcaggtatgatacaaaacacaggcaacaaaagtaaaagtagaaaaagtgggctacatcaaaattaaaactgctatgtatcaaagaacacaatcaacattgtgaaaaagcaatccatagaatgggagaaaatacttgcaaatcatttatctggtcagggtataatatccagaatatatggataactccaaaactcaacaacaaaaaaggaaaaacccaatttttaaaatggggaaaggactcaaacagatatttctccaaagaagaattacaaattgccaacaatcacatgaaatgatgttcaccatcattagtcattagggaaatgcatattgaagccataatgaggttgccacttcacattcactaggatggctactatcaaataaacagaaaagaagaaatggcggcaaggatgcagagaaactgaaacccttgggtactgctggtggaaatatgaaaggtgctataataaaaactacaaaaaacagtatggcatttcttaaaaaaacataaaaataattaccatattatccagcaatcccatttatgggtatgcatccaaaagaactgaatagtatctagtatagtatctagaatatataaagaactctcaaaactcaagtttgaacaactgaacatttgattgaataactttcccaaagcttgtcatttaaatgaacccacggcatgactgagggaaaagcagaacatcataagattccactcccaggctcgtgaagttactgaaaacatctattggtccaattcccaccaagttgggaaaggatgagaatgtttcccataacaaatctccacactttactcaatgaaaaacctgaaaaagtaaataaataaatacttctaaagacctgagtgttgttaaacttattatctaatgatagtatctcattgttccttcagtttttaatatagttttccttagttaagaatgtacaggaaaagaagggccaaaggggcctgttgcactgcttacctcaccagcaactatcttcttgatatatgtcatcacgattggctgatactaacggaagcaggggtgtggctttattaaagtgcatcaggagaaacatcttcttaaggaaatgccagcttttatattattttataagaagaaggagaaagagggagaacacatgtgcaagcgagctgaatgcacacacgctcaatgaactcaactactgtcaaaaaaaagcttgaaaacatttcactattttataatagccacagctgagccagcaaatgacactgttgtagctactatttatataattaaaattataccctaacatttcattttagaactccatattaaaccacttccatctttaagctaaaagcacttcaaaagaaatgtattcttgttatggtcaactaattaaaagtgcattgtatctggaccagaagaacctatttccatgcacaggctaaagacagcccggggaaatgactagtgaaccttcagataagatgacattttaattttcctttatatatcacatcgcctacacctagcttcataagcatgtcagctcactttgtcacctgctgtattacattaagaaaatgtttttattttcccaccttttcttctagaagtggcctatgactgacatttcaggaggaatagccttacttggaaatattctcttttataaatagtactcccaaagtctattccaacctaagctccacttcaacataatttaaaatgcagctttctatataaggcattttatatatgtttattaaatgccttataataaacacttatgtattcaattcagctagatcatgtatatgattcataagtaatctagataatttataaattttatacactaaatttaaattatatacccatgattttcatcacataaattaacacatactatttatatgcccctagcagaatatgcttcagaatccatgaatccattgaaataatatgcaaattttatatctgtacatacatgtgcttagctttccacagtttctcaaaagaatctgtgaatcaaaagaagttaagaaccactagtctattcccaaatgtccatcatattatttaaatataagcagcatctctgaacaggagacataagaccctctgacttttagagggttaaataaccatgcagctttccatttgcatctacacctatatgcaactgaaattgattgaccacattttcttcccccccctgccgcttttaatgactcatttttaatttccacttcaatgctaaataatatctatttttaaagtgtgcttgtttgcatatcacaccaaactaaaattacatccccaagaaaatgttcccagtcaagctaaaaaaaaaaaaaaaacttagcatatatgctgaagaggctgctgtttggtaccttggttagtgctgaagtaggcaggaagagctggaaatgcaaaacagcttctctgacttagaattacatcaatattacagttcaggaaaatcacattatttaaaactataacatgctcataaaaattcaaaaactggctctttttctgttacaatatgctgaagagctacagtgattcagtcatctacctgaaagcttttgtttcaaatcctttctaataggtctcactactcctctgtgaatggtttagagtaggacctttggtcccattcatccttctatgtggagcatcagacacagtacctgcgaacacaaagcaattcaaaaagttttttattaattaatattgtatgacctaattaaatcctaaaatttaagcttctggaagctatcccagtgtgcacagcttaagtatgttctaaaatgacagaggggcaaaagtaagccatcttagggacatgcgtcaaattattccaaacaactatcacttccagtaacattcctgagtcatctcaagataagtccatgctggcaaatatagaagtcattaggcaaagaacataaatttgcttaagatgcagaggcaaaagtgatcccaatatcaatcaccttaaagcttcataattaaaatgagtctggcaattgtctcagacacacacacacacacatacgtgtatgtatacaatgtatacatattatatatgcataatgtatacatattatatatgaacagagtagaaatatacagctaaaattgttttaatatacaaaccaaaatgacattttaaataaaagagaagcatatgacatcatccaagtagaaggaactgctaagagtcatctagttcaaactctaatctggtccattacctttcaagcattcaagtaagttttctgtcctgttttttaaaggcctctaggattgtataatgtatatcaagtgtaaggctttccaaaatcatcctttattcacttatgcaaaataagaaagaaaacaatgtgagaaaagatgaatattctcaaatctggcagtgcctgctgataacttctcactgttagatcagagagttattggtactgtttgtcattcatgtcctgaaatcttcaagtacaccaggaactgcacatgttcccaaaccaccatttcaaattagcaccaacagattggagttaatggcacatataacacattctgcagaatttaaagctttcaggccagctctaataggtagctgtgccttgatttgtggttattatcctacaataacataaaaattagctatccaggtaaagagtggctctccattttttagttggctacccacccccaattccaaaagcataggtccatcatgttcagattttaaagttgaaagaaaggtagacaccttagacacctcatggaggagcccggagacagttgtgaataatgctgccccatctgagatagaaccttcttttgttatgtactgggcacttaaagaaaaaaagtacaactctgtaatggcaaaagaaaggtgcaaaaaaatgcaggatagaagcagggccttgagaatatatctgggagttggaggaagaaggtgggaaaaaggctgagacaatgtacagcatgggctctgcagactgggcagggagaacataacaaccagtaggcaagataaggaatacagttaaatgaatcaatgagtgagtaaatgaatgaatgaaccaacataggaaccaatgaacatacaaataaaatgaatgaataagtgaatgagtgggcatataaatgaatgaagttgctgaatggtaggctggaactaagatgcagacagtcctaaatgtcatgtaatgagtctgaattcatccaaaaaagcagaatgagaaagacatttcttagacttctgcagagcacagtctgcccaactgtatgcacagacctaactaaaagcaatgagagttcacggaaagtttttaactctattaaatcagtcactgtggaagatcattcagggaacagtaggcagaggataagaaacagaagtcttacaacaggtccaaggactacgagctaagcaattgggttgttgtttttctgatcatgcatatactagaattttggatttgggtttttttaattgttatataagtcacgtgctgtaatattcatgcttctaaagtatacaattcagttgtttctcatatatttgcaaaactgtacactcatcaccactatgtaattccagaatatttcatcactccataaggaaactctggacctattagtggttactcgccatttctcctcacctgagtccatgggattcacatgttttaatcttaatattaatttctcctttatgtatctccccaaagtgcatacaaggacaatataagggtatctgcacaaagcagactctcagtaaaagatacatgattatctgccaaagaaatattgtcagaatgcaggaagtatcaagacaattttctttgctacccacctgatgcgacatttttactctcacacggtgagtagcaattttcaaggttcattaagttttttaaagtatcacttggtttcccaattgcaaaagtttaagttgtttttctccccactggataccataacaacctaaatatagtggccagatcaaaagacggtaaaagtagatggtgcacaactaataacccaattcagcaaccacagccttagatcatgatcgatttttccctccaccctacagagtgaaacaagttctgagaacgcacaggtgtttctctgcaagtccctgggcggaagtagcgggttataggataagccgatttctttttccattttaaagtcatctaagaaggtatttccattacattttgtatataattctactactgagttttggaatggctctttggtatttgggagcacacatttaaaaaaaaaggaaatctccaaattcctctcagagattattaccctgaattttagaacaaatttcatttaggctttgtatgtcatcccccattacacacacaaacacataattttttttcttatttctgttaaaaatgtaaaatacctttaatgataaaaagatattccttaagataattaaatccagctgaataaaaatatagtatgtatgtcttactcattttcctcattctgtgcatagggccaagggactaaatttacacatagcaccgaggctgtgcacagtcctcctctgtcccatcctcactccgccccgagtgctgcactgtgagaacaagacaccctcttcgtatatattcgctcactacttatgaaagatatttgcattaaaacagttgttttcataatactaagcttctaggatttaaaacaaaataaagcccgaactgaaaacaaaaaacaaaaaacctgactgcattttggtcagttcatctcttcctataaactattttaaaaatttatttatttatttattttttttctgagacggagtctcgctctgtcgcccaggctggagtgcagtggcgcgatctcagctcactgcaagctccgcctcccaggttcacaccattctcctgcctcagcctcccgagtagctgggactgcaggctcccgccaccacgcccggctaattttttgtatttttagtagagacggggtttcaccgtgttagccaggatggtctcgatctcctgacctcgtgatccgcccgcctcggcctcccaaagtgctgggattacaggcatgagtcaccgcgcccagccaaaaatttatttttaaaaaaagtttaaatactttgcacagtacctaaatttctttgtaccgctctctataaacaaatcatgtggaaaatattttctaaatgctcaggtctgtcaagtttgctagacataatctaatcccttttgtatcttctctcagtaactcaagactttgtaaagctgcaggacagttaagacaacagggacccaggggacagagccttcacaatcagtcacagcagccaccaaacccctggcctgagctatacagaggaaggggtttttatcttcttccttcacaatgcctgaatactctcaaggaatcctccataaataattcattagcagcaaaaagaatacagtctaatcaataaggagtaatggcgaaactcacagcaggttcaggggactgattgagtgttacattaatgtctgattaagcttcctgggaaattttaattgttcatagaccaaagacctaaaattaaccttttaaccttctgttataaagggtctttctcaatggaccaaaaaatgtttataaaatatatctaatgaaaatgggaggctaacatgagtatttcaatacatagattttctcaagaccacacagaaaaacagaacttggttgacttcattctacctaaaacattcctaatccaatcatattgtctaatatttaatgattattttccagtgggtgttataagagctttataacacactttcatttctcaactatcaattccctattttccaggaaaggaatttagcaaactctgcactctttttctctttttctagtaattccctttgtcaattcacagcaaaacaaactgcatgccataagcattcaagaagctgagtttgaaacacatttctttaacaaaaatgaaaaattctgattttatagttacacatgtagaattttaaattaaaaattgttgatatgtgctaatattacacagaaaatccaagatggttaacaatggtgggttatagaaggccttaatgacaggctatttctccaattttgttttgttcaagctaatgttaaaagaattgaatatttcatcacactctgagaagacagcaaagaatcctgctggaaaggaaagagcagctgatctaagcttttaaatatgccatggatagtccgcacaaagatatgaatcacctgtgtttcactctacaatgacacagctctccctttcattaagatatgaatcacccatatttcactctgcaatgacacagttctccctttcatcaagatattcttttcatcatgtattggttgatcgaagacaaaacataagaatggacaaatcattctttagttacataagaatattatctaaaccaagatctctttcaaaaggatcatgaagaatgcacatatatacaaatgagaagacttgccagtaatggtcaatgaggtacaagtgccaggtttctgctgaaatgcttggtaaaacaggtaaaaggatgatgggttctggggatcaggacctttcgcttcaaattccagctccaccgctttggatgtgcattattttggcccagacacttttctctaagcctatttcctcctctggaaaattattagtggtattcatcttgtacacgtattctttgggactaagaaaaaatgaaagacttacactttctagcaacaatataaggtcaacaaatgttagctttagtattagtactagcaccagtagtattagtaccgctagcagttactgcagctgtgcaacagagaacggaagtgtccaccatcttcattgaaggaactgctccgtggtggattattttcctattaaagtttatactttaaagcatcaaacctttttatcccgcccatttggaaggaaatgctatttatttatttattattttttagagataggggtctcaatctgtcacccaggctggggtacagtggcacaatcacagcttactgcagcctcaaactcttgtgttaaagtgatcctcctgcctcagcctcccaagtagtagggactataagcacatgccatcatgccccgttagagatggagtctcactatgttgcccaggctgctcttgaactcctggccttaagccatcctcccctctccgcctcctgagttgctgggatcacagaactgagccaccaagcccagctggaaggaaatgcgtttcaaatgcacatcacggtcactggcttagcagagtggagtctatcttccttggcaattcaggaccatctttaggatcaatacttactatcttatataacttatgacagtagaggtattgtcaggggctacccaagtgggcaggcttcattcaggtgacctatccgttcaactgctatgtttttcttgaagctggtgactctgtcaggaaaactcagaacaattctcagaaaggttcataggacactaaatgtcttagggtcacatggagctaatacataagggagcagtcacttgaacccaaaagtatctggcttggaaatcaactctctctaacaacccatactgaactcagctgtcactgtatacacacaacagaactggaaactctgcaaaagatctagcaggatttgaattccacacgatatgagcaaatgttgaacagggcgacaggatacagctaccaaaaagcctaatggtaaaacaaagacaaacaattatttctcaaattttatcatttgtacggatattcaaaggaattttaatgtcttaagcacaccttgacagatggtgcattcctatgattacttactttcattttactgtcctcaattctctccttcacagttatggtagccaacaaaagcaacagcagcataatgtctattaaacatgtacagtgtgctagaaactgtggtaagtcctttacagaaccacagcccccctgaatgtactcaaaattctgcagtaaatgactaacatgccaacgtaaacacatttaaaaaaaatcttcatttaaatttattaaacagtccagaattcataaagcaatgtaaaaacattcaagattccatttagtaaacacatctcctggaatacagcactagttgctgtttaaaccctggtgattgagttctatgttcagtggaagcagagtcgagctggaagcaatgaaagacttattttgaaacaaagttaagtttcctataaagaagtcaaattatgtttgggttcattctctttttcaaagttttcctcttccttactctcacatttaagaaattacctttaagcaaaaagaacttgctcagaagatagcagtcactaagaatcaggcatcaccggccttgaacctcagtataccacattcttttttctttctttagcaccagaaggatacctctcttctcgattcagtagtcccccttacccttaggggatacatttcaagaccctcagtgggtgcctgaaaccacagatagtactgtaccctctatactctatgctttttcttatacatacatacctatgataaagcttaatttataaattaggcacagagattaacaaaaataattactaataaaacaattataataatatactattcacagtctcatggatagattctttcttcctgtagatcttagcaacctcagcgtattttttttttctttccttattaagtcgggaactttcaccttttcactgaaggaagcactttacagcttctttttggcatatccaaattgacagcgctagtcttgcactttgggagcattattaagtcaaataagggttacttgaacacaagcactgtgagactgcaatactccatctgataactgagggtgactgctaggtgactaatgggtaggtcgtgtatacgcatggatacgcttgatgaaagaatgattcatgtcccgggggatacgggattccatcatgcttctcagaacagtgcacgactgtaaacctatgaactgtttatttctggaattttccatgtaatatttttagactgtagttgaccaaaggtaactaaaagcacagaaaatgaaacctcagataaggggggcactgctgtactttcagtagagagttctcgtaagtatattgctcttttctggacacctacaaacacaaattggccagaacatcatgaagcatgtttagtgtgaagacaagtaagaagggcttggtgatcttagttccaacctttggcagcttcttcatggagataaacacgagggtagaaagttctgtgcaagtctggctgtgcaaccagcctctcttaattgtgtaagacccacatggaatggtaagaaataattgccaccacaatggacaacaaaatctcactaatgtgaattaacaggcaaaaaagctaacctggattacattatcttttttaatggaaatacagttgtatatttaatacacacacacacacacacacacacacacacacacacacaaacatgcatcctccaattagactaacagtgtagagggtcttgggacctgcttaaaggatagggactcttagtgaatcatgcattactgcaagaaatacgtcttcccaaaggcttcaaaacaggtgcctttctttgtaagtttaaacagtgtccttgcagtcttgggtatacaataggattctaagtcagttctctccataacacattttgaaagaaaaaaagtcaaagcaggacaggcatggtgctcacacctgtaatcccagcactgtgggaggccaaggcaggtggatagcttgttcaagaccaaccggggcaatgtggcaaaatcccatctccactaaaaatacaaaaaatcagccggctatagaggcatgtggctacggtcccagctacttgggaggctgaggtgggaggatcacttgagcccacgaggtcaaggctgcagtgatccatgattgtgtcactgcatttcagcctgggcaacagagcgagaccctatctcaaatcaatcaatcaatcaatcaaagcagcactatatgaatcatcataaatgtcaaattagtaaggtctaaattctagattctgcttattcatgctttgggatcccagcctctatgcttctggatcctcccatctgttaggtcaacaccatttacctatatgtctagaagaatgctccactacatcacctcacagaagggcacaggatcaagatattgaacatttgatttaatgcagaaaaagtaactttcccaaagccttgtgctttccagccaggcactcgtttcctcacacaacagcagcatggctaaccaacagcttccagaagtacctgtaaagattgataactttagctggaggaaaagctggagattttcttctccattccctgactgtacttataagctacttactgcagcccggcaaggctctcctcacctggacggacagcctccctgtcgagctgacaagagctgacggatacacccgccagaggactactaaagatcgggatgctgctaccgccatgtccctggcactcttcagggcaagcctgggtaccaatgtcttctcttactcatggcaaacactgacgtggaaccagcctaaaaattctaacacagccccttctcaattaaatttattgaatgtgtttttggtattcgaagctcatttttatgtttgcaataatgtcagtacaactgatccattattattaaactacagtttttaataaaactccatttcaccataacatctaaaatactgcagctgaacttgattaattataccctagaagaaagtaataacagatttccctatttcaaatacaaaatgggaagctcctgttttattcttctaattatatgagaatgggcaaagtaatataccctccctgtcaacaaatttcagaaacttgcttttatctttttatttttcctccagtcagagtccttgttaatgacaggagcatatcataatttaattagctgacaccaactggcaatctacccacttctttttaattggaatcatttcatagaactatccataaaggcccattttgcataactaataaccttcataaacaagacctttggaaaactgctgactttaatggaaagagataaaacacttggacacaggcaccatgttcccacttcacagaagactagggacacagaatttactctgcaatgtatataacagagctaattcaggaagcacgaatcgggtttcccggatctggatagcaaaaaacttccagaaagtcaacttccccaccgcctcacgaaagcatcctaatagttttgtatagtggaaagaacacaggcttgaaaatctgaatttgtctttcttctttctttagacaaggtctcactgtgttgctcaggctggagtacagtggctattcacacactcaatcatagtaaactatagccttgacctcctgggctcatgggatccttctgctttagcctcctgagttactgagactacacatgcctggctcagatgcaaattttaatctgagctacaatgtgaccttgatcaagttcagaaacttctctgagcttctggttcttatttgcaaaatgaaagcggtataacatctaactcaaaaggctgtcaggaatattagttataatgtatgtagtgtcagcagcgaatagctcaataaatagcttttattctcccaattattacatattaaatttgactaataatactgaattgttgggatcatattagataattttgtgcaagtgcttagacaattaaaaggcaatataggcatctgagcttcactggattaaagacaagttttaaagtgctgttcttacattttacttgttttgattattgattaactgctatatactcaccaaatgttgctgccttcaatgaacctgagatcttaagagcacaggcttggcaatcaggtgaccgagtgtgaactcagcccactttctagctgtgtaacattcagtaagtagcgtaagcctcttaaattgactttccgacctgagaaaagcagctaattaaaaaaacagcattcatctcacagacatcacgaaggttaaatgaaaccatccatgtagactgctaagcataatgcctggcacaaactaagtggtcaatatatgttagtagctattattgaattagtgacaatccaagatcgaatctgatacaaatgaggaagtgagacttagaaaggtcaaagagtcttaccgatattaaggagtagaggaaggaattttattccaggtctgtctgacttcaaaactcatattcaaccctaatgcttttaaagcactcttaaagcaggctcagtcattattttctaatatacagttattgagtattcacaggctgatcgaagtgccaattgttgaggatataatcgcaagaaggtagagggtatccctgccctcagggagcttacctatctgggagaaatagataaagggcaagacaagaaagcatgccatgttctccgataaggaaaatacaccagcctaaaggtgcaccatgcaggaagaacagggaagtgaataaacatgaactttttagaagaatccaggtactaaaacagcttatgaccttttcttaaaactaaaatttctagggatttccagcaacccaggacatttgtatatcaaagaatcaaactacagaactgtaaatggaccaaaaagaagaaaatgcttatggcctgacctcagtagaacacgtacctgcacatgtgagttaacgacaagggtttgggaaagagacctctgtccaaacaaacctccttctccgccaagtgccaacacccatccttccttcagcagttaaagaggagacagtaaacacaattggctttctcagaatggagggtatgcagacccggtgcagggtaaggcataaaagactaacagaagaccgtcctgggggtgagttttgaggaagacagaataaactagaagtgaagcggagtgtggagaaccagtctgggaagcagagactagaaaggaggcaaactgcccaggaatctaataatggggcctacacacccatgctagccagagccacatactccaattcacctagaattggcacaacagcaccaattctgagaggaggaaggggaaggatggcagaagagaagaaagaaagcagcagctgaaaatttcaagaactctccaaactgttcctcccttggtgaaggttgatggtgtcgtccaatcactgcagcaaactgacacaggggcctgcagacggttgtgtgtggcttttggagttagagacaggccgttttcttgttaatcggcaggcaggcgtgacagtgttcggcagaggacaatctgttcgagaataattagattccccctcgcttcttgcgttggtggcggaagcacccggagtatttacaatacaccattttgcttccatccgagtccatatgttcgctggtcaggttaaaactgaggctgcatggcacatttttcactgtaaacaacgctgccccggcaaaccctaggggaagggaggcgatcttgccctcttaatttcccagtccaaggaaaggctcgccttcaggaacggcagcagcttcgatatttattgctggagaaaggccacacctccggggagtcatgtcaggagccataggtccagccaggggagcagccctcatttgatgtgagacaaagaagctagaaaacagcccccatgaagagtatgcctttataacatgttgaaagtcacgtgaatcaggacgtgctcggtggttgtaattccatctattgatggcagctgctgctgcaacagggaggccggctagggctgcacactccatggaggcggtgggagcctcacccattctgggttggggcaggggctccgtgggtgccactgcagccacccaaatcgtggctgcagaccaggcttcctgctctatggagcaggcaggcgccccgccttcctgggtggggctacagctgcccaaactgatgctggagatcggagcttccctgtgctcttggtgggggccgggagcagacaggatctgccctccagggtagagctgcagcctccctgctgcggctgcagacctgggcttcgcgctcaatcgagcaggcaggagccagggacaagagggagccccacctttactgagttggtggagcgtgaactccgcaggtgcagacctggcatctctgcagcctgcaccctggagggcccgggaagacccgccccccacttcatccctgcaggctcgggggtgtctgctcccgcttcccagcccctctcctctccagatgcctgctctgatctccgaccggggttggggccgagcccggggcagcaggaggcagagagattcctgggtggaaggcggcagtccccgtaaggcccctccttcagaccagggagggcctgaaggctgggggccaggatgccagtccgggaccggagtggggacttgtggtgcctcgtctgggtgcacatggaggaccatgggccaatcggcaggaacttcctcccctctgaggtccataaaagcctcaggctcagccagagcagggcacgtggagacaatgggcgaaccagctacagagaggagctgccctctgctgagagcttcagagacctgcagagatgtctgaacggcctgcttgtgaagaggagccaccatctccagggcctcctctctgctgagagctcaacactccactagatgacctgcctacagagaggaactacccacagtgggcttcctctgagctgttctgacactcaataaagctcctcttcatcttcttcaccttccacttctctgagtacctcattcttcctggacacaggacaaaaacgggcaaaggtgccaccagccacagaggtttccggccagaaaagcgacaccccgaagatcacataacactatgatttggaggcaaagaatggaggaaaatggagggaggaagaaaagatggagaaaaatctcttaggcatacatgcctgctgttcaacaaacactgtgctaggcaaggtatacaggccatctccaagaaaagatgactaagtgacttctggaacgaaaagcacaactgccatcctaaccccctccccaacattttccagggatcagccctttacttgttaataagcaagaagacaatgcatctgttgcaactgtgccatcagaggacaccagggcagagttactgcagcacttaattagcttagtgcacttgaaggctcagcctggagttctcaggtgagtggcaggaaaaccctacaactcagggtgggtcccaggacaaatgcagctgatgtcagaaaactatgtttggcaatgcagttagagacaaggagtagacgcctcatttgagaatcatttctcgaaagaaaattctagaaatgtgacagtagctggaggaggatgtggggtcagtagagatgaaaaatatgcaaggcctgatttttaaaatacctctttttgcatttcaattaaatgattaaaaattagcactaaaaagaaccatggagatctatatcaaaacccttcttttctctacgaagaaactgagatgcagaaatgttgagtgactgcttgtctgagacacctagctaatgaagagcagggctcgacttagaatttaggattcctgtccccatcactgggcctctactccatctaccacaatgccatgccatgtttctcactctgctgtgactgatcctcaattttagttttagttttgtctttattaatatgtttcaaaataccctaaagagaaaggtatcagattaactagcagaagtgataattttttttcctttcaaaaggaaaattttaactaccttcaccaacaaagggattaagtctgctctatgatggaactgcattaaaaataatgaggcagataaaaaaaagcttttattattttaatgaattcaaaagccggaagcattattgagatgagcagtgtgttactgccctaatccaatgttaccatgttttaaaaattattctgggtaggaacttttctgctacatcagacaaaaccccaaaatatgccaagtagacagaatattaaattaacatcaaatcctcatccctttcaaaatagagatcacgattctaaggagcatccttgaaagcaccacctataagacacaaaacttgctcatatgcaaagatcacccctctgtctacaatgtaacccaaagattcctctgtctgccatttaacccatgtcctaagaaatttatgattctacacattctttatctgaaacaaccattaacttctatatgtacaagcaagttaatttaatctctctgttcttttgcatccgcagctatagagaaagaaattctgtttttttaacttaccttacagggattgattctatagaagaaaacatcacagtaacatttggcataaacacaaatttgccactttaatgtgatactctcttaagtctcagaagaaaataacagaatcttctttcccaatttcaatgttcacagaaatgttactcaaagaaagtatactataaactataatattccattcttgtgtactatagactataatattccattctctttcaaaacagatcacatttcttggccattaagttgacaccattctgccacattcttgacacatcaagtttagaaattagtactcgggtaactgtgggaacaaaaatgactctggtaaagtgaagttaattacatttaacttattctgaagggttgtattttctaccacagctcacttatacagaccactcccattctgtaatcaggcctagtattacaaaggtatgctgaagcattttttacatctgttggttaaaatgacttattactatactgctaattctgtacatactgtactaatgtttctgtctgcataaagcacaagaatagcctatatggaaaaactgggacccaaaccaaggatttctcctctgcagctatggaggggatgaagcgagtctatttgtctaagaagggaaatgtctggcccagccgtggaagtccaggggttggggggacatggaaaaaggccacagggaaggagacaaaaccagaaaaccctgtccacattaccacagtgacatcccaatggcttactcacttcccctccagagccctgccaaagagccaagaagtcttaaacatcatgccccagcttaccatcctaaaagagatggaggaaggcttgttcagatggctggctccaggttgaaatgatactctagagaagttattactcataaaatattccttggctgggcgcagtggctcacgcctgtaatcccagcactttgggaggtcgaggcgggtggatcacgaggtcaggagttcaagaccagcctggccaagatggtgaaaccctgtctctactaaaaatccaaaaattagccaggcgcggtggcgggcacctgtaatcccagctactcagaaggctgagtcaggagaattgcttgaattcaggggacagaggttgcagtgagccaagaccgtgccactgcactccagcctgggtaacagagtaagactctgtctcaaaaaaaaaaaaaaaaattccttgaggggaaaaaatagccccacagccccctactttcaatatcattttgtccttctacaagcaggatagatggacttcctgttagataatgaatctaactccctttttttttgatatggtacaaaaagtatggggttcatggccaaggtgtttaaaatcctggctctgctacttagtgcaatgaaccaagtaactttaatttctttgaccttcagttttcccatctgtgaaatgaggataacaaacctatgttgaaagactactggaacaaagaaaaaataaaaaactctttgaaaaggacctagcctatagtgtcacattcagcatctactcaataaatatttgtcgatccttcctccacagtcctcactccaccagcagacagattcaaacatcacttgattagatgagcaaataattttctttaactacccaagtatctttaaggcccgtttcaaccccagaagtagattcaataccatacagaggtattttcagagcctagctgtgcattcccaaggattcaggcgtatgtaggcctgtctggcattctactaggcctgctttccagtgaccttcctgtggcaggagccgagatcttctggagaaagtaatgggaagaagcaaatgcttacagacttggtcaaaagaaaatggagaaatagaagaaggaaatttcaagtggacaactccaacccctgagtcagaggtcagcactgtgggatgtgggggccaaaacaacaataaatgaaaaactacttcactgagaacgctgtttctgggagctcaaggaggaactacttcctctggagtctgtgaaacaaaacaagctccctggaagtgaagggttcagcccagtggctgctggagcagaaaacaaacatgaaagtgcctgggtgacaaaataagagaggctcccggcaggcagcccacatccagaggagagaaaaggcagcctgggacacctggcgtctggagagcagggatgacgatgtagagaagtggagggaagagagtgtttgttaacacatcctggggacaagggtgtagtccacagatcagccacaaggacactcagaactgacttggaggagcttgtcattggctatgtgaagaccgagcatggaagtaccatgttgttgctattttcatcctgagcaattataagttggtaaagcaagagttatgtgccttgaaactaatgccacctcagtctagctgctcactcagagcaagtgcagaggaaggcaagggaaccaatattctccatacacttgctatgttttacgcactgagtgaagatttttctcatttaattgcatgtaatttcattctaaagagcagacaaacaatttcattcgattagatatacttcctcaataaaggcttttgaatgaaagcaaatttcattttgctgatcaggctacactacgtgagtgtgtccttatagaaataaattaacctggaattaacattacgtatttttgttgttgttttcaaagacagagtctcatcctgtcacccagatttaacctttctcagccacatctgcaaaatggggatggtaaaaataggtaatgataggagctatttcacactgttttgaggactgtgttactacacagtaaggtgcctggcacaaagtaagcactcaataaatgttagcaatttttatgttttataacactaggctgctaagctttgatggaggaaatcatgcaacaaattctggggagtgtttcctcaacatatctgatgtccaattttctcttgtagctgcatggggcccagaaccgtatcacatggtgcagaagttctctcaaatttccaactgtctactcaagcaccaagcctctgcgtgtgtgcgtctccctcagatgatcttgcttccaaattcacaaagaaaacagaagccacagccctgctaccaacttcctacccaacccccataaacagcattatccttctcctttaaactctccccacttttgagaggaacagtcctcctacacagaccatccattctcctgtgttccacatcctctctgtctcctacagtcataacctggacttccttatcttcagtctcatttacttcccactcatcacttcccctcagcctaaaaccctgctggagatagggaaggagggagggagggagggagagggggagggagggagggaaatatattttatttatattttgattggccgattgcttttcagggtttcactctgtcacccaggctggagtgcagtggtatgatcatagctcactacagccttgaactcctgggttcaacaaatcctcttgccttagcctccccagaagctgcgccaccatgcctggctaattacttttttgttttgttttgtttgttttttaatacagacagggtatcaatatgtttcccaagctggtctcaaactcctagcctcaagcaatcctcctgccttggcctcccaaagcctgggattacaagtgtgagccaccactcctggcctaagtcttctattttaaacaatcccacctttaacctcattcacctctagctacaacactttatttatcccttaatagccaggttgctagaaaaaaaaccctttatacttgctatcatctccatttccccaaatttccaacctctcataatatgtactgtgacatcattaggcactaaatctacccttgctttgggtgggttctaatgacctcttaaatgcaaagtgcagaagactttaatcctttctgcttactgccccatacatgagtcactccctcttctacattactgtggcctcattacactgcaagtttactaaaggcaatccatcaatcaatctggcatagctttggctatatccactcatgtggtattgcacgcagcctacattcactgaacgaatcaatggaaataataagggccttaaaggctccgatggcttcattgtgccatccgctctgcttctatcgctactaactatggaaaaagttaacatttctcttactaagtgaatgatacctttggcaaagtaagatataaaaggtgtaatgttctagctgatcctgctccatacagctccaggtaagtaatctgccccagtgagagatctgtttataccggcaaagtgcttcagggcttaagtcttcagaatttgacccccgctcacggcacagaaggatgcccaggacacactataaagctattagaaattgaaaccaatagccctcctagtttcttttaatagactttcagatgcagtgttttctgctttcctttaaaaacagtagaatagtaattaacatttagtaattttcaaagcagttgtgcaggaagatttcctgaactatgaaagcccacaaatttggcaacaagaagtatcacaacagagaaacagctcttggtttattgttcattgttccccacacttagttaatgtgttacaatgacaatgtatgaaatacatgaagttaccatcaaaacaaacaatgttttttttttgttttgttttttgttttttgttttttttttgagatggagtctcactctgtcgcccaggctggagtgcactggtgcaattttggctcactctaagctccgcctcccgggttcatgtgattctcctgcctcagcttcataagaagctgggactacaggcgcctaccaccacgcctggctaattttttgtatttttagtagagacagggtttcaccgtgttagccaggatggtctcgagctcctgaccttgtgatctgcccgcctcggcctcccaaagtgctgggattacaggcatgagccaccgtgcctggcccaaaacaaacagtatattaaacaagaaaaatgaatttatgaattagctttcttccctcccaaactcccttactctacacaagtcattcctgatggagagattgaaataaaatgagaaatttaataatgaataatagtaatactattactaataattccagcaattatactggtattactttaaaaagaaaaaaatattgcttaatctttagcttttgctccacagcaaattccaattctttcaggacacagccaagagaaagcagataatgttcgtcccttatttccatacgtttcttgtttcaaaatggcaacccaaaaggaatactccactgattgtttgtagatatgctgattaaagaaaaatataaaatttcaagcccatcaaccagtgctgctctataataatcaaaaactacctttacaataaaaggttatcaaaccaaacagtctgatcatcacataatttctcatgaaagctgaaaaggaaatacaatcattcacttattggttcatctttcaccaaacacttattgtactaaatgctggcaatacagaagtgaagatctgcttcatgccctaaagatgctcatagttagcaccaagaactacacatctcgccaggtacaggggctcgtgcctgtaatcccggcactttgggaggccgaggcaggtggatcacttgaggtcaggagttcgagaccagcctggccaatatgggaaaatcccatctctactaaaaataaaaaataaaaaaaaatagcctagtgtggtggcacgcacctgtagtcctggctactcagaggctgaggcaggagaatcgcttgaatctcagaggctgaggttgcaatgagccaagattgtgccactgtactccagcctgggtgacagagcgagactatgtcttcaaaaaaaaaaaaatatatcgacctctaagaatcacatttatcttgagctacagagttcgaaggacagaatttttttttttcaattaatgttaaggtctggaagtttgactttggctcttaacctttggctcacatacctaatttggttactatgtgtttactacatgcaaaaagacttccttgggcctatgaatcatttctagtaaatggagctaataataactttccatcagaaagctctttgtcccatttttgtatcagaaatgggcaagaaaaaagtgaaacaaaataaaacaacaacgtgaagatttttttaaatcctgcccctgggatgttgatgagggcagagacaagcaatttacctgcacacaaaattaagttttttaaataatttagattctaaagaaaggaacttttagaatgacatctgctaatactctaaagcttataactctgagttattgggaaggtaagaacatattttccccataaaaataagttctatatcatggttatgatccaaggtgaactcacagaaacctactttctttggttccttcaataaacattaaaagcctgttatttgtgaggcactatgccaaccattagggatataaaaccaaataggactcagtctctgcccacaggagcttaagagtctagtggaggaaactaaattaacatttgcaagaaatgctgtgtttcctaaaatatctacaaggtgttttggggagcaaagaaaacgggcaccttaatcagactacgaaagggagagtcacagaatgctttcccttaagaggtcatatttgagctgaatttgaaggctgatgaggaattacctacactaaaaaggaaatcacaggtaaaaaggtcgaacaaaccgtatttagtgatttgctgaatcatggaggtgggtgacacaaaggaccctagaatgactcaggtgtctggtttggataaacaatccaacgtaggcaccattcacaaagaaagggatgctaggaggtacgagggcaaagatgaaaaggtcatacgcagaccgcaaagcttaaaccttcgcctcacatctgtttggaacagcagtagctttttacttagcgcttacatcaccaaagccaatgagtagcgaagtctgggacgaggacaagagctgcccttggcatcactgcctgtcacctgtcccttcggggcgccccctgcctccactgcttggcctctgtttgtagcttgtgttttggccttgccagcaagtgtccttcagggaggtctggctactcacagtttatagatgagaacactgaggcagagcgataattaactcgacaagagaaaacaaccagcaaatggccctcttgtcccagagcccacgttcttcaccagaacactgcctagtttaagaaacagcagcaattctgtttcttataaactcatgagcttcccaaagacaggctctcatccggtcaggcatcatgggtggatcatcaagcaaacagatgccaacagacattccctcccaagttattccttttaatcctgtcctttgtcagatgcaaaaggcctaattcaatactggaattcctctatatccattatcaggtcacctggatagcctgtcctaaaagaatgaagtccctccttgccacaacaataagctttgtcttttttcccccccataggtcagcttccttcttttatattctgctacaatctgttgttgtggttaattacacaagagactagcatgggtgtgtcaatccctagtggaactgcgttgagaatctgcaaaccagaccatatattatggggcttccaaattttcaagtgccacagaatcgcaagcttctgatcactgcattaaggatctagacctgtggttcagatgagagatgagcttcataaagaagtatgttgccagtgagaccccactaggttgaagattgcaggaagctgagatgcttaaattattctaattaatgggcttattccccactggttatgcacagcagattgaatggacagttgcaggtgcaaactgagaggtaaacagacctttaaataagtaaagagccagggagcactagctggggaagcacaggtttcagaatgaattattaaagcctgcactgatccacagtcgagggtatgactgatttctaagtgaagacatcttatcctgaatgctgctactttaaggtaaaaatagactcattcttcccctgactctctttctccatcattggtgcaaaatgaaacagctccgttggtttgtaattgatgtatctgacactaaaatttcattctatgtacttccatcctctgaaatgcacagtaagggaagaagatcatcttgacaggtaaaatagtaggttttgacacaaagtcattgagatatatgtgatggagaattttctactgagacaaaatgcagttctatttgaaagtttactacacatttcaactttcactttgaagaaacactttcagataaataaataaatacgcaatgattaaaagaggaaattggctttgtttttttgagaactaccccgtagagtaaagcatacctttttatatttactcttttttataaaactattgattgaaaaatatgaaaaggtagaaggtgcttagaattcctagcacataatacgtgctcaatttattgatgtgaattatatttacacataaatatacagacaaaccagaatatataaatataaagggatataatcactccaacaccatgaattccaccttaattttcctctccttgacaaactactgattaaatgtaaaaagttgctctttaatctagataacacgttttgtatgcatttaagaaacatttactgagcacctgctttacatcagcatagttctcagtacagatagagcaatgaacaagatacaccaggtccttattccaatggagcttaattctacccagcgtgagatatgcagtaccgagaagtaaataaatgagaagatattttcagataatgttcatgatgtggcgacaataaaacagaatacaccacgagcgtgtggaagaagagctactttagagggaatgaccaaggaaggcatctttgaggcagtcacattcaatggagtcctgaagaatgagagcgccaaccattaaaaaaggtttttctaaagtgctggggggaaagcacgtgtaatagccggagttaaattcactgctttcaacagaataccaaataaaatgatttacccacagaaagggtcccttttctcactggattcccacaatgccattagggagccaagctccttatacctttttctttgcccctcctggtgtgtagctcaccgggggctgctctactactgagcagtaactcagccttccagtgatgaagaatggggaaggctgaagggcagggtgtgtctagccagcctagtcagtcccttcctatccgcaaatagtaccttccccagaagccctgcccataagtgttcacttacatctgctctaaactgtcccacagatacagtaaagctaaggaagtttcttgcttttaactggcatgaatgggccttttgtagccccgaaaaaaaaaaaaattgaaactctgttagcaggaagaaagcaagaatgggcactggcctgtgataagccatgtctgctgaagcatcctaggcagggccatggcaagtgcgaagtcccttgtgggataataggtccagcttgtaaaacagaagaccagggtgtaggagtgcagggaacacgacggaagcacagcccaggaagactgtgagtgaaatgggagccaccggtactgagggctcgccaggtcctggagtggggggagtacttttttttttctccacaccacctcccagatgtggtcttgctatgctgcccaggctggtcttcaactactaggcccaagagatcttcctgcctcagcctcctgaggagctgggattacaggagtgcaccactttacctggtgatattacctttattttacaaataatgaagtaaactcagtaggttaagttgactcagctaaattcacagattaggaatgagaggagacacaattataacccagcttgatctgactcctaaattcatgcctgtaacccctgtactctgctgctgtcttcatatccctgctttaacaatatgcctctgagtatgagctgacagaatccattcttccaaatccattccggttattacctactgtcctattcactcacatttataggaagtgtttatttgttctaatattttcatttatttcaaagttctagatagagagaactctatgtctttctttgcctacctaatatgcatagaagaaaaaaatattaaaactgaaaatgactatcttcatctgatgctgaggtttggggtgaaaattcatattagtgggaaagcagatctctatactgctccttctcactctgagatacctggggagggagaaaagacaacactgaaatgtcaaagctcctgccagttcctcggtgctgaaacattaatgagcttctgaatgtgcaaaggtgggcccagagccgaaggatgtttgagagttaaattgctctgcataatcaaggaaaggtaattgagtttcccgaggaatcagagaatcaagaggtctaggagaagtgagaaaggcagggagctatgaaggtggctgctgtctaaccccacatgacgtctctcatgatttccacattaccagcaacactgttcccaaattcctgacacagagctatagcaagctctcacatgggggacagcagtgagtgaggattctgtgggtgactcctgtgggtaagcattggggaaatactttcagatcacatccaggataaaccattattttcaaatctgggaagattaaatagagatggtgaatgtaaaagaacctgtgggacctggcagagcaactctgatattctccagagcagcagcagacagaagctggggctgtttgcttactcctctcgccctgaacattaccaacatgcaggctgggactgtgagacaacgccatcagacaagcgagacgatgccatcagacaagacaggtgttccagcgattgctctaggtaagcctcattctctttgttcactggcagcaccaccccgctccaccctgcgcctcatttgcagagtcctctacaaatgaacatgcagcctgcctggcacacctggcacagctcacctgcatgccgccaagcatgacagactgtctttgctgtggttgtaaaggcctattttcccaagaggcttcttctccggggccctacagctttcagcgtgcacttcaaactcactgaggactgagtgacttacagttttctctgtgtgctaagctgttagattgtttccatctttacacaggctgttccctccatttcaggcatcctctcttccaggctgaacccgttttcatcagattatcttttaccagttcttcagaaagcaattcaggcctcgtttctccaggaagccttctctggcctccacctttgatttcgatggtctccttcatgttccccagcccccgtctatgcctccaccttggtatatcatgctctattgtaattattaatttacttttctttctccgcgaatagatgtacccacagagcctagcagtaaacctgcaacaaagtggtggtttgatcattcttatcaaatgtatggcttaaaagtattgttcttctaaaatgtaaaaagagaatcaaatacaggtctggccaatgacagtatatttcaaatgacaggcaggaacatgtcttcccaagtcctgatttttctttgaatgcacagctctgacttatctggcctctctccagaccttcatatgactcttctctagttaagccaatagcaggcttcaagccaaaaactcctagaagtaggagtttgccaggcaatagtgcatgtgtgttggttgcaagagggtaaaaaaaatattacaaagataacagcctgggtgcaagcttggagagtttcaggaacagaagaggacagcgtggcagagctgtgggttcagtaagtgaggtcaaagcgtgtggacgtgtacctggccggctaagcaacagtagtttcttggtgaatctatcagagaaggactactatacaacataagtcggtgggagcaatgtatctaaagtgagaatgagtgaagtaatgctatcccgcaatgaccactaattgaaatgccaacaactccaagttggctaagtgaaaagagagtcttacctcaattaccctaaaagaacattctagaactaggttaagctaacaggaataagcatatgtggagggtgtttctgggaaaagaagtctgtcagaggcaggcagaagtatcaattggaatgtgtctcagagacaacctaagttgacaccatataaataaatatttctgaagattgcagccaactgatctgaactctactgccacgtaaggcatattaattatttttaaactaatagaattggtgtgcatgttcttgaatcatttaaaattcttatctcctcaagaatctggaatttttgtttgtgttacccctaaatccaaatttcacaatgctgaggagtccatggttttcaggcatcattacaaaataaccagcacttcctaacagctggtggcagcaaaaatctgaaacttatatttctcagttacaatgcctacttaagaatcacctcaaacctttaagtacaatacaatgtgagggttactcagaggtacagagactagtggtatggtcaggatttcaaccgtaccatataacctgcataatgaacaactcagacttacctcacttgttactaaatatttgctttatgtaagggaaaattatcttcagccaaaatggtagagcacaaccaacttaatatatatcctaagtggcttagaggctaagtacataatcccttcagcagtagcctcaactacatttctcttattgtagctagctcttgcacatttaaccaccttcatctgtattgttaacttgaaattttaaatgtgcatattcccagaacgcatcaactaatttttatcattctttcatttgaaaatatccttggaacattaatggttgaagagataaaggataccatgttcctaagagaatttattgtgactcttacactcagtgactggttgtaactgggaaactcaaaaccacaactatatatgactataaaatgacaatgaaaatagtttattctatacttgtaggctgtttgacattttccagcttgccttgattttataaaaagaaatgaccttgaaaataattaagcatatcaaagggtaaggctgtagctcactgaaacacagcaatatgttcacgtctttataacactgctaagcattcatgaaatagcaagagattgtattgctctttaaccaagttctactttaattttataggcttatacatattcactacgaggccattctaatcttcacctacctgcattcttctgaacttgcaaataaaggcaatcaggactctacctgctagacttggaacagatcagattttgcaagaggcatcagggtctggttgattctttttttttccagcctgtgtttaatgagagtgctctcaataaaaacacaaattcagattaggtttctgtactcaatgtttattaatttagatactctttaaaagagcatgtaagcatcttgagaaataaatttagctactgtcactttataaaaggaacaagtgcaattaaaaaagaaacaggaaatcggcaatgatatggaaggaaagtgcttctgagacctggatgctatcagccccactgcatacaactgagtgtgctccctgcagtgttgcaaagggctcagagaaatcacaactggccaaatgttagaaccttccgcagagaaataatgacagaggaaagtcagaatctccaagaatggaagacctaatgctcggagatctgcagacatcttaataaaaggaatattcaggagggaaggtgccattttgacttagttcaagttctctgctgggtttcctcctctacccccaccctagcaagagtcaactcagaccacaaaatttaaattaaaacacaaaatgtttagctggtttctcccaacttgaaaaggggttgacctgggatcccaggtgagagaaaacgagctatataaaaataaggcttcttgggaggccaaggcaggcagattgcctgaggtcaggagttccagaccagactggccaatatggtgaaaccctgtctctactaaaaatacaaaaaaattagctgggcgtggtggcgggtgcctgtcccagctactcaggaggctgaggcaggagaatcacttgaacccgggaggcggaggttgcagtgagctgcgatcatgccactgcactccagcctgggcgacagagcgagactccgtctcaagaaataaataaataaatagataaataaataaataaataagacttctctcatgaggtgatggaatgccttagagatctgctatttccaaaccaccaggaccagccccagtgagccaaatccttaatgcttacatctttcctcttcctacaacacatggacgggggcatgtgagtaaccaaggaagccaggcccaaagagaaacttcctggtgccaggatcattttgggtgagccacttgttttttgctcatactggatacgtgtgccacgtgccaggcacacagtcctgaacaagactgataacgtctctgctctcatggagtttatgttcttgtgatgggtgacaaatggtaataatgaaagattttgggaagagtatcaatcatggaaaacatctatttatcagtccgttcatttacttaacataggctactgttgtgcaacaggtcccatgttggctgctggaagtatacaaaggtaactaaaacacaagctaactttgggagtcagccacacagagacggtgaatgaagctacaggaatcagtaaggtaacccacagacagtgtgcagagaacaaacaaggtggcgaaagaaccccaccgactgggaagacagtagtgcaggaagaaaactaggagagtatggtgtcaccgaagcccagggaaaagcgttcccgaaagggagcggtccacaggacacatgaagttagagtatccggaggattgagcaacatggagattgctgctcatcgcaactacagcagtttcaattgagttaaggacctgaacgccagactacagcggaggtgacaagaagtaagaaagtgaagactaaaaatgtaaataatttcagttgtaattgtgaaaggagagatgattcaaagataagtagaggaagaggtggagcaaaggcattacttctttttttcccctccctcgctttcttccttcctaagaggaagacaggcacatttaaaggctaaaaaaggtgaaaataattgagactagataactagtagagtgaggtccatcaaataataaaagagtgagctctagaaaacaggaaaagacatccttgcctttggggatttcgggacagaaagagggaggtttgctgatgctttcaggggtgaggagaggtgaagggttaaaagtcgtcgaaacaatcttccaccttatagcctcaggccaggaaaactcccaggcaagattgtgtgcagctgaagaggccaccatgtaccagtcacaggtttttaaggtgagcttagatgcaaatggtaaaagtgaataaaggtcggggagtggagaaggtggcttgtctgattattaaagttacttacagatatatatatctgttatatagatatatgaaatttttacaatgagacaataaagtaatatttgggtaagaaaaattcacacatttttaagtaaaaatgtccacttcccactctacattagggtgagaggaggccctggcaatgcagacaatgctgaatcaataatttcagtaacctaagagggctgtctagaagtaaatggatctacatgtgcacatctgaatgggagagatcaggaatgtaggtcaacaagggtcatcctcggtgacccacacccccattacctacaccagacaaactgctttgctgcactgtggactaggttcccctcccttttttaaaaaaaaaagaagaagaaaagcactatctgttttcttgcaactcctcaaggatttagtgcagtgtatgtgtcatgcttctgggcaacttggaaaataacctgagaacatcaaaggtctatactgaacgtgaaaaaccctctgggcacaggctgcaccaggccacacactgccacgttcccttcacagtcctaaagaaaaaaaggtacatgtttgtatagggttctttcagattctctcaccggaatcatttgctccagcatgcatgactgaaacctaccctgattaggaggaggataagatcatgctgcctgagcacacatgtaagtctggtaacaccctactcactgtgtgaaaaagcattttagctgttggcgtcaccaaaatgtaagccctttatttgctgagtgtctgctaaatcaacatacagccttcatattttgtctgttcccctgttaattcttaaaggctgttggttcctggagtctcggctggagtctgggaaccacgtcagtcattgtgcttgtccacacatgtaaagtgctcaagataatgtttgcctatcacagtgtttgtttaacttgctattggcccaataacatgcaaatatgtgctccataaaagctgcaactgactgtaatacctgagagctaggggccgcgggataacttagtcattattgttttttcttgaggtgaaacataaaattaactattttaagaacaattcagtaacattgagtgcattcacaatgataaacgaccaccaacctatccagctccaaaacatttgtatcactacagaggaaaactcgatacccactgaaggcagctgctctcgggtgccccttcccacaagccctagcgaccatcaatctgcactccgtctctatggattcatctactttgaacatttcatacaaacggaatcacagagcatgtggcgtcttgtgtctggctcccttcattaagcataatgtattccgggttcacccgtgctggagcatgtatgggtacttcattcatttgatggctgaatgatactcgattgtatggatagatcacaattggtgtattcattcaactaacaacgagcattttggctgttgctaccttttcactattgtaaatactaatactatttataatatatgtatgtgaaattaagtatcagttttccattcttttgtgtgtgtatatggcagtggaattcctgggtcatacatcaactttttaaggaagtggattccacagtggctaccacactgtacattcctatcagcaatgtacagggttccagtttcttcacatccttactattttccattttactgatcacggccatcctactacatttcattctattacatttaatagtaaatgtgaagtggcacctcattacggtttttttttctttttttttttttttgaagacggagtctcgctctgtggcccaggctggagtgcagtggcatgatctcagctcacggcaacctctgcctcccgggttcaagcgattctcctgcctcgacctcccgagtagctgggattataggcacaccccaccaggcctggctaatttttgtatttttaggagagacagggtttctccacgttggccaggctggtctcaaactcctgacctcaggtgatcttcccaccttggcctcccaaagtgctgggattacaggcgtgagccaccacgcccagcctcattgtggttttgatttgcatttccttaataactgatgatgaggagcatcttttcacgtgcttgtcggccatttgtatatcttctttggagaaaggtctattcaactcctttgctcttttatatttagggttatctgtcctttggtcatttttaagcaaggtactccaatattcttctctatgcatactcctttaaacagacaaaacgcaaaacagtgcggtggttaggaagctgtgctatgaaaccagactgcttgggtctgtcctgcaacttagtcactatgagaccttgacaaaattatctctctgagccaaaatatcttaagagtaaacctcgtggatatgtagtaaatattaaataatcaatgtaatatacatatcatggcatgtgacacatagaaaagctataaaatgtttcaaaagccaataaaagtatgcacaggtagcacgttcatgtaattacttgtgtacttccataaggatgggaaaaatgcacgaacctctcccagattcagccatgtaagggtagaaggaacttcagggaggaagtcacaggttttttgcctccatgttaagacaaaaatggccccataatgaaaagcactgtgcaaaatattaatttttaaatatctttttaacaacataggaaaggcattcttctacttttgcaaaggaggcagaaccaaaatctgtgaagaacctttggctatacagacactccacagggaccaaatctcctgccccatcacacattcctgggaattaaaaagaatggagaacgtttacaagctgctgtactttataattgttatttctttgaaatgattctttttctttgtgagaggaaaataaaccacagtatattgctgagaagtattaagactcattcctttctgcccacacacaaaaattcgttgcacccggaggaatcatgtcaagcagtccacctgcttgggtctaaaagtcatgtatattgttctgacaagtctaccttgctgccaatatgcttttgccgtctttagaaaggagtgtttagtaaaacaaatgatgcctatacagtgtccatgtacaaaggcccctgtgttccagttctatcccatacttgaaaaacaaaggctctttcagggtagggggttcaatatcacctgctatgtactctggtccaattaaatttcccatttgtaatacacaattttatacctataattctttctgtcattttacattgctttaatatgaaaagaagtctctgcttcacttgaattccttagagagcctggcttttctaaaagcttgtgtgtccgtccctacatccctcccacctacaccaaatttaaaccttgacagactaatacattggatagcaatccaggcagtctgcaaaagacagatgccaaggcccaggagtcacgggtaagctcacgtttatcttccacactgcaacgaatagataggatggaagaggtagtcagaaattagtaagccaagatgaaaaacgccaaagttaatttaacaaatatagagaaggaaaattggtcaaagtcagttacagggcaaaagactttctttcaaaaaaaaaaaaaaaaaaaaaaacctctaacaatatatgtgaaaagggcaaagcttaaaaagctggactatctaagaaacaaaataatgttcctggagtagcaaacagaagtcctgtttgctcttcttgggacaaatgctcttgcttgtcccagatcacaggtgaaaaaagatacttccaggcagaataacaatggatagcactgggagtctcaagtttgagttccagctctaaagatacagcaaggccgggtgcggtggctcgggcctgtaatcccagcattcggccaaggcaggcggatcaccttaggtcaggagtttgagaccagcctggccaacacggtgaaaccccatgtctactaaaactacaaaaattagcagggcattgtggcacaagcctataaccccagctacccgagaagctgaggcaggagaatcgcttgaacccaggaggtgaaggttgcagagagccaagattgtgccactgcactccagcctaggcaacagagcaagactctgccaaaaaaaaaaaaaagatacagcaagaaatcttcagtctaaaatgtacctataaactcatttttcacagattatggaaatatttttgattttcaagttttgataacaaaactagaatgtgttacagtttaattctgagtctgcatcgttcttggtttttgatcattatagaaaatacagaaaacacagaataaggaaaaaagagaatgtgacatagtacaacttaagaaaaaataatttgggtgttatttcctcactatcaaaaacaataattaaataatatatttttcattaacctaaaatgaagaatttaacacaatgattttctccccctcctagaaatatgctcaattaaaaatatcagaatagtgtgatatatattatgtatgaaatataatccaactaatactgcagcatggttagtttccatattactaaatatgcctcatggttgcatgtagcttccctttacatttatttataattcatttaaccactcccacactcattacttttttttttttttgctattaaaaaaaagtataattactgctttcaccaaacaaggattgctatgaataattttttcttaattttaatttttctttttttattggcctacttaggaattctactatgagtaatttttgactcgataaatatttctaaatttgcttgtctcaaaatataaatcaatttacacaaaaacggtagtaatacaagactgcctgtcttaaactctccctaagatttgggcattaacatttcttgttcatttttgtcaaatggcatttcactatttacctttcattcttccaaatgaacactaaaaaattacctggaaaactgctttcaagaaacgtagtcgagaaagactgacacgttataatgctcagtcttatcatctacaaacatactatgtctttccaagtaatcttctacatttcttaaagctcgtagacttcttattttcctgcactgtttgtgaccgctaaatactgtattttgcaaaacctttcagtttttttatatgcaaaattcatgttatttttcaaacaaccctctaattttttttaaaccagaagattattttctatggtttcatagtctacaaattactactttcagattatcaatttctgagtatactttgtttctttcagtacatgttatggttctctattctagttttctaagtggttttgatttctactttggtctaatagagtttctgtgctcccacgcattgggtgaggtagaaccaatgctgtctgtgtacaatcaagaattgattttggtaaacgtttcaaagataactgaaaaaaaggtatatttcttttataaaagatatcaagtttatcctatcaattgttttttatcttaaattatttttatatgacattaatataatccctcctttctttgaatttctctgattcacctttgcatatccttttgctttaaatcataacattttagatcattctttttccagagggatgggggtagggagtgccggtgtcatcactggaaaagagcttacacctgagagtactggagtcatgtcttcttaacagagacacctgccaagaaattcattgttaggtgattttgtccttgtgtcaacatcatagacacactaacgcaaacctagatgagacagtctactacacacctgggctacatgatattgcctattgctcctaggctacaaacctgtacagtatgttcttgtactgaatactataggcagttgtaatacaatggtaggtatttatgtatctacacttatctaaacatagaagaggtacaataaaaatacagtataaggttgggcatggtggctcatgcctatgattccaatgctttgggaggccaaggtgggggaattgcttgaggccgggagtttgagaccagactgggcaacatagcaagacctcaactctagaaaaacttaaaaaattaacccagcatgttggcaaacatctgtaatcatagctactcagcaggctgaggcaagagaattgcttgagcccaggagttcgaggctacagtgagccaagatcacatcactgcattccatcctgggtgacagactatgactttatctcatgaaggaaaagaaagttatgaaagataaaaatggtatacctatgtagagcactgaccatgaatggagcttgcaggactacaagttgctctccgtgaatgagcgagtggcaggtgaatgtgaaggcctagaacactcactgtactctactgtagactatccacactgcacgcttaggctacacaggcctagaacactcactgttctctactgtagactttatcaacaccacacacttaggctacacaggcctagaacactcactgttctctactgcagactatccacactgtacgcttaggctacacaggcctagaacactcactgtactctactgtagactttatcaacactgcacacttaggctacacaggcctagaacactcactgtactgtagactttatcaacactacacacttaggctacacaggcctagaacactcactgttctctactgcagactatccacactgtatgcttaggctacacaggcctagaacactcactgttctctactgtagactttatcaacactgcacacttaggctacacaggcctagaacactcactgtactctactgtagactttatcaacactacacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagactttatcaacactgtacacttaggctacacaggcctagaacactcactgtactctactgtagactttatcaacactacacacttaggctacacaggcctagaacactcactgtactgtactgtagactttatcaacactacacacttatgctacacaggcctagaacactcactgtactctactgtagactttatcaacactgtacgcttaggctacacaggcctagaacactcactgtactctactgtagactttatcaacaccgcacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagacttcatcaacactacacacttaggctacaccggcctagaacactcactgtactctactgtagactttatcaacactacacacttaggctacacaggcctagaacactcactgtattctactctagactttatcaacgctgtacacttaggctacactacatttattaaaaatctttttctttcttcagtaataaattaagcttagcttactgtaactttttactttataaactttttttaaccttttgactcttgtaataatacttaccttaaaacactaacacattgttcagctgtatgaaaacatttccttttttataaccttattctataagctttgaactatttttaaattttttttactttttaaactttttgttaaaaacgacgacacaaacacacacattagtctatgcctacacagggtcggggtcatgaatagcactgtcttccacctccatatcagatctcactggaaagtattcagggtcaataaaggcatggagctgtcagctcttatgataacaatgccttctctggaatacctcctaaaggaactacctgaggctgtttacagttaattttttaatgctttttttttctgagacagggtcttgctttcctgccctggctgaagtgcagtagcgggatcatagctcacataaacctcaaactcctgggctcaagctatcctcccacctcggcctcctgagtacccaggactacaggtgcgtgtcaccacacctgactattttttatttttatttttgcagacacagggtctcattatgctactcagattggtctcaaactccttatgtcaagcaatccttctacctcaggctcccaaagggctgggactacaggcatgagccactgcatctggccaactttattttttttaataagtagaaggagtgtgctctaaggataaaagtataatatagtaaatatataaacgagcaacacagtcatttcttatcactatcaagtattatatatggcacagaattacatgtgctacactttgatagaactggcagtaccgtagggtttttaataccaggttcaccacaaacacgagtaatgtgttgtctgtggagttatgacaggtggtagaaagttccccgctctattataatattatgggaccagcattgtatacacagtccatccttaaccaaaacatcattatgctgccatgacaacatttgtttggttttcttgtttgttgtttgtttttaagaccaggtctggccctgtcgcccaggttggagtgcagtggcacaattaaagcccactgcagcctctgcctcccaggctcaagaaattctcctacctcagcctcttgagtagctgggactacaggcacatgccaccacgcctgactaatttttgtatttttagtagagatggggtttcactatgttggccaggctggtctcaaactcctgagttcaggtgaccctcccgccttggcctcccaaaatgctggaattacaggtacacaccgctgcatgactacatttgtttcttaacagtggatctattccaggagagtggagtctcaacaattactaattattagttataatatatctgcctttcttcttcacactttcatctggtaagcacctgataaactgaaataacgtttgctctgatcaccagtcgatgaatctctgctgcttttagaaatatctaaaatattacaatactttctaaggtcatgaaaatcttttaggtattaatgagagtgtgggttacatgaatatgcatttatctatactcaaatatcatcaaattatatccttaaatatacacattttatcatttatacaatacacctcaaagttcagaaattattgggggaaaaactaagtatagctcaaggagtaactgcgcctgtgccctatgtagaaaacgcactggtgatacagacaaacattcatttatttacaaaatcgtatttgagtagaaaatattgtgtcatcgtattttgtaacatggtaaatatccctttatattgcaccaaaaattagagtcaggcttcaagatgatttttacataccttattataataaacttagtattatccaactgataggagataaaacaaaaagcaccactgggagaggtttacaattcaggtaaaataaatgctttgttctttgagatctggagtaataactgtctgcttattaaacaaaaaggttattttttcctatgcataacctttacagtacagaagtactccagacttgaaaatccctctaccacctgaggattaaaacactttaaatattcaaatctaacttcttaagtttgaactatactttccatcacagatctggaagtagtctgtgaactatcgaggaagacagggccattcacagggtggtcattcactcaatttggggaaacagagtatcttctaatctgttaggattttgctgaatgacatttgctaggggaaagttttaaacatttattgccgacactccaggaaaatagagggtaatttactggcatgtgtgattgtcaagtgggagaatatgtcaatcacctaattatcattattcattaaggagggctttcaaatacattgtaaatgaaacatgtgtaaagtagccatgaattccaagtatattatactgtgcagacacagaataaaaacttttttcaaaatacataatttacttgaaggagtttcctttcttaaatacattctctatgaaaagcaatttgtactgactcaagttaccacatcttccatggtccttttagaagagatatttattcaaaagcagaaagataatggaaaccaagtgttttactctaagctaatgttacacaaaatcactaagataattttttatttcgttccagtactctcctttccattgagtcctccaggcctcaacccaaaccccctcaccagtaaccacaaaataataattcttttttatctgctacttagtctcagaaacaaactgtggagtcccaaaatcaggtcagctgacaaaattagccttcctcaactacacccataagtaccagtggatccaggccattcctacatccattcaccactgtccggctcttaagaaggactatatttagctcttcagagcccttggcagaaagagataaacattaaaaaacaaaacattattttgaactgaattgataccgtaacaaaaaagtaacatttgactctttaaaacattggaaaacacttacatggtctgaccctcagcaacacgaaaacatattcgaagcaatgagattaatgcttatataggcttttgtttgttttgagacaaggtcttgctgtggcccagactggaatgcagtggcgcaagatcacagctcactgcagccttgacctcccgggctcaggcaactctcctaccacagcctcctgagtagctgggcccacaggtgcgtgccaacatgcctggcaaattactgtattttttgcagagacagggttttgccatgttgtccaggctggtctgaaactcctgagctcaagcaacctgctcacctcggcctcccaaagtgttgggattacagatgtgagccaccacaccagcctatactggccgtttgttaatggcactggtaatattggctcttccccttagacggctcatgaggctagccactcttgaactaaaagaatgcacgtataacatacaaacataatgtctgaatccccaaactatagactttaacccaaattggtgaaacacaaaggaaaaggaaaagaaactttaaattgtttttaggcctgctgtttggatattacaggaaccactgtgatttatatttggcctgagggtataaagatctatgattttatttatggcttggttaaatcttttcaaaacacaagagccacctattcataatattaagaaatcaggtgatttaaaccttactacactctgctaatatactgttctcttcagtagaaacatgtaggagtatgttagggacaatctctcaattatgagcaaatttacaacttcaatgctgtcttcttaaattacatgccatcacttacaatccaaacatcatttaagagtttataagtttaaaaggaggacaaaacaaaaacctttaacaactcattattatttaagccagagttgcaccaagttaccccttcaattgtctaaataaattctagacatggcagcctactgaataaataaaagcaattgataatcccactctatagaaaagcaaaaaagcacaaacataaaatcaagagaccacaccgaagtagcatcatggagaagaataaacattttcaggacagaaaatgtttaagaagaacagcaaaaaagaacaaaggtaggtatattaaatgagcaaggaaggagtggaactgttgaaaggtggggtctaaaaaggctgtgacctgctttctaagtaaagcctagtccaaaaatgtcttgtgaccagatcaatttccattccttctcgaaagatggaagacataagcaaaacacatagagctatgaggacagagtggataatgattagtacatagaaaagttgctacttcgaaggattcagatattaagtagagcaattaaagaatttctccaatgacatcaatctcaaccagacggatgttctcaacatttcgcctagcaactcccccaggccatccttacagcaggcttagggaggtgctactctcttggttcctgctttcaaaaagggtgctgcctccatttagtgatgtttataaaaatggcagtggtttcctatttgaatgttaattattgttatgacacacaaggtaatttaacttgctttggtaatttattcacccttctaattagatgtagttactggaaaatcttccagagtgtagcaacagttccaaaggtgaaatggcaggaggagggagctttcccataggatcgcaactgtaaatctgggatggatgttcaattgccagtcacctgaatgaacaatgccagggatcagagacggtccttctggaatcaagcaggtggcacccatcaccttcaagaatttgatgattcaagaggaaggtaaagccccaaaagatggttggagctactctgaaaagattaaagactgaacttgaatgaaccaaggaacaataccacacaacaccattttaaatctcctagaccgggagtcatttacatacagttgagaaatgccgtagacagagtataagccaaaaacaccactgaagtgggagaggctccactcgagttacttgctttgtggaagtattttcacgcttgccacatcatacctgctcgatcaatatttactgaaacaagcaaatgaatgaatggacaagtgcatgcatggctacagcataaaaacaggcacacccactccatctctctcattacggcctcctcagcaagcagaccttttttcttaatttgaaggtccccaaagtgagcgagtttcaatcaacagaaatttctttgtctttaattaaactgagctgccactgcttcttctgtgaggtctaagtgccagcctgtagccatgttctacgctagccagaagggaaagactgaatcatatttgtgaccaaaaaaaaaaacccattagactccaatcaatgcagagcaggtggctgatgactgcagcgatccctatgaggagcacggattgatactgccaaatgaacacattaactgaaactacccaggccttaggggaatggccagaggcccctgtagggaacagtttaagtcaaacttttcctgcttccattgtaggatggaggattcaagggctcagattatataaacaagttcaaggccatgcaagaatgtatacagaaatactcaaacctctaaccccaacaggaagaggaagaggaggaggaggagaagtagccagcagaacaagtggaagaaacagcttccagtgaggtcactgcacccaaagaagaggagcagtcaagctaacgaaagccacatggcactgggctccagtccttccacttcagagtgatatggaccttcgcaaaaggcctttcaattgccctccaagaaagcgtctttccctctgttgtcctcttcactgtaatgcacaaaataatttattttggtgatgaggggtcctgatctcttgacatacagactgaaaaaatgggggttgtatgtgtgtcctacatataaatctgtcagcaaatattgccaccactgaattctattttctcagattgccctcaattttgccactctgaaataatgtgctgaataatctcagcaaccagaaatcatcatccaggaatgtttcttatgagacagctgatttattcggattcactagatcccttttagtagatttaatccccctttgggaaatgtaatagcaagaaaaacatcttttaaaagtgctggagtgaggccacttctcctagaagaagccagatggtcagatatatatttctcaaaacccatcttaaccttgagtatatgaagggatactacatttcattcctgataaattttggtttccatgttggcattgagctccaggctttctatgtgttgatagcggagatttggaccctccatccacagtctctttctaagtgaaggggaagattggtttttgctgttccttgttattccaaaagctctggtctggggcccatgttcaccctggctctcagtctggtcagatgcaatgttcttcaaaggtggggacctacttgttatcagagtagcagccaaaagaggaaaaggtgtgaattaagtactcagttaaaaggaaacatgagaccaggtgtggtggctcatgccaataaccccagcactttgggaggtcaaggcaggaggatcacttgagccacagagttcaagaccaccctgggcaatatagcaagatcccatatctaatatatctaatatagatatattagaaaatatatatctacatatagtagaaaaatatatatacacatatattagaaaatatatatacatatatgtatattagaaaacataatctctctctatatatatgtgtatatataaactacttatatatatataagtatatatataaactacttatatatataagtatatatataaactacttatatatatataagtatatatataaactacctattctatcttataccttccactcaaggtcatgaagatttgattttggagactgatgcaaatgtttgccacctgattttaaaactcaggagggttaggccgggtgtggtggttcatgcctgtaatcccagcactttaggaggccgaggcaggtggatcatgaagtcaggagatcaagaccatcctggttaacatggtgaaactccatctctactaaaaatacaaaaaaagttagctgggagtggtggtggatgcctgtagtcccagctacttgagaggctaacgcaggagaacagcttgaacctgggaggcagtgcttgcagtgagctgagatcgcaccaccacactccaagcctgggcaacagagcaagactctgtctcaaaaaaaaaaaaaaaaaaaaaaaaaaaaaaaaaaaaaacaactcaggagggcagaagagaatgggtaatcactatacctagtttccagcaagagattcctccctttagaaacactccccagaactgacagaaacagagaaagaggcgtaaggagccataaagagatgtgacgtgctttaaaagcaacaaaatatcagggaggaacatactctactctaatatgtccatcataggggttctatttgtttcctacagataaagtgatcatttaactatgaaaattactatcattcatctctccacatgcattcccatccttgagaagtggtaggaaccatgcgcctctgggatgtggaaacaagtgctcttgtgaacagaggtttcattccactgagagaaatggccatgcaaagcagtgtctcaagagagcaaggcaaatcaatgtctcgcctagagtatattttacaaatttctaatacaaatgattgcactgaaggacaaaggttttcctgtactcttcctccatccaaccttcaaacagatacactagtctcagctctagtggaagtaggaggcatccttgacattatactcagctgtgatgtaaggaatctgtgtacttacaaaactaatgcaaagcatttcaggctgtcagctgacatccctgccactccccacagctgagactattcagtaatggcagtacatctgacatcctgtctgacatctagaggactcaggaaattcaaagaaaatactataaattctatcatttcatgattcacacttcatgcaaccaaagatctcctctacacaaaaacacaggaaatgtcagaataccccataggtatgtgatttttcttaacttgtatggttttatttataagaaataaattcagttactgaattatgaaacagacacataggggtcccctttgggatctagtccttaagatgcgttcaagaggatgaaggatgtccatctctgagatatattagtacttctacaacccgtgtgccaagcaccagtgggctaacatatcctccagatacatagacacaacttaaagcagagaagccaggtagagagatttgaaaaatgaattctaacactagcatactaaattcccaaataaattgtttaattacattgtacctacatttccccaatgatcacgtagagataattacctttgcttatttcacagggggcatttgtaataataaaaagaattatttgaaatcttcaaagaaagagcactattttaacctacttatataaggaacagaaagagaaaattgagttaacagtcttaaattctgccaaattaatctaatttttaaaaagagagaccaagtaaaacctcaccactgttgttctcatcgtaactgaaatccagcacattaaagagagagagaaagagatcaacttttaaaacttgtaaaactccatccctggtggccacaaacactcttatcagttccccactgaaaacccctcctcgccatctcccttccttcccctttctcctattacctcagccttcactccacttaatcttcccatctctcgacttctctatcacctcttcctccctgatagttatgacctcactcccactgtcacacatagaactgatccaaaggggacctaagaattattctaaccaatctcccacacagtaaaaaggacaactggagactgaagtgataacgtcacaggctcagggtcaggtagccactttcatgcaaagctgggtcctcacctagatatatgactcccagtacagtactctttccagtaccccacacaacagtctacctggacctgttcaccagccttatccaagagatccatttctgaaacagttaggtgcactttgttgttcttccaccatataaagcactttgagtcacaattagaaaaataaaactgatgacagcaatcagattagaatcctgtatctggaagacacctttacccataatccatcttatccaggaagtaagactcaggaggccatttccacaatgcctctcctccccagacactcattcctatgttcaacatcacttccattgctcaaacctaaatccttcctaatgatgatactgaagcaaaatcacaataccaggttttccagacccggctgagaagacactaactgagcccctaagtacaaatgagcatacttaacatagagaagacacagttagcacattgctaaatttctccacacccttatttttagcagattaaataattgtaacccctttaactttatcttctaagtctatttttggcttttatctaaggcccctttaaattctccatgttgcttttggaaagctagagtccagaaccaaggacaggtagctaaagtgtttcacataagagaaactccatcaacaaaagtattgcgaagtctgtacaagcccagggcaatcaatgaaatctgcatgtaaacgaggcagttttccagacaatacttttcaattagactaacttacaaacttgaggaataacgagaaactacaaagaaaacatcaactgcgtcttcaaagcattttcaagcacaaaccctaatacagtttactggatgccatttaattgggcagctctaagcatgtagctaaatacaagaaggttggcataagagataaaaaagcaaacaatgtccaagctacatcacttaaatactgtcagaacaaggttaagaagaagcaaggtgagaaatcagggaaaatgcaaataagaattccatttcctacaagataaagaaagataaataaaaatcctgactagctaggggagtatgtccagcaccaaaaaaaaaaagtaattatttcatgtgtggtcctgatataaagtcttgaaaataataaggctgctaaattgcaaatatcagggaagtgaagtagtagctcaaaagattatgaaaattgagatttccaaactgaatttgaaaaggaaacaggtaaaatgaggtcaggacattacagatgagaaagaagcttctactatttggctggctgttttaaattaataacctggaacattagcaggtttaaagtcctataaaaatgacacggagggagaagtaaatgcggtagaaacagcagtgtttacaccttcatcatagaaaggtattactaaaaggatttacaaggtggtaacaggatacatatcaaagtcaaagcgctttaataaatgatgagaaaagacattaggcatggaagtaaagccgaagggcttgaaataactccacctatccacgtcccagattattttaaaccaagtaagccactccaagatccacaaaagatcaggttgtatttttccctaagtggcagtattcccatgagcaccaaagcagtaaaggcagtaggtagaaaaaccaggagttaaaagaatataaaacactagtcctttctgggatattgttacacatgctgaaagaatctaaatatatatatcatgacccaaagaggtctcaggcttaaaatccaaaaagaaagaaaagcaagtatattgcccttttttcctattgggaaaaccttgtaaccactgaaaaattagaacagataaataggaatgggtcagtataattagtatcttctaattatagaagcacccagattggcatcaaactcaccaactcttggctgtcttcaacaatgaccaggcctcctctggggagactacttcttgccatcctcaatctgtacctcagatgtgtgacttcttgcttctaacaatatcacagattatggactaaatgtttgtgtcctcccaaaattcttacgttgcagccctaaccctctgattctatttggagaaggggcttctcagacagtaattaaggttaaatgaggtcatacaggtggggacctgacacaataggattagtgtcctcacaggtagagaccagagagctcattgacctgctcccttcctccctgtgtgcttgcatgaggaagggccatgtgaggacttagcaaggaggcaccatctgcaagccaggaagagagacctcaccagaaacctagtgggccagaaccttgtcttaggcttctagtgttgagaactgtgaggaattataaatttctgttttttaagccacccagtctgtggagttttgttacagtaccctgaggtggctcagacatacctaccacattgatgcttaatagtgactacccaaacagcaggaataaaagtttcaatttgtttcttacatttcctaatgcaatgctctgtaaggctagatgttttagaaatgctttttgaacttaataatggttttaaaaagtcacagacttcaataacagccatcattttctataagcactaatggtgttatatgccaagaatttttaaaggcaaataaatttttcttcttatctaaaaagctgcctggagaatgctcacccttcctttactcactactgaaaactgtcaatagcaattcaagtaatataattccttttttttggaggcagagtcttgctctatcccccaggctggagtgcagtggcgcgatctcggctactgcaacctccgcctcccgggttcaagcgattctcctgcctcattctcctgagtagctgggactgcaggtgcccgccaacacgcccggctaatttttgtacttttagtagagacagggttttgccatgttagtgattctttttttttttttttttttttttgagacggagttttgctctgtcgcccaggctggagtgtggagtgcagtggcgcgatctcggctcactgcaagctccgcctcccgggttcaagccattctcctgcctcagcctcacgagtagctgaaactacaggcgcccgccaccacgcccggctaattttttgtatgtttagtagacatggggtttcaccatgttagccaggatggtctcgatctcctgatttcgtgatcacccgcctcggcctcccaaagtgctgggattacaggcatgagccaccgtgcctggctggtaattccttttcaagaattacaaacaccaaagtatcttgtacaatggtaatttatgtgcacacgtatgctaaaaatgccaaaaagaacttacacaatttttacatacataacatactttagttccttgattctatgccaattcacctaaatattaacaaacttaggacagtggaccttgggcttacagaatattaaattgtagaataacagaatcataaaatcatagaatcacagactagaggtttgtctcggtcaaatctcaccattttttttaaatgaggaaaaccagagctcagtaccttgctcaaagtaacataaatagttcccttaattcccagaattgtggttttttactgtattgttaagaaataattttctgtaaagcaaaataatgattctcaaaattaataaaacacatataaaagatttaactcactagaaaatgagtaagatgctaagtctgatttttaaaagaattcaaagaagacacaaatacataagcatcagaaatgccagcaagatgtaaaatgtgcaaaactagtcaatatgcataggaaaataatctattgcattctccaaacacaactgcattttatggacaagaaccaggcgctttactgtctattttctgcagcacacacaattctagtacagctcaaagacagtgaaaggcagagctgacctgatggttgagtagacaaaacatgctcttttttttttaatcatttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacggaacaacttttcgctgtgactgaagagatgaaatgtaaaatgaggaaacacgaaagaagaaatggtctgctacacaaacatacaaagtaggtgtgatgtgctagataacgaggtgatgtgctgatggagctcaactctgaccccagttccacagctccagtcaaaagatctgcgtttaagaaaggagaaacaaggtggctcatgcctgtaatcccagcactttggtgcggtggcgcacgcctatattcccagctactcgggaggctgaggcaggagaatggtgtgaacccggaggcagagcctgcattgagcagagatcgtgccactgcactccagcctaggcaacagagtgagactctgtctcaaaaaaaaaaaaaagaaaagaaaagaaaggagaaacaaataggaatgaagagtggaaaagatatcaaataaggacccaaaagcactctgagaaaacaataaggttcttatgtcctgtgttcaggcaaagaaacacaagacatagacatgaagagaacagaaagcaaggaataatgtttaaaactaatttggcacaattttttttcttttaaaatgctcaagaggatcattgcagaaaacacagtggtaaagcaagctgctgagggatttttcaatagctccactgtgaaaaaacaagcacatcttaaaactacaagctttgaaacttttaaatttcttaattaaaatatttctagattccgttcatttctaagcaagactgcagccctaaagagaccagtaaatttttattcatcttttttgaaacaaacatgattaacaagtcattgtttgaatagaaaactatgaattaaacaaacaagcaaacaaccccacaataatggaacccattccttggagataatgacaatgcaaagtacaagaaacccattttgaagcattagtttcatgtgagcacttgttgacggaaatattacaagaagtccccctaagaacagttctcttcattgtcgtatcaatggtcttggtggctcacattcctcacgtgcactgagggccgtcttgataaaaagtatctagtagacctcttggtgtcaagttgtaaagctcgaacttgttttgggatttttaagaatgtataataaatatcgatttattaatttacaataaaaaaactaatgggtgaaaggactggacactcagcctctgaccttcatgttttctccctgcataggaagtcaaactactatcagaatgttgtcgtgtctggcactacagcaagagcaatgagttgcacaaaccatgaagcaaacagactgttcattcatccagcacgtcctggcctagagctagaaatacagcagcgaacaggagcgatcagagtccagattggactctgaaaagaggatctccttgccccaggagctgtgcagtatggccccagttctagctttctctggcctagacaatgcctaatggagccctgcaaagattcacttcactgacttttttaaaaatatttttatataacataaaattttcactttaaccattttaagtgtacacttcaatggcattaaattcaaaatgttgtgtaaccatgaccactatttccaaaagatttttgtcatcccaaacagaaactctgaacaagtttgctttttaaaagtggcacaagttactaacatttgtggttgacatttttttttttaatatctatgttaagaactcgattataggcctacccataatatgcttctttaagaggtctggggccaggcgtggtggctcatgcctgtaatcccaacactttggggggccaaagtgggtggattgcttgaactcaggagtttgagatcagcctgggcaacatggtgagaccctatcgctactaaaaacacaaaaaagagccaggcatggtggtgcacatttgtggtcccagctactcgggaggctagtgaggaggatcactggagcctgcagggcaaaagctgcaatgagccaagatcgcaccactgcactccagcctgcgtgacagagcaagaccctgtctcaaaaaaaaaaaaaaaggtctgtatgtttcattagccattgtgtgtgtttatgttaaaaatatgaagtgtttcacaaatttgcatgtcacccttgtacaggagccatactaatcttctctgtctcattctaattttttagtatatgtgctgctgaagcacgaactagccattgggttttgattttataactgttttccagaaggcaaacttctaacttcttaaagagaaaggtaccttgttgccatgtcctccctcccaccccactacacagaggcgctttcttctacaatgcacactatttcatccaactcttacaaatatctaaagagatgctatcatcagctttttagacataaggaagctgagactcacaggaatgatatttctcaaagctactcaggaagcaagggaacaacgcaagtgtcggtaacagttattccatattggagcatgactgactggatgaatatatgtttgtttttgctatacagctaacattaactggttctaagactgaatactgtattaaatttgttattaaaatacatactcctataacaagaagggacatataagacaaaataggaaagatgaaaaggttttaaagacacaggagaggctaaagaagtgatttttaatggatatactctgggagaaattctcaactatttccctacaaatgggtgacattagtcacttagggtggctgccttttttctgaaagctatcagacatctccatgggcaaaataaagaaagagaccccctacggtttatttatgtacgtatcatggtagcactccgtggttttaagacatattgaaactccatcatatgctgcttttaaagcccaaataactaaaataaaaactcccaggcacagcaacggcaaaatactgtcatttgtatgtgcttaggagacacgtgtctctaaaagcaacatgtacatttctcttttcaagcaaatgtttaaagaactggcaccgtaacaaacaaggggaaatatggagatcagttttaaaggcaggatttgtttttgtggagtctaatttatttcaagaaatccagattattaaattcacctcctatctgaggaaggatctcaaaggaaaggtaatacaggctagtcgtccttaaatgcccaagtccaaaagactagtatttaagacccaagtttatcacttactaagtgtcagaccttggccatgttacataatcgctctcaatctgtttcctcaaaataatactgcttaacaaaggattaagtaaaatggtgcgtataaagcaccacacacagaccgtagcgtatacttaagagttttatttcagcattagaaagcatgggaggccgggcgcggtggctcacgcctgtaatcccaacactctgggaggccaaggagggtggatcacaaggtcaggagttcgagaccagtctggccaatatggtgaaaccccgtctctactaagaatacaaaaattagccaggcgtggtggcaggcacctgtagtcccagctactcgggaggctgaggcaggagaatcgcttgaacccgggaggcagaggttgcagtgggccaagatcgtgccattgcactccaacctaggtgacagagtaagactctgtctcaaaaaaaaaaaaaaaaaaaaaaaaggaagcatgggaagtaggggagtcgctaaagctcactgatttaaattactactcaattagactaaattttttaaaaatcatgattttctttgtccccctccccaactcacacacaaaaagccaacactatactaaataatagaagatagtcgaggtcaagattttcaccttgttctccagctatcattttttccctcccgacttctattttggattaaggtatttcaggggccccaacatcaaagtagaacagaagaaggaaagcaagagaaaatgagaggtaggaactagaaaagccagtatcagaaaagcatacagcacttcctcactatactagcaaagcttaccatgcaatattcaacaggtaaatcctgatggatggctgacaccgggttcaagacactagtccacatgctccacatactgaataccctaaggtagttcagagagaaactgaggggaagacggagaaaacgcacctcacggtgcattctgtatgtcactgccttacacgcaggagtttcaatgttttggtaccaattaaagaccaactatcagttctccatggaagcagcaaaatataaaagtatccttgaaatcagtacagggcccttctgcgagggtctggtgatgtggttttgagattctttgttttggatcattcctcgtttggtggacccacaaataatggtcctgcctagaaccatcaccgcaagctagagtgaaaaaatgccagaagactaggctggtgggtaaaaaaattcaacgtttttcctcatgattaaccttgggtggccttgacaagttatgtaaggttttgtttcttcagaaagacactgcatttttagaacatctctaggcacaaaaattagtcatgtaactgaaagacaagaaaattttaagcatatattataaataaatgtgaatattaggggtgtgtatccaaacacatgaatagctcttaaaagaataagacaaaaagatcaaacatatttgaaatcagagagatgtcttttgggaactgaactcttgccatgagcaggagaaaaccagaaaggtcttcatgggttctggtacctgttcaaccattaattcatgatgtgtcgctggaaaaagatcacaaatgtcttcaagcttcattttccctatctgtatctgcccaagatctcactggattctcgaagaatcaaatatgataacacagtcattcctgaagtatggccacggaccaacagcatcagtaagtcaggaacttgttcaaatgcagttgagtcccacccagtcctaataaatgagaaacttcagcaatcggttattctgatgcaccttgaagtttgagaaccactgcacaaaaacagatacaatctgaaacatctgaaaacactggagtgttgttattacggaaaaaattaagaatcatacattgaagatcttaagaactttcacttaaaagttggatacagaagaggctatgtgtggcttttgttgttgtttttgttgctgttgttgaaacaaggtgtcactctgtcacccaggctggagtgcagtggtattattatagctcactgtagccttgaatacctgagctcaagcgatcctccttcctcagcctcccaagcagctggaaccacaggcatgtgccatcatgctcagctattttttattttatttacttatttacttttttaatttataagaaaagaggtttaattgaagaaattggcaaaaagaaaggggctacagaactcctgcaactttggaacccagcagggcagttgttaaatgttaaagctccaaaataacctggctcatttttaatttttcttttgtagtgatgaagtcttgctgtgttgcccaggctggtgtcgaactcctgggccgaagcgatcctcctacctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgattacatattctttaaagagtaaatatgagactaaatgtatctcaatccaactattaataaaaaaagagtgaacttgagattagctctctctagggaaaaaggagaacagtaagtcctcctgggatctttacattttcttggcaagagtaatgcattcattgcttttaaaaaggtaaaaggtaaagtcaaaaaaaaaaaagaaatgtagttacaaaagatgcatttcaattgataatgaaggcttttaatgtaatgattataggaaatcttggaggagttctaataagtacagccaaattaagaacaaaatatgctaagaaaacagagaagtcatattgtttttcattctacattctagttaaacccaataaaacatgtgaagacaaaagtattcctcattagaagtatccttaggtcccatttatcgtcatatcttgtttactaccagttaagaaaatatggtactacagcctctgacaaattagggacaacctgagagccacattggtagaaacatacagatctgaaaaaattctgggatgaaagtaaggaagaagagattggaagaataaattaacatttaaaatacaacaagatcacatagaaatagaaatagttcgatgaaaagacttgtccataaaaagcaaaattaccaactatctggagatttaaattagactgtactgatgaatgtattcttcagaatatgtttatttgtatgatcttttacgtacccttcaataaaactctagactaagtccctacgacaaaagaggcagccccagcagtggccttgtggcctgatctacagagacagcaagccgccattcactgacccacccccatcacactggcaccccacgtttctctccaagcttcttccccacagtataaatcagatccaaattagctgctagtcataatcagcagaaaggatggagaggccttacagttaccttagacacagccctagtggtcttctcctacttcctcagggacggcctccgccagcagcacaacagcacacttcctgtagatctacaatcagttcttccgagccgcagacggctgctatcgtcctcgcagctctccgggtactcacgcttctttttctccctctttaattctaggccttcttttctttcttacctttgtgtcccctttcaagctttcccttttattcaaacgtacaccaaaatggcaaaagcagcaaagcattctaaatcatgttcacgcaagccagtgctggggaacaaaatggatacaaattggtcattatgttctctttcatttgggggtggcgcacaattaagagaggtacgctgtttttatgtacttctctataactgcagctctaaaggttcctcataccatcatgaaatttaagaggtacatgagcaatggcactatactgggaaagttaaaacaaaagatttattaacctgtgggttgttgttttaaaaaagtatcaagggggtctacacacttcctaaggggaaaagtaaacatttttttgaacacttcatatactacagttcttgtggggtttttttgtttttttttttttgacatggaggctcgcccagtcacccaggctggagtgcagtagtgcgatctcagctcaccacaacctcccacctcctgggttcaagcggttctcctgcctcagcctcccgagtagctgggactacgggcatgtgccatcatgcccggctaatttttgtatctttagtagagacagggtttcactatatcggccaggctggtctcgaactcccgacctcgtgttccgcctgcttaggcctccgaaagtgctgggattacaggcgtcagccactgcacccggctgcatgccacagtttttcacagacattatctcacgagtagacatgccaaacctagccatctagagctgtgctatccaaaaggtagtcactaaccacatgtagctatttaaatttaaaacatcattaaaattaaatttgaaattcaattcctcagtcacattcaacgcatttcaagtgtttgatacatgaaaacggctactgattgccatattgcacaacaaagagagaacatttccattatcagagaaattctacggcacaacaatgatctaagtctccttcacgaagattttccacaaaaacgtctgaagaattacattgggtccctcgtacaatgaagattaattcgctcacactaaagctgtaactacaatccatatacgtgtgttctcttgtacctgcagccaggttttcaccactgccagtttctacgctatacttggcctactgagagctccagtcttttacaaacacttactacatcctaacctctcttgaatgtctggcaaaggtttggatcaaaaaagacatcacatttttgcacatatgacataatacttgtagttgcctggaaatttattggcccatatgaagtgggatccccggggcagtgacaaaactaagtttatgctactgaggttttgcttgcccaggaaatataaaaaacttgtgactgtgaagtcactaaataaactaatggttttaataatgagggcaaaaaattattttaataggtataatgtcattatcaaaccacagaaaatgctatacctgaaatagagttcaattttggttagatttcctttaaagtctcacaggactcatgtggtacggggcctctgtgacaataggtaacttttcataaatgcttaagcacatctggactctactccagtgacctacaaggtaatacatcattctgtcagtttcagaggtacattcacatcctattctccaaaaccagaaatcgcccagggattcctagaccatatgacatgttgctgaaggaatatacaaatatatacacacaaatgtgcgtgcacgcgcgcacacacacacacacacacgcactgaaagaatattataaccattcacctttcttctaaattttaccttctgtgttaactttccctgtgttgacaaagaatgcctctcactaagtcatgaccctgcaggtcactgtaatacaacatcgcatacctggattattataatgggtgaagggttcttacatatagctcaaccggaggttaggaagccctacgaacactcagatttttgcttcatttttaaccaaaaggggtcagagcctttgtcaataccagctgttgcagtggttggctgcctgtgataataggctgcctttcacctgaaagaatgaaggggtgtttctcagagtaatatcttacgatacagaggatgatactgtctttaaagctagtgaaaatcaattttactgtcacttctttatttaaaaaaaaacctccctttgcagaaatatcactgagatgtcatgtttaaattttttttctacttcacattatttataagccaatattttaaagatttttggcagttctttaggcctgggcaggggtgatatttgcccagaatacatctgatatggtctcctggttgtttctaaatttcctgttttgactgatcaatgcttgtacagtgcttgttattaactactagacaataactcctgggtacagacactgctccttgtcttttttcctttgtgtaattcagatagtaaatgtccagcaaaaagcaagattccaaggggtaaattcaattgctgacgtatttgcatttctaattctaatccaagttaaataaatgaaaaatccactgtaaaagagaagcacaaaaggcaaaatcttcacaatcattacccagggaatcactgctttgtataaaatcattaaaaattatcttgaaaaataataaaagcaagttgactgagacaattatacaattctaagaaatgtttttagaaatgttcttctaagtattgttctttttaaattttatttttggcaattctcaactgtaactacaatacaacattctttccccaatgaaaaacaaattttaaactatttatttaacacttttggccaccaacatttacagaaatagttgcttagtatagcagctcaagcagcttaaaaaatttaaaagttaaaactttcatagggcctagaagcaaagaaaactcattagcaataaacataaatagtgcccaatcttgttttctaaaactattctccaatttctaaattctccaatttctaaaactattctccaataaaagaaaacagggcacattgaagaaatggctgcttctaggatatgagcaggaaacataaaaaataagcctgaagcatcttgtagtgccagaaagtgaggaggtgctaaagaaaaaaaaaaacaactctgcaatgatgaggatatgtcaaacggacacagaaatcaactgaaaaagttccctgcggccaaaagttagaatattttgggcaagaacataaagtagtattggattataactagagatataaaataaattgtgtacgaatacatactgatataaataaaagacaaatctcctgttcagaggaattccaaataatttacatattaaatactcctccttcaaggaggtggaacgtggctcccctctccttaggtctgggtggtgcctagtgacgtccctgtgacgaggacagtgtggaagggaaaaggaggagctctgcagtggcgaaggctgacaaacgcgacctcagctaggtgatcaaggtcaaaatcaacaagtcaagtcaatagagcatattccaggtaggatgtaatgaaaacggcactttatctctgtggtcttcctccccaaaatccgtaactccactctaatcatgaaaaaaaattcagacaggtattaccttctttccacgtaaggtacgttctacaaaatacctgaccaataatattcctccaaactgtcaaggatcatcaaaaacaaagaaagtatgaaaaactgtaccaagagaagcctaaagcaacacaaggaccaaaaataacgtggtatcctgtgtggcatactggtacagacactgggtaaaatccaagggaatctgaataaagtatggactttagttagtaccagtatatcaatattggttcattaattgtaataatgcaccatactaatataaggtgtcaatagggaaaactgggtacagaatatataggggaacactctgtactattcacaattttgctgtatatctacactttctaaaatttaaagtctatttaaaaaatttaaacagtctttccaatactaaatcatactgcatacaattaaaaatatttatttgtttgccattgtaattgtggttaagagtgtgggctaggataaaactgctggatctgaatcccgttcccctgtctaagttgatttttactattaatagttatgtgcttgacctgtacacagtatatagctaacacgggcccattctgacatcagttatgttcagcagtctttgctttcccagtaagagaaaagaagacaaataaggcccaatcagcccaaagcttctcatcacagggtagccatatttagtaaagaaccaggcaacatttgctgagtatcacagggactaaacctggggcaaactggacccccattcacagtcaaggcaggttctctttcccaagaacagatgtaaccagcaatgtgaataatgcctctgggcaaagtgcaggactgattttaagagctgtcagcaatttcacatgatatgaactctgtttatttctaatattcaaatgagctcaactaatgaaatactattttattttcataagcaaaaagagcagtaaaatgaatttgataaaaaatatctgaagacacattcaataagaatgaccggggtacatagtatgttattcatcttttttaaagtctacatgttaaaagatttacaaccaatgaatgcttcttaaatgaatattcatacagcaattgcagtggcttttttactgcctaagagagtcattaaaggcttgtcatcctggcccagcaatgcctctggtgcttctaaatcattagatcttagtctactgctttgaatgttgtaattgcaacataaaaatgagaaataaattaccagtatgaacaatcaaaggtcacgattttcagcaaaagcttagaattttatagtggcacctactttttaatataaacgattaagggtatttttcttgaccagactgagtaaataaacagatgcaattaatgaaacaaatgaaaaggctgagagcaactggctattctttaaacagattataagtaactaatgggcattaaagggttttttaatgtaaatttttgcttataatttcaacttctattttagattcgggggtacatccacaggctcgatacatgggtatgtagtgtggcgctgaggcttggggtagaaatgactccatcacccagggggtgagcctagtacccaatgggtagtttttcagcccttgcccccatcccctcttccccctctagtagtcccagtacctactgttcccatccttatgtccataactgatgtttttagagttagattaactgtcactatacctaatacaaaattcagtctgggattgtgcctcaggctatgctccacgtctgctactactctaagatcacgtgccctctgtgaagtcactgagctgagcacaccccagggacagggaacctgatatttctcttctatgaatgcactcagcacctcacactggatatataaagaataaggaaatcacttaataattcttggattaaacaaatgaatgcatctgcttgtggaattatttccaattcagtgcaccaaacagggaactttggtatacagccaaccaggctattttaagttttgttttgttttgaaaaaagtatttactgtgagggcttagagcagttacagggctctaaacagaaattactggatactccctcccttcaggacaacgtttgacacatttccaatatcttgtcacgtacaaaattcagaagagcacacctgattcgctggcttggtggggtggatgcttaccaggagatcttgattgacaatgacaccaaggctttatccaaggtggaagttaaacaaagtaaacacggagatgctattcctagaagagaacagcatagatgctgagcgagaatgtacacagacagccactgtaacagagaagatggagaacagcgtagatgctgaacaagaatgtacacagacgcccactgtaatagagaagatagagaacagtgtagactctgagcaagaatgtacacagatgtccactgtaatagagaagatagaggagaacagcgtagacgctgaggtagaatgtacacagacgcccactgtaatagagaagatagaagagaacagtgtagactctgagcaagaatgtacacaaacacccactgtgatagagtagaggagaacagcatagacgctgaggtagaatgtacacagacgtccactgtaatagagaagatagagaacagtgtagacgctgagcaagtatgtacacagatgtccactgtgatagagaagacagaggagaacagtgtagacgctgagcaagaatgtacacagatgcccactgtaatagagtagagaacagtgtagacgctgagcgagaatgtacacagacgcccactgtaatagagaagatagaggagaacagcgtagacgctgagcaagaatgtacacaaacgtccactgtgatacagaggatggagaacagcgcagacgctgagcaagaatgtaaacagacgcccactgtgatagagaagatggagaacagcgtagatgctgagcaagaatgtacacagacgcccactgtaatagagaagatagagaatagtgtagacgctgagaaagaatgtacacagacacccactgtaatagagaagatagaggagaacagcgtagacgctgaggtagaatgtacacagacgtcactataatagagaagatagaggagaacagcgtagacactgagcaagaatgtacacagacgcccactgtaatagagaagatgcacgggatgggaacaactaacaattccccaggaactacagtaggcattttgcttttcatatatatgatttgattctccaaacaaccttttgacgtgggtattatcaaccccatctttctagagccgaaaatgaagttcaccaaatttaagttacttagctaaagtcatgatatcaaacctaggtctttctaacctcttctacctcccaaccaaaaaaaaagtttcttatcaaagcatcatgtgaaacattaaatccatgaagtctcagaaatgcaagtcatctttgaaaacaatgtttcttgacaacgaggatttcttgcccccatattaacaaggttttctcacaacatattcagcaaatctttttcattcaatcaaaatatgttatttgcttttatataaacctaagtttccatggctattgacagaaaatggtgataccaacgtgacaagtacaattcttacagacaaattaataatctgctcatccctacaagctcaagattcccctctaagtaagtctatcagtccttatatatggtagcagtaataagagataccagatgagaatatggacacatccacaaaaattgctaatccctaatggcagtcaaccttattaatagggggttaaagcaggagcattttttaaaccagcgcaagcccagcacttttctaccatgcagaaaatgggtgttcatctctctggatcagcttaagcacacgcatgctattttgtttattatttgggtcactatatctgtaacctaagcagatggtaatatgcattttatatgaaatatttaattaggccatcaaaaacatggcagtaccagctgtcacggcctgctgaccttgggaaaggaggaagtatcagcaaaatgaggatgacaatgttcagatgaaacccagaaatgaagtgtttatgaaaatctcagttgctctaacttaccacacttcaaaccaagaaatgtcacggaagcataatgatccggttcacatcaatcacctacaggtccactgggtttattaaaaactattttcaggccaggcgcggtggctcacgccagtaatcccaacactttgggaggccgaggcaagtggatcacttgaagtcaggagtttgagaccagcctgggcaacttggagaaaccctgtctctactaaaagtataaaaattagctgggcgtggtggctcatgcctataatcccagctactcaggaggctgaggcaggagaatcgcttgcacccgggaggtggaggttgcagtgagctgagatcatgccattgcactccagcctgggcaacagagactctgtctcaatttaaaaaaaaaaaacaaaaaaaagccatttttaaatgatttatactgatacatacatagaaaaactggaaatatgtactgcaaaataataattattatttctagatggtgagctaatgggtgatttttatttaatacttttacttaacgatattttctataatgtacttttatgatttgaaatatttttaatttaaaaaaacagtgacatatacatatcagtccttttatttagtactgtagttcctgaaacactgccttaaaaatccatttttctcataaataaatttgaacacatttgatcctttctcatttctacatgaccacctttacatttttcatatctgaccgccctatcattggcctatgaagctttccaatctcttagcccaagttctttttccaaccaagtcagaggactcctgctactgcaaaccccaggctgggccttgactctgcctgcaagaattcagctggaaccgagtcaactccttccccctttcctcagaggcttttccagagacttctccctttcctcagttccccaacccatcaccatctccctcaaatcatcgaaatgtgacgtattaaatccacgcacagtctcagaaatgcaattcctccttgaaaacaacagttcttgacaacaaggacttcctggtatcacgctagctaacaaaatatactccaaatccttttccattcaatacattatgatacctgcttatgcataagcctaaagcctccatggctagtgagagaatatggtgataccacagtaacaaatccaacccaatcactcctccacctcttcgcccagaaaataaagtctggaggctgggtgaggtggctcacgctttaatcccagcactttgggaggccaagatagtggatcacttgaggtcaggagttcgagaccagcctggccaatatgggaaaacccgtctctactaaaaatacaaaatttagctggtcgtggtggtgggcgcctataatcccagctactcaggaggctgagacaggagaatcacttcaacctgggagggtgaggttgcactgagctgagatcgcaccactgcactccagagcaagactccgtctcaaaaaataaaagaaaagaaaaagaaaaagaaaataaaggctggagacttaagaactttctccagtttccttccctggtccacagcaaatccctctgaccccagggctttgtttccctctcactggtccttcagtgaaattaattcaataaatatccacagagctttaatccagatgtgtgcaagatattggggatttgttcagccaccatcagacacaatctctgctccatcaattctctcccgcttctggacgccagcacctccccatggttgttcgctagagctgccataacagaatactacagactggtggctgaaacaacagcaactgattctcacagttctggagtctggaagttcaagatgaaagtatctataggtttggtttcctccgagccctctctggctggaggagccactgtcttgctgcctcctgacacggcagtccctctgcgcacatgtgctgttggtgtctcttcctcttcctacaaggacaccagtcatactggactagggtcaaccctaaaggcctcatgttaaatcacctcttcaaagaccttctctccaaatatggtcacattctgaagtaccggtggttagaacatcaacatatgaatttgcggggacacagttcagcccagaacacactctccttctcctgggtttctcacttgctcctggctcttctacctcagtcaataacatcctcaaatctttttcatatttaatgcaccaacaacccactcctagtccagatcttccccctgtcctatctagctgcttcccatcactgccaagatgtgaaaataccctaaactagaagtctcaaactcaaatatagaggagccaggagaatcctaagtggaccggatggagaacaagagagtaccagtgcctgctaaaggtggagatcactatccattgccagctaacttcagtcaggtgtgaaaacagagcccagggtatctactgtgttttgtaagagaacccagaaatatatttatatgtaatttcccaagttttatatgctgataataaaaacagaaactccccccaaaaactgtaagtgggccaaataaaataggtttataatctatttttcccctattttttccctataatctcttaaatttactttccccatttcctgacctgtcactcatcctcacattaatgaaaacaggcttctttgtaccaattccttttcccagaccccacttaaacagctaatgctgaagcccccatatcttacctgccatgcttcccttctcaagtgtgagctccttgaaagcagatcctgtgtctctatatttccagtgctgagcactgtgtccagcatagaatgtgggctcagtaaatgattactaaataaattggcttaactctttctttagaacaacccaatgaaatggaggaatgataaatcaaagaatcttacctttgtcaaagctcaccacttaatttacctatttgcttcactggtttagcaagattctggaccatcatgtcacatatatactcttacatggcacgacagcttaaaatccccacttttccttcaaatggcacaattgagcttccaaagagacaaatgctgatatcattctgtcatttacccaaaaggtccatttatctgcatgcttaacattttagaacacagtcaatcatcagaaggtaagaaaaaaattctatgaattgtcaaaataggtgattaatgttcattcattaatttcactcataagcaaactcttcaggccttgactcagaatctcctggcttttaatttttaaactattctaacataacttcatttgcaggagaaatacatcaggccagaactatcttttacatctgttagcctgagagccagacttaattcctgagataccagtgtgctgctctgcggagggggttcctttgaacccactccgaactacactgaatttagcctcttctcatctgtcacttcacttatgaactgtcaaaattactccagaagggtggagtctatgaagatgacaataaaagaagttttgtacttaaaaggaggcatggaatttagacgtaagaagacagaaacctagggtggtccttacaaggagatacagttcagctatcacaaattagctcaagaaaatacttaggtgtcatctctttctaacaaagttattttcttgaccaggaagcttccagtgttccaatgaagtgctccaaaccctcttttctttcactataaatgtgggcatggtctccctcctggagtcctttcccatgaaatatccagtacagtcatgcgcagtctagccacaactcgccacaggaaaagcacaatatgagggacagtgttcactctcatacatctctgcttttgttcaatccaggcataacaggaattagacaggactagattaaaagttcccagttccggcccagcgtggtggctcacgcctggaatcccagcactttgggaggccaaggcagacagatcgtgaggtcaggagtttgagaccagtctggccaatatggtgaaaccccgtctctactaaaaatacaaaaattagctgggcatggtggcgagcgcctgtagtcccagctactcgggaagctgaggcaggagaatcgcttgaacccaggaggcgaggttgcattgagctgagatcgtgccactgcactccagcctgggtgacagagagagatgccacctcaaaaaacaacaaagacaacaacaacaagagcaaacttcccagttctgctacactcttaaggcaagttactaaacttttctaaatcttcacttcctcatatgtaaagtggggatcacaatattaaagcctataaaagggtgaacaaatactaaattcactggtgtgatgaattacccatcatgctgtcttcaatttccacgtctcagctgaggctttccctgatgctgcatgtgtggcaaggatcgggctttctatagaaaatattgaataaaataatattcctccactgtttttaggacaacttcaattagatgtggaaatactagggaaaaaagagtagtcttaaaatgtattttataaaaatctagatacaacttaagcctaaaataaatttaaaaaaagaaaaacaaattaatccagatgacatataactaaacatcaaaatggggaaggaaggaaggaagggaaacctacattgaaatctattctaccataaaccaacatgaacacttctgaaaagaatgtaagaggagttctgggctatctcttaagtaaaagcaacaggaatcccatgggtaaagaaacttgtaataaagaggtatttagactcaaagaatctcacagaaatataagaaatagagttagggtcatatggaatgttctagtggtaccaaaagccacacaaaaatgacagagaaaaattatgtacagaacttgtatgcttgaaaaaaaagttacagtattattcttctcttgctaccaatgcaaaacaaaaatcaataaccaattctgttttcagatttttatccactgtgctgcataaaggcaatttggggactgtctgaacagaacttctaactcagcatcttctcagacaagtagatttgtcattctaaccaataaataactagtcatactgtggctaagagagcactttatatttaatgctttaataaagctctgaaaaagttgggaaaactttaaaaccttagccactttagagtaatcatattaaattttaatatagttttataaactgtataacagctcagctgatttaacaactgtaaaaagctaaattcacagaaaaataactcgtattaattattgaattcacttttcagaagcactgattcaccgaaagtgatggcagactcagaagcttctgaaggaacacagttgagttccctaaacatttcattagtgggcattaccagggaacacaattctatgccaaacgtataaggcaggttttaggacttcagattacctaaaatgaacataataatgagtagtcacttctataaagatactggatattggatataaaaattaaatatgtgttatttgacacacctattctctatgaataggctgtaccacacataaaacatcagaaaatctgaattcttgtgtgtaggtcattcatatgtttactcctgtcttttaaattcatctttatcaccatcagatcctcattacttattgtctggatgcaggtttctcttttacttacactgcctctccttccacgttttcatcgttatcagtggcccatgttagtaggttaatcttagtttgtgagcctgaagatctcttagcgctccaagatggaactggtacgtgtcatcttatttccatctaaatacagcataaggagtgaaaaaggtcaatggactgggagttactaaataaaggtgatgtggaaaacaaatcataacataggagtataagctaaaggaaagggccattatggtaatatctatcaaggacacttacaaacagtaaaagacaaaaggacatacaaagaaacgtacaacttaactaaaacagaaaagaaaaaagaaaagctctgaagtctacaaaattataacaacgatgggatatgaatcatgttttttcaattctaagtggaaggaagaaaaataaatcacatgtgcctggtaggggagaatttgcttaagaaagttttctcattttagatttgcttttggggtagatggtactttttcactatattcttcaatctcaagttttcacaggaatcacattaataagagacagggactggacaataacctggggagcagtaaatttgggggttattcttttgcattaattggtctagttaaccaagatgtgcaaactgccagagtagaagtaaatctacattctcaaaatttttttaaaaatgaagagtgacaaggaagaatatgcctcattctagcaaagtcatatctgaagagagagctgggaaaataggtgagatttgaaatttgtgtctatatgatgtaagacaattttagaatgatagttattatctcataggctaaatcaaagcacagctgtctctctgcatgcacattttgattctgcaacagaggtcctgcaagagccatcataatgccagcaaattaaataaggagagtttgaaaggcccagtcattgtgaacaagactgaggctatttcattcacttcacgtggtgaagtgcattacgaggagctgatatgactgtaaaatgtatggagacactattaagctgaaaggaatctagacatgtggatagttccctactcactaacacttcatgataatagagttaaatattctgaatagttcacttctaagggattaatacacttccccagtactcaaaatcatgtctgcctttcaacttatttgaaaggttcagtaataactcctcaaatactcactgcttgtcatattctaaatactgaattcttagatgcaaacacgcagctcctattagggctaacggaagctacatgtttgtaccaagggaaaaacatacgtctagaaaactgttctctgctgctcataggcaatcacgttgcatgtcctctcgtggacggtataaaaatgcgtgactatttacgcagaaccattcaggtgttacaggcacttccatagcatccaagaatgcattagccaaaaccaactaaagtagtttttgggctcatgatcattcaagctgaatcaataatattaaacagcatgtggaatgggggaaaaccaagtgtaaagcaacattaaaacctctttccactcaagcataattcattttgatctttactactggattcagctaaaggtcaaataatatatgatgatttagattcagaaaatatattatttcgctgttgagtatagtctgaaatgagggcaactaatttaaaaatggaatcaattttaaaaatataaatgtaataaaaatgtctccatcacagaatatacaaattaagtcccactattgattactgccaacattttaagcctccctactcatattggtaatgtctttagtgcaacttaattttcttcatattgtgtcatacacattcaatgaacatcattccagtgagggaccaagaacgaggtcagaaatggctgtgatgataaattacagaccttaataacttctgaacaatttgaaatgtaaaagccatctataagtcattcagcttgatagatgaatggttaatgaattatacaaactaataaaaaccattaattatttatctgtactacaaaatggcataaggccaagatcttaaacatggtctgcattaagaccaaaactgggattcagggtatatataacaagagggggaaaaaaagagttatctattagaagactgtataagcaaaaatcacttaagctttataagcatagaagattttattaaaggactggtcagattcataactgacagaccactgaaatattatcagcattggggtaaaaaaaaaaaaaggtaactggttgatttagatgtttccttgttcttttgctttttgttttcagtgaaaggcagtttgaaatttccgtcttagtggtttgtactgcagaacactgagatcaagacttgggtacttttgtatacttgcatttcttgctcttgcatgagtcccaagcagtgatggggggctacccctccccactaaggaataatcacattccagtttctggaaagaactcaaattagtctgactctagtgaatcaagagcaagtccaagatggaaacacaggagaggcaacctgggagggaacagactgaacaggtaaaactacagttagtagcctccccgttcatgaattacaactgacaaatgacatcttatctggtaactctgtcaaatcttcactaattcttcgacttcagtatttctcaagaatggctcttctactaccaatatcagaatcacctagagagcctgtttaaaatgcatattcctaagttactttccagacctcaggtaacaggacatattccagaggtctggaaataggtaacagacctcaccaagtgtggggctgagaaagcttttaatgatctgcccaggatattccaatgtgccctaaagtttgagagtcacagtcctaagaggatgctctccattacaccaccctgcagcaatggtgcctaccatcacacgcatagtgcacatgtcagcaacgtaagagatgccaagctcttaagtgtaacagggtgccttgaatattccctaaatatgtgagaacataggcatgactggatggataaatgcatgaaggagaaaactaacagtacttctgatataaaataggaattctgattcctttagaattggctctacagcactttgggaggccgaggtgggtggttcacctgaggtcaggagttcaagaccagcctcaccaacatggcgaaaccccgtctctactaaaaatgcaaaaattagctgggcgtggttgcgggcacctgtaatctcagctactcaggaggctgaggcaggagaatcacttgaacccgggaagcggaggttgcagtgagccgacattgtgccactgcactccagcctgggcaacaagggcgaaactaaaaaaaaaaaaacaaaaacaaaaaaaacagaattggctctacaaatccattcgcagctctccaaaaatccccaaggtgctccaaatttctcacagtctatatatttgaccgtacgatcttaacttctcaggtattgatcagagaaagtcgagaggaaggaggaaatgcagggcttcaattctgatttcgcagaaacatgagtgctgcactgctttcggccccgcatggtgtgctggcagacaccaccactgtcccaggcgcgtctgctgtgaaagccgttgcttagcaacagcaatcaatgctgtatttcctcttcaccattttcctgaagattgagacactgctccaaggtatcattttcaaataccttctgtttcactgaccaaacatgtttgttaatttttctattataggaaaaaaaaatcatgaaccaaattggtctaagaatccaggaaagaggagtgagggaaggtcagtataacaccagtgctttgggatttgtttgatgaagaaaaattctttgacagctcattgactttatttgctataccgtttcattctgccattttagcattgatttctgctacctcatgggatatgaaagtcgttagcatgaattatcattctaaatgcagatccacaaggtactgccataaaacacaaaaagcaaatgattttcagagactggttgaatacacatctcacatctctgttaaagctcttgtcttggtcatgttcttattaaccaataacaacaaaatgttaaaaaaaaataaacatctctccactgataccacaatatataattctttcagatgggcaatgtttctactaaattaattgtacctgtgatgaaagcatatagacaataccaatatttaccttaggaaaaaggcagagaaagtacacaagagggagacaaataaaagggggaagaggtagtaatttttatcaatatgtcctaccaatgaatagattcttcatataaaaccaaaaatgagacttgggaactttacatgacatcttccaataaagaaacttgatacttgcttgaagtatatacgtgcagatatgttagtaagtggtggaatccaacaaggtggatattgtgtgatatttatttttcatgtttattgaatatctactgtgtaaaaattctatgggtagcataaagatgagtaaaatgtaatccctgtacaagattgtggtaaaaaaaaaaaaagtcacataaataaatacagaagaatacatattacctcagataatcactcaagtatttagtaacaacaaatattccacttaaggtggattatatctacaacagacaaaatgagtaaatcggaatcaaaagcttttatttttttaaaacactcaatactggtaaggatgtagcgacataaaaatgcatcatgtgccagaaaagacacagggctggtaaactaaatcaactttttcaaagatagttagcaatatgcaacaaaacttttaaatatgcaaatttaaaatgctgacacagtaattgtatatctagtcaattatttcaaggaaataaagatgccaacaaaagatatttatttctgctacatttaaaataataaatactaaaatgttcaatattagaagaatgattaaatgcataatggtaataattatatgataaatgagtaccattagggtattcaagaatattttatgaaaggaaataattcctataatgttaacaggaaaaacataaaagcagccaatacataaatgcatagataaaatagtggaacaaatgaaaatgctaatgatttttggtgatttttattttcctctctttattttttctatgcgtttctaggttttttgtattgactgtctactgcatatttggtcaccgaaaaatgtcccaacaaataaaatctatcagtctcatttgacttcctattaaccgatctgttttatttcaacttagaacttcaaccctcactggtatcaagtactgccaagttgaatgatagtactcttaagtttcccaagcatttttagaccagcagtttttcatttccataaagatctaataaatttggttaatattttccacagagaatagctgtaatgaaagcataaaatttaagttaatctaaacaacaaatatgtaccaagcacaaggcatacaaatgtagacaggacgttcttgggttatgagaaatggatttcagtaacttgctctcccttcagtgtccttccagaagatatggggccttcaggtacagcatttctctggtgtcagaatatatagtctgtctacaaaaggagctctagtatcatccagggcaggtgatgacactgtctacaactgctaaccctctaccatcagataaactaaagagtgaaggatgcagagaaatgaataaaattaaaagaattctgtcaagggaaattagtattctttcaaccttcctcaatctcatatgatgtcgacacagatacacaggatatcacatgctctttttgtcagttacctgtgactatggatgctgacaaaagcacttttctaaacccaaacaccaagggccagactttccaatgcttacacagcagcatgtatgttaatacctgcattatcaaaggaggaaactgaagatttggaatggtgaagtacattggctagggtccagctcatccgcaagaagacaaaactccagtgagttttgagtcaggttatctcctaagtccgtgtttccaccattatagcacatatgatctttgagaaaatggataggagaaaggcacccattgcaaaggaataacatgagcaaaacagagcagcagaagtcaacagaacattctcaggccctgcacacccaagtttgctagaacaagggcaggggaacactcagctacctggtttgttcacccaacctgccctgtctactgcacttccacgccaggacagtggccctgttcaaaggtcaaaaccagtcccactctgatgctcccctccctggctccattctcacttcagcatgatgatcttctcatggtccctgagaatatcttagcatctgtaatggccatcggccattgagtaaatcccagttttaaacttgcctataaagaacgaacttagtgtgcttttctgctgctttctctcattgaacacagttctttctcttccttcaagaagaacctttctgaagcaccttgaatttcctagtttataatctctgtgaactcctgctatcaagagctctgcagagctagcttccataacctgtcctctttggtgactctctcgtaacaccaaaagctcccttctaacaccaacaggcaaaagatggtcatggtttaatattttaggtactgttccagaattagccagactgtggttcttaatgtttgcatctgtttgtttacagaaatggtggtattgatctaatggaacactggaacttggtctttacaatggcaagttgtggatgataaggttgaaaaagacaagagaggagtctagaaatccagtcagagattagatttcacatcccaggtcacaaaatggtagggagataatacatttgtgaaagctttatttggtaaaagaatgcaagataaccaaagaggagacaaatgtcatagcaatccagctatgagttgtgtactctgtgctggaatggtaaaccaagcatggcaagatatctcaaaggaaaaatgaacagaactgtcaattaactgtatatgaggtaaaacaaaggaaaaaagacaaagagatgagttttgaaaccaatatgttgaagctcatagtatcagctcatttatttaagtgaaatatatgaaggaattgtttaaaataaaaaccaaggaatttttaaaatagcatgccaaagtaagtaaatacataataagtatgcctccaagaagtaaggctaagagagaaaccaatttagatcagtggcctctttcaggaagagagaaggttctgccctatccagcattttctataaggacaagagaaaatattttttcagtcttccaaagacagctaccggaatatttaggaacagtcctaaaaatcaagaaacagaatcttctgaatatggaggaatgatcattaaaacaaagaggaatggagaatagcaaagccattttgcagctaaacttgctgagccccaaaattatccactcatgtttatgttagcagtactataaaacttatatatatgctctattatcaaatacatttttccactttctagtaggtaaaattcatggaaacacttaattttctttatttatgcagatttttacctctctaaaaaatgctgctgctgagctttctatttttgttcattccagttgaaatgcgatgattcatcggtcatcaccacaatggccacacgcatgtggaagagaagctcatgattctaatctgcacagttgctggcggctagatatgcctaaagaggatgtgaaacagcagcttcacttccaatggagatccggacagtaataaaacagtttcgcaatctcttcactaaatacatctttgtttgcatggtctatgtatattgtcatggggcaggtgcaggaaaatataaaatatacatatttaaaatcctactgagctgctgtgaagtcagtgacaaagaaaaacacacacacgctggggcttcatgcatgtagttaaataaataactttgagatcatcaaaaagagtcagcacacccatatttcttacttggcgctcattactgttcaaagacaccatttttttttaatgctgagccatcttaaaactttgtcaggcaacattaaattcttcaagtcttaagccctaaagaaagttaccagtaatgggcagtaacattaagttagctttgcatttaagaaaaaatatttatccatctgccttctcccacagagtactttggatcactctcagtggccatcgttctctgtcctgtcttcatgcagctgggctgagcagcagcatgccacagaaaggggccagcggaactcaactgtccaaagaaatgtccaaactgcttctgttacgtaaagccaatgtcactttccttttttaaaggaagccctggggtgtaatcctgcctgagatgagtccactgacacgacaaaaatctaaaatgtgtaactatttggaggaaagtcagtgtgtatcttccacttgaaaggtataattccttaaaagggacataaaaatattttttctattgtatactctaacagtcaataactcacaaggaaaccgaatagagagcgaaagatggagcactctggactaatgtgaaaaacaaactcaaggccgggcacggtggctcacacttgtaatcccagcactttgggaggccaacaggggcaggtcatgaggtcagcagttcaagaccagcctggccaacatggtgaaaccccgtctctactaaaaatacaaaattagccaagcgtgatggtgcacacctgcaatcccagctactcaggaggctgaggcaggagaatcgcttgaacccgggaggcagaggttgcagtgagccgagatagcgccatggcactcctgcctgggcagtagagtaagactccatttcaaaaaaaaaaaaaaactcataagcagacttcaggaaaatgccaaacaataaaatacatctccatattggacaatatggtgaccccaacaacccagatagacgcactgacaaatatcttctaaatgcatcagtacattgtttgtaccctcatttggggaaaaatatgcaaaaaagatacctaggaacaagtgggaaaatctgatatggattaggtattacagaaaatattagagaattgttactaattgtctaagacgtgctatggcattgttataaaagagaacgtctttgtttttagaatgctaacaattgatgaatctaggtgctaaatttctggttgtattccttcaccttttctgcattattgaaaatataataaaaaatgaagaaaaataaaggcataaaagaagttgtatttaaaaagagaacattaaaataaaattcatgatttaagtgataagaaagaaatatccttagagtattacagtcaagtaaagataccaggccagtaagtaaactctgaagctagctttctcactagaaacatttagctaacctgaggatcctgaactttccccttgacggagacgtgggcacaaagcactggaggctgtgtgtgggcctcatccagactggaaagtctaaaaccaaactcctgaacagacctaggattttccaaggactatatgctgtgagttagaatcactgtaaattacaaaaaatctattccacacaagggagagcaaagaagttctcaatctagaccctaaatactggacagagggggataatttttttctagactcataagcagaagttggcatctaaccaagcttgtagcctaaatttatattatctttgtgggagaagaaacctcaagcccagaaattaacctgagcaggatccaaggttgttaatgccttagttatccatcaaaacaaaaggcaaattcactcagggtgaatacaccttcaatccaggcctcaaagaatttctaaagagtgtgaacttacagcttaaaaaacaaaatcacaagccagggtaacgtagggagaccctgtctctacgaaaaattaactgggcgtggtgatgtgtgcctatggtcccagctacttggaaggctgggatgggaggatcgctcgagcccgggaggcagaggttgcactgagccgagattgtacaactgcactccagcctgggtaatagaccaagaccctgtctcaaaatataaataaactaaaaattctcacaaagaaaacaaagaaacaaagatcagtgaacaagactcagcagaagtattatattgctgaatcaactcacaaagagtttctaatttggtattatcagaatttaaagtaaatatgtttaagatgtttaaaggaataagagattgaaaatatgaggaaggataaagaaaattttttaatgtctagctaggaaaaaaaataccatctagaaatgataaatataattgtaattaaagtgctaatgtaaaaattggcaacagtttttaaatcccacaatgtcaaatgctggtgaagatggttcagtacgaatgaagtcaactttcagaaacaatttgacattatctagtgaagttgcaataagcatactcatggcccaacaattccattacaagttatatatccaagaaaaactcctgtacatgttcaatggaagataaatacatgaatgttcatggcaatgatatgtgtaacagttaaaaacagaaaataaataaactatggtacattcatagaaaacaatacagcgataaaactgaatgagttgcagttacatgaccatcacgaataaatctcagaatactaggtcaaaaaaagaaagtagacaagaatacgtacactctgacatgagtaaagttaaaaacataccaaattataacacataaaaaactgatttcaatacatacaagaaaacctgttaaaaaaaaagccagtgaaaggaacataagattcaagatagtgattatttcgtggggtggagagggagataagagagagaagcagttgtgcagctttaaaagtagtggcaacaggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccagggggtggcgggcggctgtagtcccagctactctggaggctgaggcaggagaatggcctgaacccaggagacggagcttgcagtaaaccgagatggcgccactgcactccagcctgggtgacagagcgagactccgtctcaaaaaaaaaaaaaagtagtggcaacactgtatttcttaagactggctgactgctatgcaagttgtttgtttactgttatttgtaccttatatttaaggtattttgtgtgtgttcaataaaaattatttaacaaaacaaaaaagcaataatactcacgggtatcttagccaaaagcctgaagctatactagttctgcacacaacaaacatgctttagaaaaagaggaaaccagtaacattcaggaatatcatagcaagacaatcacatgcttctggaaaatacaggatactgtggtaaggaaatgaccaacgttgtcaattctgtcccctttccagggatgtagatctccatttcacagagcaccaatagctttatctgtatgcctgggagttgtcaagcctctcttttatataggttgggcttaatttaactaaaactcctgattttcccctccaactattgatagggacagggggcagagaaattctaggcagaaaatggtggtccccaacaaaaccccaccttcaagcctcaaaccatggcccaaagtagaacttacatccctgtttccctgcttgaatgctgccttttccaaaaccacctgtggccctatcccaccccaccctgtgcctataaaaaccccagatccagccagcagagagaagagaagcagctggacatcaaagactgcagctggatgtcggagagaagcagcttgacttcagagggacagcctgacggggtaactctggagaagaatctggccagagatgaccgcatttcacaggaagattaccttcctgccccatccccttttcagctcaccttgccactgagagccacttccattggcaataaaactccctgcatttatcatccttcaattcattcgtgtgacttcatttctcccagatgccagacaagattctggagccatgagtgtgaagacaaaaaggttgtcacactgaccctttgccctcgttagcagaaggcagctgcctcatgcgaaaaggcagagggcccattgagctgttaacgcataagccgtctgcagagagcagagctaaaaggtcactgtaacactccctctggggctttcgtggtcacaggcactcccagcccccagatgcagctgcaggcaagcacagagttggctcctgccagcaaccaaaaaacactcacccaggctcctgcactcacacacctgcatgcctcctttcatgaggggtggaacgcagcagatccgactgagtggggttcactgctggtgccgtagtggctggctgactccagcgaccatgtactccacctcccaccttgttgactcatgcactccctcctgtgaggagctgagagctgcaggtgagtaaacagaacacccctgttgcaagtcccacgagggtgtcagggaaatatactgcttcattattgctgttcatttgatttcaaatataatgatatctaaacgcaattttttggcatttacgttcctctaagcccagccttaaatttagatgatgaaaatcttaaattgtcccaaatggacactacctccttccacatctgttgactaggatattgatggtagtggccattccagacgacccactgctaccatcacaccagctgcagtgaggaggaatggccgggcctgcacactccacagagcagggagaagaccccacccgccccacccgccatgctctccccaacccaccatgcagctgcagacccaggcacctgcagcctcccaaaccatggctgcagacctgggactcctgctccacgaagcaggtgggagccccacctgcctgggcacagctgcagctgaccaaaccacagctgtggatccagacatccctgcactttggggggcccaggaaggcccctgactgcactcacagtctcagaaatgcctgcttcagctgcctggcttctctctgctatcgatgcccactccgacctgggagcaaagtcagggctgagtccgggcaccatgaacagcagcaggaggcaggcaggttcctgggcggatggggcctggtcaccagtgaggccccattgtcaagccaggaagggcctgaaggctgggggctgggctgccagttccggggcatggagtggaaacttgtggtgccttttccggcccacccatggccacctatggaccaatcagtgcaaacttcctcccctctgaggcctgtaaatgccccaggctcagtcagagctgagcagactgggacaaccagctgcagagaggagctacccactccagggtctcctctctagactgagagctgcagagatggtactaccagctgcagaggggagcaacccactctggggcctcctctctgctgagagaacagacagatgatgggacgaccagctgcagagaggagctaccctctctgcctagagctgcagatgatgggacgacctgcctgcagagaacagtctcttactctagggcctcctctctgccaagagctggagacaacggaacaactagccaaacagagaagctaccctctctgctgagaactgaacactcgttgggatgacctaccagcagaggggagcaagtctctctgctaaggagctgaacgctcattgggacatcctggctacggagaggacctgcccactgtgggttttctctgagttgttctattgctcagtaaagctcctcttcatcctgctcaccctccacattgcatacctcattcttcctggtcacaggacaagaactcaggacccaccgaatggtgaggctaaaagagctactgtaacacaaacagggctaaaacatgccccttgctcgccacgttgtgggcaaagagaaggagaaaggagctgcaacccttcgggtagcccagacctgggagctccctgagccagggctgtgagcccttctttggggccctgtggttcctggcatctccaagtttccgggatgtcaccacattccccggtgccagacgggaaagccgcttgcagtgaacccggtccagccacagcctcacagagagctggtgctcacgccagcacctggagctgcccacaccatagcagcagctggtgtgtctgaccgcacagtgggcggaccccacgtttgctgacacacacccctcaccactccatgcctgactccagactccctttgaagcacgggatccaggctggtagcatgagctgagcgcagcctgccagggcgagtgggtggaacaagcccagcaggtccaagcaaaactcaggcaagggcaccaccagtcacatgtttccggccagaaaagtgacaccccaaagaccccatgacagtatgacttatatcctgttatattgtctcatcacaattcacatagggttgaatctgctattttgactgtttgtgatgttttggctagcatctgaacagatgggcagtttttcttcagtatgactatttgccaacaattggaagggtgtaaaactcattctcagagcaacccaaacataactacaaggagtctaacagataaaatatccactgttgtattcagaaatcctgtataaagtgccagtgaattaaaagaacactttggtaatgtggttaaatgaatgctactaataatcataatagaactggaaatttgtataggtattgtgttcacattcatctgattatcatagctctaagaaatagatattacaggtattattacggactttattatcgacaaggaacaaagcacagagagatccatattacagaaaatggactgaactcagaaataagaacaggatttgagccgatctgtgcctcattagctgtgtaaacttaaacaagtaacttaatttctcacagcctccattgcctcatttgaacacgcaagcacagtgagacctaactcacaaggtcctcctgagaattatataaaatatataaaagttatcagcaagagctcctgtcatagagtagattcttcatgaatatatccttccttaatttatgaaatcctccttgataagaagaagtcaaaacttttatcattactcttttcacaaaggagtcaaaggtgatttcaatttagggaaaaagaaaagtttagacctaaaacattaatataaactgaaggatgcaaagaactcaatgttctacaatcatacttcagtggcctctcattgtctcctgaagaaatatacagaatataatgagtgggtcaccatgcggtttagaaggggcagagttgtcctacagtaataatcacggtacatttgatgctaaatcgtatgtgctctaatattgtaatttcacatctaatacatgaaaatctttccaatgaagttagtttattccctatagcatgaagatagatgaagttaaatagtttatttcctatagcataaagatagcccttgacattcattgtcacacatttcctgtttctgagatcagtaatttgtagattccttcctgaaggttccagcaaagagcttttacccatctgcccaactcctttgattcaagacagggaggggaacagaggtctcctcaggaaagagagtctcctgtacccagggtgaggagaaaagtggtcataaggaagccgtggggccacagatgtatgaccactcacaactgattcagtgagccaagaagacagcagtgttgccagagatggaaggtgttctcagaatgctaacaggacttgctgatgaaggggatggtggtaggggatgacagaaagaattaatcaagagcgatgccttgattttggtcctgagcacctgactgggagtaactactgaactggaaaagatagaggcagcctgagtctcctgtaaaattcagacaccttccaatctccataattctagtttcttgttcctggacctcttgctttagggaggcatatagcactttacaaagtatttgctcattttgtcatcttatgtatatactgaaaatggagtcagtgtcaccagaaaggacacctaatactccttgcttttcttatggacctacgactatactataggtgctgaaggtacctatacctatactattggtattgaagggacacaaagatttgacctaaccttagagtcactttgtaggactactaccccttctctgttttcctccttcttcattaactcttcccttacctgacaagcacagctgactggaattgtgtacactaaatggtcctttacaatacggaatacttcagtaattacaatatgctggaattgctaaattctataatttcatttggatgaacttaatcacatcatagcattcaatttggcttattttcaaaatcagcttcgtttataaactaaaaagaactgaaggattcttttcattttcaagacttctcatctgtaagaggatttagattcttctatttacaagcattcttctgagaatctttcattctacacacaggtttctttgggggttctgttttatcttttttcatacactgcctaccagagagaacaagactggcaaaaggactctgtcctcataaagctcagagacgatgaacagataaacaagtaagtgaacaaaaatacttcagataatgctaaatcctccaaggagaatatgatacagtagatgtaatgggaagctcctttagactgagtggtcagagaggacctttctggggtggggtgtggcatttgaactgtgccctgaagaccgaagcagtacaagcacaggaattagcaactgcaagggctctgtttgataatgaacttggtaggttaaagggacagaaagaaagccagtgtggctgaggtgtggtcaaggggatgtatccaaagtatagcaatacatcagagaggaaacccaggggcagatatattagtactgaaatagcataagggattcacactgtattctaggtgtaatggaagtcgatggaaggttttaagggaaggtgcagggattacctaattcatattttaaaaggtcattgtgggcgccactgagaaagaatatagaggagcaggaaaggaaggaggaggaggaaggacagaaggaagactactatgattgctcaggcaagatatgatgttacgttagactatactggtggcaaagaaagcaggggaaacagactttagacatattttaaagaaaatgttaataggacttgctaatgaattcagtggtgatgggggtaagtgacagaaaaaaaattaagagtaatgactagatttttgtactgagcacttgactgggggtaattattgaggtgggaaaaacagaagcagaaaaaggaaggtggcagagggagccgaggaatcaagagttctgctctggctatgttgagtttgagatgcttttcaaatatccaagtgaggatgaaaccagtagatggctggacatacgaacgggagctcagtatagcaatcaaggctggagatacaattttttttttagtatattggcatcaaagagggtatttaaagtcatagaaataaattagaatcctttaaggagagggtttatttaacgagaaagaaaggagaagaaagctcaggactcagcctttcataattccagtatttaaaggttaaacagagcatcaacagccgtcaaaagatgttgaaaagaaatggctaaacagagggaaaaacaagaagagtgttgagtactaggagccaagataggggtcagttatgtggaagactgctgaaaagtcaaaaaaaaaaaaaaaaaaaaaaaaaaaaaaaaaaaacagaaaagacaccagatttggcaagactaaaggtctttggtaaccttattagaacaactgtaatgaagtgtcagaaaagaaagtcccattagaatgggctgaaaagagaatggaaggtgaggaacaggggagaaggaagagacaataactacatagcagtcttttcagaagttgtgcacaagtgtgtgagagagctagagcacaggagagcgagcccgcaccagcacacacttaacacaggtgacaacagaagttacggaaagacagtgtctctggagcatctgtaatcatctccttctttgttttcctcttcgagtcattctgctgaagttcctgaataaaccatacggatctacaacatacatacatctcagacctagtatctcttttgttcaatctctccatatttttctgccaaatctaatcagaggttttgcggagggattcgtaacaactatattcttcatttttaaaaatgtgtgcaaaatagtagcattcggtaaatattacaagattgcaaggctagatgtatctcaaagaacacaatacaaaagatgtaagatgctcttctaactggaaatggtggaaacttcattatgaatccaatttccaaattatttccaataatgaaggccaatgtatgatctagtcacctttgacaagatcggtttccataatatgtttacttgctttttttcacactgtctcccaatctgttctttgaagtttcttcttgcctaaaataaacttccacacacctgctctataaacccgaactcaaagtgtagcatttttacctccataaatgttttggacactatgctgacagaagaagaagaggaactaaatgacctgtgaaagcccctgttagttgcttcatactgataccgaatttctaaatgtattataaatgcatttcacagcattccattaacatgtcagaggactttcttttccactaagcacactttgcatgagttaaatatcattcttttaaatttacataaagacaagttaaagatgaggccatgtactacagatttatttaatctacatgagacctaagatatattttcatcaatggctgtgctagaataattataaattacagaaaataaaacattcagttagtggtatagtttgcctagaattgattttttgatgctgattatataacccattaactgactaaaacttcttcactcgagtcactgcagcgtctgccaccatttgtgttagtgtttacacataaagatcacacacatttgatgcgtccactttccttcaaatatgggttagagtggaactgggaaacagaaccatttctagtctttttacagctttgttattttgatttttaaatttacatttggaataaagagaaactctgctataagaatctcatactaacctctgaataaagtggagatatgcaagtactccaagaaggcaacagaattaaatatattttctatgaaagatattaaaaccaaaagtgtttaataatcttcattaatgaactttaaagctcaagaagaccttataaatcatctagttcatcttccttggtttcaaaatctactcttgaatttatttagcattatgagattattagatgaggttatttattctccctaattttaatattgataattaatctttaataaatgcttgtgatttttgacatattaaattctaaacctcaacatttcaaacagtcttagatcatgaagaatattaaccaagtccaacgtcccatatactttgtagtaaaatggtagaccctgaggtgaagtggggcaataatttcatgagaacacatcacagtacatggttagatgtactttccactttttcttctactagaaaactaagtttctgttttgggaagtgctggctttgtgttctgcccgtttatgctttaatttcagctcatgcactggggcgccctcaggaggattaaagaagacaactttggccgggtgcggcggctcacgcctgtaatcccagcactttgggaggccaaggcaggtgaatcaagaggtcaagagatcgagaccatcctggctaacatggtgaaaccctgtctctattaaaaatacaaaaaattaaccgggtgtggtggcgggcgcctgaagtcccaactactcaggaggctgaggcaggagaatcacttgaacgtgggaggcggaggttgcagtgagctgagattgcacaactgcactccagcctgggtgacagagtgagactccatctcaaaaaaaaagaagagaagaaagaagaagaaggaagaaggaagaagaagacaactttgagtggtggatgaaactccgtcctaaagattccaggctggagaactgggtccttttagccatcttattaacagtttgaacttgaagagatcacttaacctctccagccactctacctttatgcataaaatgaaaataatattagtttacacataagtattcaaataatttcctaaggtctcaccgatctctaaaaatctgtgataaatattttcataaaatagatttggcatcatatgctatgttatttatatttacctaacaccacatttccttatttttattccttttttttttttttttttttttggagacaaagtctcactccatcacccaaactccaaactacagagtgcagtggcagatctccactgactgcaacctccgcctcccgggttcaggcaattctcctgcctcagtctcccgagtagttgggattacaggcgcatgctaccatgaccggctaatttttgtatttttagtagagatgggttttcaccatgttggccaggctggtctgaaactcctgaccttgagtgatccacctgcctcagcctcccaaagtactgggattgcagacgtgagccactgcgcccggcctcacatttccttatttcaatgtttacttcagaaggccctaaagcagggcaattcaactggcttccatgtttacttatcattaaaagttatcttacaggactcttgggattgtgtcctttttaagacaacacaaagttcatagagtaatggactgtgtggtactcctacccgaggctccaacattttgaggcataagaaaatcaagtatctggttctgatttccactctactttgttgccatttttagcaacagttgatggcacttgacctgatctctttcctggtccattgcctataggtcaagctgacagcagcataaaaccctaaacagccataactttttagtatctattaatagatacattttatggtggctgaagtgacaatctaggttcctttggttaagaagttcaaaatctttattctactgctattcctttctgtataagtttctcagagaaaacaaggtgtttccagcagcaccatcactttatgaaaaaaattaaacctccatcatctaaatataatgttttttctaaaagaagccttcttttttttagtatgtatattatttttagatacttccattgctttaagaagttcccatgatctttgagacaaaaatcaaaacatctttgggatgacaaaactaaaaatgaataaatagataaagtggaatttttgagccaactttttttacattttcatacaaatttcgaagctacaattaacttcatttagaccatgaatagcaacctaatggggctgtaacaatttccacaaataaagctacactatttgtttcacattcactaaggatgactattactctaaatgttcaattagttcttcatttattttaaaattaaattcattataaaaataatgttagaatattatccaataaattttctttgctcaccttcaaaaattctacattaccgttctcttgagaaattctacatttggtttttgttcctcatcttatcatcctgcaataattctttgaaatccatttatcttactaattttaaaaaaaagggattagtgtctatttaaatcaaataattagtaataacctattgaataagtttgtgatagaaggtgttacattgtttcagtctacctgccattgaacaaaataatgccaataatttacttaatcctattgaaatttaaattttgcaactctctttatagaaggataaagtttacaattgccctttatccatcttatagagatgatgcaaagttaaattatgcactaccatagtctgttttcgcagttataatgaaatacctcagactgggtaatttaggataaacagttcacagttctggaggctgggaaggtgctaatatccagcaaaggacctctgactgcgtcatctcgtgacagaaggcaaggggcgagatacagcaagagggggccgaattcaccttttatattgacaccaatcccacccatgagggtggaactctcatagcctcatcacttcttaaagtttccacctgttaatactgatatagtggcaattaaatttcaacacgcattttggagggacaaacattcaaatcatagcacgtgcctttcaagcgttttgaggtattcagaaaatggcaagatactagaagtattttaatgtgttcctaaaacattaaacctaaaacagacttatatctaccttcagctctaaaaatctgggccttcaagatttttccaagtgttaagcaggtggaccccaaaagtgaggcacaaacttcacattatccaaacacatgacaacgtttaatatcacagtatttaaatgctactctaatgaatgtgtgaagattttctaatctggtaattcaccgaacttttaggaaccatgacttttcctaaagccatgacctggttttcttctgaactacatgctattctgtatataatgctccacatgtttacaattgctccaagtgatcaattcattaattctcaaacaaatgacatcaatctttttttcacatgtaaagaaacaaaggcagaaagagaaagaataggccatttccctttaatctgcaatcgctcaccagaaagatttagtttgcataaacacattcaagaaaataagcgaaaataaattttaaaagaagtacataggaaatgacaacgtaaggaaaatgggaaagggaagagagaaccaggagttaggctagaatgctgtcctatcttgtgcattgccaactctggagagatccaataatcagtccaaggtaccacacaggctagacctgaactcctgggctcaagctatcctcctgcctaagcctccaagtaactaggactacagtcgcacacagtcagaactagcttgttggacttatttttgtcaaagaatagtatcataatctttgtgcctctcttgattgagaagaaattctcccagagcagaactgtcctatagaactttctgcaatgatacaatcttttctatcagcaccatttaatatggtagccactggccacacgtggctgttgagcagttgaaatgtgtttagtgcaagagaaagacttaatttttaatttgattttaattacttaagtagtcaaatgtggctactggttaccatatttcatagtgcagttctgatacatatgtacagcaaatcacagcaaatcaatttctctcacagtagtatctctctcagttactcagtttcctaactttgacagaactatttatcatatgatgtatattttcacctgaatacttccatatgagtctctattttattccagagaatttttccgattacagacttagtgtacttttggccagtgagttgtgtgggttattgctaagcatggcattggacgtgctcggatgcttgtcttcattcattcctgaaagcagtcttattctctaaaactatccatcattcttactcttctctctcatcccagctgacatgccactttcaaataggtatattttctctggtttcctgcttttctgatatagctgtggatacatggagagtgtaataaacgggttgtccagaaaggagcttctgtagtcactgggcagtagatatcagcatcagcaatagatctatttaataaaataagtaaatatatatccccactatatggaagagtataatacataaaagcatgtaatataacaaattttatgcaccaataattttttacagtattcagaaaagtttctacatagtaactataaactacatattaaaaattgttttctggtcattgctataatgtacacacacattccaattgacacacagaaaaaagaagttactttctttaaactgcaagggaaatatcaaaataacatcacgaaacatttcataatatcctagagatagtatctcttacatttcaaaactgctttaactcatatggggctccagttcatcagaaacaggacttgatacaaaaaggcatggcatgaatgataattactgctttgggtacaaatctgcacacattacatgcaagatccaatataagtcaacttctcacagcaatcaatttttcaaaaggaagggtacaaccaatgtttattttatgttaaggagaggaaatcaaacaaaaggggaaaaagtgagatgaaaattcttatgctccagttgagtttttccttgggagcactgaacagattttaggaaatttagcctaattttgctatggcaacagttataacacttgagaccacagtccaggagaagcgcagcatttattctcttattgcagcactttgatcctttccgagtctaacttaaaagccatagtttttaatgcaaatgagaatacatacattgagattcgggaataattagaatatttatatttgtaataaatccaatggaagctcttttgtgacatgaagcttactcagtggttagggggttaatgaatgaaatggatcactggactgaaaataaaaatcactatttaaaacgaaggcgacaccaggagaattaggcactacataatactgtaaccacggagaattctcaacagtaaaataaagccctgtagtcccagcattttcattacttttccagtagtgctggatgcagtgtgaatttcaatgaggtgggaaacagtggctgctccctttaaagaacatataccacacagaggaaagaacatataccatataccacagagaggagaagcactccttcaattcacacagtgatgaacatattccacagagaggagaagcactccttcaatccacactgtgatgaacatataccacacagaggagaagcgctcctcaattcacactgtgatgaacatataccacacagaggagaagcactccttcaattcacacagtgatgaacatattccacacagaggagaagcactccttcaatccacactgtgatgaacatataccacacagaggagaagcactccttcaattcacacagtgatgaacatattccacacagaggagaagcactccttcaatccacactgtgatgaatatataccacacagagaagaagcgctccttcaattcacactgtgatgaacatataccacacaggggagaagcgctcctcaattcacactgtgatgaacatataccacacagaggagaagcactcctcaattcacactgtgatgaacatataccacacagaggagaagcactcctcaattcacactgtgatgaacatataccacgcagaggagaagcgctccttcaattcacactgtgatgaacatataccacacaggggagaagcactccttcaattcacactgtgatgaacatataccacacagaggagaagcactccttcaatccacactgtgatgaacatattccacacagaggagaaacgctccttcaattcacactgtgatgaacatataccacacagaggagaagcactccttcaattcacactgtgatgaacatataccacacagaggagaagcactccttcaatccacactgtgatgaatatataccacacagaggagaagcgctcctcaattcacactgtgatgaacatataccacacagaggagaagcgctccccaattcacactgtgatgaacatataccacacagaggagaagcactccccaattcacactgtgatgaacatataccacacagaggagaagcactccttcaatccacactgtgatgaacatataccacacagaggagaagcactcctcaattcacactgtgatgaacatataccacacagaggagaagcactccttcaatccacacagtgatgaacatataccacacagaggagaagcactcctcaattcacactgtgatgaacatataccacacagaggagaagcactcctcaattcacactgtgatgaacatataccacacagaggagaagcactccttcaattcacactgtgatgaacatataccacacagaggagaagcactcctcaattcacactgtgatgaacatataccacgcagaggagaaacgctccttcaattcacactgtgatgaacatataccacacagaggagaagcactccttcaatccacacagtgatgaacatataccacacagaggagaagcactcctcaattcacactgtgatgaacatataccacgcagaggagaaacgctccttcaattcacactgtgatgaacatataccacacagaggagaagcactccttcaattcacactgtgatgaacatataccacacagaggagaagcactccttcaatccacactgtgatgaacatataccacacagaggagaagcactccttcaattcacactgtgatgaacatataccacacagaggagaagcactccttcaatccacactgtgatgaatatataccacacagaggagaagcactcctcaattcacactgtgatgaacatataccacacagaggagaagcgctccttcaattcacactgtgatgaacatataccacacagaggagaagcactcctcaattcacactgtgatgaacatacaccagaggagaagtgctccttccactcacactgtgatgaacatgtaccacatggaggagaagcactccttcagttcatactgtgatgaacatataccacacagaggagaagcacttcttccattcacactgtgatgaacatataccatgcagagaagtactccttccgttaacaccatgatgactatatactgtacagagaagcactccttcagttcacactgtgatgaatatacaccgtatagaggagaagcactccttcaattcacactgtgatgaatatataccgtataggggagaagcactccttcaattcacactgtgatggctattggcctatccatgccactatgtagtttacattttagtatcttaaaatatttcatataatagaatattgcatttaacttgcaagaaaggctaaacacctagcataacaaaccatggtgcactgtaaatgttaatttaaaaataatatatacaaatcagttacagcttagacaagaaacctctttgactacacaatttggaactagaattatatattatatttaaatgtatctctttaaaccaattcaaaagcaacatagagagactaaaacctgtactgaagaaggaaaatcaggtcattacccatgagattgcttcagttcaaaaagagaaagcaggagtaggtgtgaaaatgcacagattactgaaaagtggaatgtggcgttaaatcaaatcttacaacatggaatcacgttttactttgcattaggttcctatgctcctagtatcaaaactaggaggtcctttgagctactaacttagtaaaaactaaaagtcaaacatttcactaatagacctgcctctaagtataaggttgaggcagaagatatacaatcatagaagaaaagacaggagttaataccgctttccccactgtaactggaaagtgtcataaatcctacattagtttctcacctaacctccctatatttagtcattccagtgccccaaaattgaagaattagtctcaatttctactggaatataaataacacatcagcttctagccagataattacgtccttcctgaatatgttgcaaaagtgttattcattgtggagaatgcagaattataaaatacaacccgactctcaaattacttataatctggttaggaatacctaactataaaaataaacacagttgtgggtctcagctgggcaacagtcaggctctgcaggatgtctagatagacaggtaggtagacagacaaaaagacatgtatggtgagccacctccagctcacaggcagtatcagactcacagtagtaccaactcaaaacagaccttcccctccgcagcattccgcatgccccacattatgctagaacctctatttgaatttttcttctagagcaaattcctagcctctcctctaggaaggggagggctggggaaagagcccttggggtcttttcaaggggttcactgaccctacaagctctaagctctctctacagctgtgctgtccaatatggaaatcatgagccactgagtggctactgggcacttgaaatatggctagtgcaactgagaaactgaattttttatttaatttaatgaacttaaacagccacatatggctaatgactacaatactagaaacaagatataaaacatttccatcatcacagaaagcactactctacagagtaaagacttattataattggatatatacattcctgaaaaatgtggtatataaaatattataacttgagggctcataaggcagaacactcaaactctatacagtattataaccaaatccctaaaaagtaagaatcccaacttttaaaactagcgtgatttttaaaagacatttaattcttaataaagaaatattatgataaataagtatacatttaattatttatttatggataaatgaatgaatgaaatgaatgacagggtctcacaatgttgccgaggctggcatgccgtggcgcaataatagctcactgcagcctcaacctcctgggctcaggcaatcctcccgcctcagcctcccagtagctgggattatagacacatcccaccacacctggctaactttttttatttaattaattaatttatttattttttgagatggagtctcactctgtcgcccaggctggagtgcagtggtgcgatctcggctcactgcaagctctgcctcctgggttcacgccattctcctgcctcagcctcctgagcagctgggactacagaggcctgccaccacgcctggttaattttttgtatttttagtagagacagggtttcactgtgttagccaggatggtctcgatctcctgacctcgtgatccacccacctcggcctcccaaagtttttttatttttctgcagaggcggcatctccctatgttgcccaggcttgtctcaaactctggggctaaagtgatctacccacctcagcctcccaaagtgctgggactacaggtgtgagccaccatgcccagccaaccatacatttaaaggttaaagtagcttgaaagaaggctgtaagaaaggtatctaaattctgaaaatgcacaaagactgggaatactatggccaaaccaagcgagagacaagaggtctcgggctcactgtttctccattcctccaccttgctgggctgtgctggcgtttactgcactttgggtttagctgctaccacttgatgaagaaaaccattaatacatcaagaaaaaccacttaataaaccaaagagacgaccacattaactcaatagcatccccccacttgtcaattctatgtgaattaattcttgtcatagaaacatgagtaggcgcagaaaggacttcatttggcagacaggttctctgtgtgtgttccctcatactccccgatataactggtcgcagctccattcccatctcagtctatcaaaaaaactatgcctgctgctcaaggcttttctcaactgataccttccctttattaagcctttcctgaccatcgcctccaaccaagatatgaggaacacagacttttttctcctaaagatatttttactcacacttcacattaaatttaacacatacttatggttgttgttctattactgttattactagaggtagcttaggagggctgctggaaattcaagggggaaagctaaaacttcccagggctttgtaacatctcttcagactggattttagtcctaattctgccaccagcttcctggttaatctcagtaagtcactccctccccgtttctgggctttaaacaaactcatttttcaaaatatctttattattgtaacttttgaatgacattttaaaagtccctgtaaacctctagtatgcacagaactttaaaaagctgaagtgagaatagccttctagactttttgccacatgaatatatacaaacataaaagcattttacactgaattagaccatgccatccgtatcgtactgtgacttagtttactgtattcacttaaaacttgatttcagtacacaaagaaatctcctgcagttgttttacctgctgcattattagaaaaaaatataatttaacaatcccccattgattaaattaccctttaaatgtttaagcttttcttaaaactaggaaagtaatacatgcatttttttaagtattgaaaattttcctttccctaatacactctatcttgggtgataaaattttctaaagagtatcttctgttttttcatttttctcatagataccactggggtttctttctctttttttaagacaaggtctggctctgttgaccaggatgaagtgcagtggcacgatctcggctcactgcagcctcaacctcccgggctcaagcaatcctcacacctcagcctcctgagtagttgttttttgttgatgttcttgagatgggtatcattgtgttacccaggctgcactcgaactcctgagctcaagcaatctgcccgcctgagcttccgaaagtgctgtgattacaggagtgtgccaccacacctggccaggtttcaacgatgcattcctatatttacttcttgacttttgttacagcattattttacactgtcagtgattatttttaattcattaaattctattccataaatagatcccagtcctctgtgctttctcagttgatttttggagacagatagtcaacaggcagcattcacaatattataattatatatctattactcactgtagaactaagtattgtggaacagctccacaggggaggaaatgcaatcttatgccattcaacttctcctgtttgaaacaaaatatcccaagagtcaagcagatttcattttcgtttttttgcttttctttactttacctgcaattctttcttacatctcagattatcttctttcttggattcttctaccatttcattgcagaaactccttacatatattatttcatataagaagcctagataattagataaaaaatagcttatatccatgcatatttgagtatctttctatcactgccttcttacttaacaaatagttttggctacatgagatttttggttcaaagttattttctttgtttggtttttttttttttttttgagggaaattactttttacttcagtgcaatttactggagagacgaactgtgcaagtagagatgcctgatgagcgtcacacaacgttttcggtggatagtcacgacacttgagcccaccacgaaagcaacgggaggcagctgcaatattccagcaggacagtgtgtactacagtgagttttaagcagttatgattttttaaattatactttaagttctaaggtacatgtgcacaacgtgcaggtttgttacatatgtatacatgtgccatgttggtgtgctgcacccattaactcatcatttacattaggtatatgtcctaatgctatccctcccctctacccccaccccatgacaggccctggtgtgtgatgttccccaccctgtgtccaagtgttctcattgttcaattcccacctatgagtgagaacatgtggtgtttgattttctgtccttgcggtagtttgctaagaatgatggtttccagcttcatccatgtccctacaaaggacatgaactcatcattttttatggctgcatagtattccatggcgtatatgtgccacattttcttaatccagtctatggacacttgggttgattccaagtctttgctattgtgaatactgccgcaataaacatacgtgtgcatgtgtctttatagcagcatgatttatactcctttgggtatatacccagtaatgggatggctgggtcaaatagtatttctagttctagatccttgaggaatagtcacactgtcttccacaatggttgaactagtttacagtcccaccaacagtgtaaaagtgttcgtatttctccacatcttctccagcacctgttgtttcctgactttttaatgatcgccattctaactggtgtgagatggtatctcattgtggttttgatttgcatttctctgatggccagtgatgatgagcactttttatgtgtctgttggctgcataaatgtcttcttttgagaagcgtctgttcatatcctttgccaactttttgatgaggttgtttgatttttttttgtaaatttgtttaagttctttatagtttctggatatcagccctttgtcagatgagtagattgtaaaaattttctcccattctgtaggttgcctgttcactctgatagtaggttcttttgctatgcagaagctctttagtttaattcgaacccatttgtctactttggcttttgtttccattgcttttgctgttttagtcatgaagtccttgcccctccctaggtcctgaatggtattgcctaggttttcttctagggtttttgtggttttaggtctaacatttaagtctttaatccatcttgaattaatttttgtataaggtgtaaggaaaggatccagttttagctttctacatgtggctagtcacttttgccagcaacatttattaaatagggaatctttcccccatttcttgtttttgtcaggtgtgtcaaagatcagatggttgtagatgtgtggtattctttctgagggctctgttctgttccattgatctatatctctgttttggtaccaggaccatgctgttttggttactgtagccttgtagtatagtttgaagtcaggtagcatgatgcctccagctttgttcttttggcttaggattgtcttggcaataagggctcttttttggttccatatgaactttaaagtagttttttccaattctgtgaagaaagtcattggtagcttgatggcaatagcattgaatctacaaattaccttgggctgtatggccattttcatgatattgattcttcctatccatgagcatggaatgttcttccacttgtttgtgtcctcttttatttcattgagcagtggtttgtggttcgccttgaacaggtccttcacattccttgtaagttggattcctaggtattttattctctttgaagcaattttgaatgggagatcactcatgatttggctctctgtttgtctgttattggagtataagaatgcttgtgatttttgcacatcgattttgtatcctgagactttgctgaagttgcttatgagcttaaggagattttggactgagacaatggggttttctaaatatacactcatgtcatctgctaacagggacaatttgacttcctcttttcctaactgaataccctttctttctttctcctgcctgattgccctggccagaatttccaacactatgttgaacaggagtggtgagagagggcatccctgtcttgtgccagttttcaaagggaatgcttccagtttttgcccattcagtatgatactggctgtgggtttgtcataaacagttcttattatttagagatacgtcacatcaatgcctagtttattgagaatttttagcatgaagggctgatgaattttgtcgaaggccttttctgcatctattgagataatcatatggcttttgcctttggttctgtttatatgatggattatgtttattgatttgcgtatgttgaaccagccttgcatcccagggatgaagccaacttgatcgtagtggataagctttttgatgtgctgctggattcggtttgccagtattttattgaggatttctgcatcaatattcatcatggatattggtctaaaattatcttttttttgttgtgtctctgccaggctttggtatcaggatgatgatggcctcataaaatgagttagggaggattccctctttttctattgattggaatagtttcagaaggaatggtaacagctcctctttgtacctctggtagaattcagctgtgaatccatctggtcctgaacttttttggttggtaagctattaattattgcctcaatttcagagcctgttattggtctattcagagattcaacttcttcctggtttagtcttgggagagtgtatctgtcgaggaatttatccattttttctagattttctagtttatttgcatagaggtgtttatagtattctctgatggtagtttgcatttctgtggggtcagtggtgataccccctttatcattttttattgcatctatttgattcttctctctattcttcattagtcttgctagcggtctatcaattttgttgatctttccaaaaaaccggctcctggattcattgatttttgaagggttttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttgtgggcacttaatgctctaaatttccctctacacactgctttaaatgtgtcccagagattctggcatgttgtgtcttcgttctcatcagtttcaaagaacatctttatttctgccttcatttcgttatgtacccagtagtcattcaggaacaggttgttcagtttccatgtagttgagcggttttgagtgagtttcttaatcctgagttctaatttgattgcactatggtctgagagacagtttgttataatttatgttcttttatatttgctgaggagtgctttactgagaccatcgatgctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtatttaggagacctatctcatgtacagagagacatacataggctcaaaataaagatatggaggaagatctaccaagcaaatggaaaacaaaaaaaaagcaggggttgcaatcctagtctctgataaaacagactttaaagcaacaaagatcaaaagagacaaagaaggccattacataatggtaaagggatcagttcaacaagaagagctaactatcctaaatatatatatgcacccaatacagaagcacccagattaataaagtaagtccttagagacctacaaagagacttagactcccacacaataataatgggagacattaacgccccactgtcaacattagacagatcaatgagacagaaagttaacaaacatatccaggacttgaactcagctctgcaccaagtggacctaatagacatctacagaactctgcaccccaaatcaacagaatatacattcttctcagcaccacatcgcacttattcaaagttatttatctttcagaactttgaaagtactgttccgtgatcttctagaattaaatgctgcatatgagaaatgtgattttagtccagttcctgcatgttttgtcacttattttttccctctaggggaatatgttggtatatatatattttctatggagttctaaaattttactaggaataattgagtttttgacttttttaaatcatgtgattcaacacatagtgagccctttctatctgaagaattataaggcttttttcagctttgtgaataatgtttttatcatttcattgactatttccacccctctatcttaactatcacctgcctctggaaatcctattagaaagacgttggtcttcacagatcttaacccccaagtttctaatttcccaaattatccattaatcagttatactgtacattatatatatgaatattctgggaggtttcctgaactttcctttcaaaaatcagtctttggctaaatctattctatttgttggcccatatatcaaatgttttgttatgaaatcattctaattcttggaaagagttttaactatttcaagattattttgaatcttactttgaaagtttggtgtagaaagaattcttacttgatggactaagaacacaagagattgagagttaagattagaaagaaataacattctacacgttttgtaaaaggtggggattttttccttatttttaaaaaatgaataaaagccaaccaatctttgttgggcatggtggcaaatgtctatagtcccagctacttgggagacatatatgtgtatatacatatatatacacgtatatatgtacatatatgtgtatatatatattttaacatgggactcatatatatatatgagttaaaaaaacattttatttcattaatatctcttgtacatgggaaactgtcacaaagcagtttcttctctttttactatactctaaacatagactatatataaaagaggttagctatagttcctgagtcagctactcatcactcatttcccacacctaaaagaggccaaggacacttaaatgtaaattcattgtacttttcacctttttgagtgaccccattttataggtatcttggggctagctatttgcacatcagacttttccattctgaaatgctgactcaattcactagagagaaggattctacttgtgagtgtggaaaaaaaaaatcctgactttctagatcattttccctattcactttggataataccactttataaataggatttgatgcatgcaaagcagcaatctgaaaggaccggcagtatatactataagcacttattatagtatttgtaaatgccttattaatggcaaaatagctttgaaaccatccatgatatgtaccacagctaactcaatttgacagtgaaagatgctatgtcagtctgttatggcagatataaaacatgtaccatatgagtagatccttggcatatgttataaaaattacttttgctttatattttctagttgtgtaaaaagggacaagaagcactcctaacactgttttcattggactcttccacactgccttctgttgcctactataaacagttaaatatatcttcttttactatctggctacagcagttttctgtatataaaaatttttccactctactatgaattgggtttatatggactccatctaaacattattcatgaactattctgaatacataccaaatgataccccagtgatcttcaaaacgctgaagtttcaattttctttaattctgctatcaggccaggcaaagcattcatctcagtgaggcagcctgcctcttaggcatcattaatgttttagattttcataaattccactacggctaaatagaccaagaacctgaactccatagagttcctaaaagaattcagcagctactgcctttttttttttttttttttttagttttatttccaagatgaagtttaaaaataagaataaaaactggcaacaggccagacatggtggctgaggcgagcggatcacttgagcccaggagttgcagaccagcctggacaacatggcaagaccctgtctctagtaaaaacacaaacattagctaagtgtggtggcacatgcctgtaatcccagctattcaggaggctgaggcacgagaatctcttgaacctgggaagcagaggctgcagtcagccaagatcgtgccactgtactctagcctgggtgacagaacgagactctgtctccaaaaacaaacaaacaaaaaacagaaatactgggaataaaagtatttttgaaacatgtagatcctcttttattaagaaagaggcagacatctcacacttaggaaaatctcaacccttaaagagagaaatgaaatagaaattttacaaatcaaaacaaaagtaaaaaaaaatcaaaaataacagatttttatctaagaaattaaaatttcagatttaacgtggaaaatatctgaaaaatgttgtgattatgaataagccttatgacatttctgcatcacttcctgacttatagacctatttctctaaattgatattcattctacaccaatgaaccactaaaggccttgttcatcaagattccagaggtgatttctattcatattttgctatgaatacaccaaactgtatgaaaagttagtttttttccatttctgtaaatataagtttaataaaatacaaccacagataacacaccaggccaatgtctcagtcaattaccaacttagccatgttttcctatccaaaaaattcatttgtttttggtgacagtggtgatgaaatcatttatttacttatttttcatttggttttcatgaaatacttgttccagtttgttccatgtaggttttgagaaagattacagtattttgttgttctaataaactgagacattcagttctatcagacaacgatcttacttttattctagctgccagaaaagtcacagctaaagttgacattcaattatggtggctttctttagttaaaaaaattaataaaacgttcttctcttcccctttactacctaacttttgcctttgttcttacggtatgatccttgatcttactgtatctgtagttttattttaagtaagaagtgaggactctggacattgctctagttgttcaaatgagattctatgtggattgtaaaaatatatttttctactggaaagtaagtctatttgagtagctagggctcctgttgtaatagaaagggtaccaatcccaagtaatatgatttctaaaatgaagtcattatcataagtggagtatattatttcaagtgagtaaaacttttgaagagtgaattgttcatattctgggttatgtatgcatttgttacggtcaaggaagcttgaagcttcaaattcataaataaattacatcaaatgcaataagaataccacctactggacactttataatatgcattaatagtatatttatgactttatttaatttctaaaatggccctatgaagttatttttagaattttcattttacctatgtggaaactgagccacatagaagatgcccaaataacagtatttctgcagaaatcaaaacccaatttgcctgactctaacatttacactatatatattttatacatatatactatatatatatgtaacacatatattacactgtttaatataattacagtctcacatagggatgaattcgattattcagataattaaaatgttttttaaaagaaaataatattcagcatatttcttcgttagttatatgttaaaatacgaagatacacatcaaactactaaatcaactaagactaaatgctcttttgtatataactcccttattagacctgaatgttacagaattgtaaacttaatttggcagctgatctgaatccaggtcgctactctgtagtcagctgtgttgtatgactctgcactgagacccagaggaaccacaatgaaaaattagctgctcagtataacgaattgccagatgctggactcaagtaggtaatgacatttgaaagcatgtgtgcaagtacagaagaaaattctgaggtcccagatctcaaattttatgtgttataagcaaaatgctaaaatctcaagttccatttttaaaaattaattaaataattatttataacgtgtgtctaggcaaccacacattcaacagactaccaggacagattttgcctctagcactgtggtttaagaaagagaaggataactctctctctctctctctctctatatatatatatatatatattttttaacatgggactcatatatatatatatacacacgagttaaaaacattttatttcattaatatctcttgtgcgtgggaaactgtcacaaagcagtttcttctcttttttccgcactctgaacatagactatatataagagaggctagctgcggctcctgagtcagctactcatcactcatttcccacacctaaaagaggcctttttgtttggcaaaatgcttcccaaagtaaatagaaacgacagttaacactttttattttctagctaagagtcacctattgccttcaaaaaaataaattcttctagtagattacagaatttgctttgaaaaattttggtagacttttatccttaaaaaatccaggtagcaagagaacctggataagtactgcctggattagcgagcggttatgagcaaacgctatctgagaagtaagttttcatgagtgatgagaacataccctttcctgcttcgctgtccctcaccatcaaaatccctctcaccaccttgctgaaaccaaccgttgcagagattcattctattgatgtaaggttgggtctcaactgaaatagttaacaggcagagagcatatctcttttgaaactgtatttggagtaaaaggttcggatactgagccactgataaggtgtttggaggaaattgtttcataaaactgaaaagcaaccgtaagaaaataaggttggagccaatatgacaagaactgatgatgtaacgattctgcccagaatgttctgaccatgtcatcaaatcatgccctctaagcaatacaagacacacaagagaagtcttcacaaaacacacgctgggctctcacacactcattttcggattttgaagggatttcacaagatttcaaatctgcccagatcatctcaaaattgttcatttctaaacttgaaatgtctcccaacagagactttttggaaagtaatttgggcaggtcgtttgttcccattatcaattaccggtcagtatgtaagtagctctcttcccatgtcaaagctgcccctggccttcctcttgctcatgctctaattgtgttattagtcaggctccaaagtctgagtgtagctccatctaccacaccctctgggccagttatgcaaaagctctctgactttcctttttttttttttttttttttttgagatggagtctcgctctgtcgcccaggctggagtgcagtggtgcaatcttggctcactgcaagctctgtctcccgggttcacgccattgtcctgcctcagcctcccgagtagctgggaccacaggcgcccgccaccatgcccggctaatttttttttttttttttttttgtatttttactagagatggggtttcatcgtgttagccaggatggtctcaatctcctgacctcgtgacccgcgcgcctcagcctcccaaagtgctgggattacaggcatgagccaccgtgcccagccgctctctgacttcttttacctaattcacagtatttctctgagggtcaaataagatcaagaacaagatgcgaaaactacaaagtgcattttaaaataggtgattactgggatttttttttagtatttgatttttttatagtatgatcattgctttttgtttcttcatttgtttttgagacacagtctcactctgtcacccaggctggagcaaagtggtgcgatctctggctcattgcctcccaggtttaagtgattctcccgcctcagccttccaagtagctgggagtacaggcgcctgccaccacacctggctaatttttgtatttttagtagagacagggtttcaccatgttggccaggctggtcttgaactcctgaccttaagtgatccgcccacctcagcctcccaaagtgctgggattacaggcatgagccaccgtacctggcctgattattgatactccacacaaaacacagaaaatacaacacaaatatggaaactattaaacaattatttcaggttttaattcacaaaaatgcacccagtatggatcctagttttttgttttttttgtatttttttttgtaatttcctaaatgtactgggataaaatatttctgaaaaaataagctctataaaaattttcaattaaggttatatttgatcatcatagtagtacagcccaacaaaacagttttacctaaagtaacatgaaaaatataatttctgtttcacccttaaaaaatgtgtgtttgtatttatgtacttccaaaactttttcttatcaactaataagatcaggtcacgttaagtctattgatctcacctttcactgtaatatctgctttggcaactgttccttagatacaatgttctccaaactcaaaagttatttccccactggataggtgattttgtactgtttatattaaactttatctcttttcttctaagagcagctcccccaggtagtcaagtctgttccatgttagcttactttcaaattaagtcaccttctggcatgacacaattatagagcacattaataactgcaggcacctgcagaataaattcaaacgcattcctttccctccccctctcttgatatatacctgcaaaactgtctaaaaattctataaaatctaaaactcaaaaatggtcttctctatattcctgtgttcctccttactgatactaggttctaatactctgtcttctaaaacctggcaacactatctaatctattctcaccctgtgatgactgtgactgctgaaacctcattttcatagtccaacattcaaatcttcaattgttgcttgacaaactcagttatcatggaatagctacctgaagaaaacagctgaattcagtacactattttcagtgactgcaaaactataatacacaatacagatatttttcacataaactaggtgtaaaaatacaatgttcacacttcatatgagaatattttatttctagaaataaatcttcaccagtccaaacacgtaagtttacagaaagtcagtaagaaatcattatatttatatagcaccttgaccactacaaaagctgctcactgataatatcagaaataatcaataggcttataacactgccaaaatggtagcagagtatcgtgtgtctattgagtctgaaattaaattgcaatttaaggtccatctcttaaagctatattcatgtatttagaactctatcaaacaaaacaagaaaaaaattactttgacgtacatcttttaaagatgaatatgaaactttggacaataaatactactctcccgaatcaacttttaaagtgcaaccatcttttaatgatagttaactgctttaagaaagcaataaactaaaatgtaaacctgaaagcccactatcttaagctcttttaaaaattaaatacaccagcaacattttgagactcaaaattaatttacttcactcaatcctatgcataagtttggcaatttgtttcagatgctattttttctgtaatttttgtgggtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtataaaaaggcttcacaggggaacattcttttctgataaaggaaagcagctgggttggcttcaaatagcagtgactttacttggaatattcacaggtaagctgcaaatataaaacaccttccacagagtgttattttgtaatcggggcttatctcaagtgcaagaacctccagcctacagctttagtaggtgcctcagacactgtgcccggctttagtaggtgcctcggacactgtgcccggctttagtaggtgcctcggacactgtgcccggctttagtaggtgccgcggacactgcgcccggctttagtaggtgccgcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtaggtgccgcggacactgtgcccggctttagtaggtgcctcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtacgtgcctcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgccgcggacactgcgcccggctttagtaggtgcctcggacactgtgcccggctttagtaggtgcctcaaacactgtgcccacgtactctgaatggcgtatacacaatgataataaaagataacacagtgtttgctaagtgccaggtacaactacaggtaccgtaccagatagaaactgttattataaccatttgacagataaaaacactaaagcacacggagatgagtgaatttgcccaaggtcacatagacagtaagcagtatgaagaaacatatgtataactgcactgactctaaaatattataaatttattctgttaaaggtttctgtttaaaaaaaaatccatgtatttattaaaagtagcttttttctcagattcacttatagcaagactttattacatattaacttatcactgggtacaaaccacctggttctaaagacgtctgtcctgattactgtagggactgttatatatgaggcagaggcatcttttcattattattatttcccaaaacctatagaatttgtgtatagcagttatagactatgtctgaaatagttatattcacataacacttaataatcacatttaagtattcactaacagaacaaagcctgttactatggtaaataaatacacacagttctatcacagagcacagaagtcatcaaacagataatattttcttcattacacactgaaacttgtgacccgctaacagcataaaataatgtttaatatttaataccatgtgatggcaatactcaaccaaacatgtatttcaaatgatatgttatttgacatttcaatttcagctcaaaagtacttctaaaaaggatgaaaatatgtgcctgaaactgatagtttgaatttaataaatttttctgggattgttgtgttttgaactttaattttagaaccaagggggtacatgcgcaggtttgttaccagggtatattacatgatgctgaggtttggggtacaaatgagcccatcacccaggtagtgaacacagtttccaccagttaggttttcaacccttgctccctccctccaacctcgagcagtcctcagtttctgctgttgccatctttatgtccatgagtacccaatgtttagctcccacttctaagtgagaacatgcggtattggttttttgttcccgtattaattcacttagaataatgacctccagctgcatccaggttgctgcaaaggacatgattttgttctttcttaaggccacattgtattctgtggtgtatatgtaccacattttcttcatccagtctactgttgctaggcacctaggatgataccacatctctgctattgtgaatagtgcagcaatgattcttccaatccatgagcatggaatgtctttctacttgtttgcgtcatttctgatttctttcagcagtgttttctagttcttgtaaaaatgttttacttccttggttggatgtattcctaggtgttgtaggtgtgtatatctactgcaaatgagactggattcattatttggctctcagcttgaacgttattggtgcatagaaacgctattgatttctgcacacagcgatgaacatgcaactatatgtctttttggtagaattatttgttctcttttggatatgtatccattaatgggactgctggatcgaatggtagttctgctttaagctccttgagaaacctccaatggcgttccacagtggctgaactaggtttatattcccatccacataagtactcccttttctctttttctctgctgcctcaccaaaatctgttgttttttacttcttaataataggcattctattaaaaaaactttgtcagatgtgtagtttgccaacattttctctcattctgtagactgtacactctgttgatagtttcttttgatgtgcagaagttctttggtttaattaggtcccaccagtcaatttttacttttgttgcaactgcttttaaggacttagccataaattatttgccaaagtctatgtccagaatggtgtttcctagcttcttatagtttcagatcttaaacttaaatcttttccccatcttgagttaatttttatataagatgaaaggtaagggtccagttccattcttctgcctatggctggcaagttgccccagcaccatttattgacagggagtcctttcctcattgcttatttttgtctactttatcaaagatcagatggctgtaggtgtatggctttattttggggttctccactctgttccactggtctatgtgtctgtttttgtaccaggaccatgctgttttggttattgtacccttatagtatagtttgaagtcaggtaatgtgatgcctctggctttgggctttttgcttaggattgctttggctacttggactcttttttggttctatgttaattttagcatacttccaattctgtgaaaaatgacactggtagtttcataggaatagtgttgaatctgtagactgctatgggcagaatggccattttagtgatattgattcttccaatccatgagcatggaatgtctttccacttgtttgtgtcatttctgatttctttcagcagtgttttctaatccttgtaaaaatgttttacttccttggttagatgtattcctaggtgttgtgcatgtgtatctctactgcaaatgagactggattcattatttggctctcagtttgaacgttattggtgtataaaaacgttactgatttctgcacacttattttgcatctgaaactttactgaagtcattgatcagtttcaggagccttttggtggagtctttgggactttacaggtatataatcatatcacttgcaaagagaaatagtttcacttcttcttttcctaattggatgccttttctttttttcacttgactgactgctccagctagcacttccaggactatgttgaataggagtggtaagagtgggcttccttgtcttgttccagttctcagggagaatgctcccagtttttgtccattcaggataatgttggctatgggtttgtcatagatggatcttattattttgatggatcttattatttgatggatcttattataataataattattattattattattttccttcaatgcctggtttcttgagggtttttatcatgaggggatttggggttttgtgaaaagctttctctgcatccattggggatgatcatatggtctttatttttaatactgtttatgtggtgaatcacacgttttgatttgcatatattgaatcaactttcatcccaggaatcaagcctacttgatcatggtaataaagtttttgatgtgctgttttatttggtttactagcatgttgttgtagatttttgggtttatactcatgagggatattggcttgtcattttcttttttgttattgtgtcttcaccaggttttggtatggaggtaacactggcttggtatagtttcaaaattggtagcagctcctatttgtacaatacatctggcagaatctggcagcgaatccatttgtctggggcattttttttttttttttctagttggtaggttttaaattactgattcaatgtcagaactcaatactgttctcttcagggtttcaatttcttcctgactcaatcttaagagattgtgtgtgtattagtcagggttctcttagagggacataactaataagatagatagatagatagatagatagatagatagatagatagatagatagatagatagatacacacacacatacatacatacatagatacatagatagatacatagatataaacgggagtttgttaagtattaacttacatgattacaaggtcccacaataggctgcaagctgaggagcaaggagagccagttcaagttccaaaattgaagaatttggagtctgatggtcgagggcaggaagcatccagcatgggagaaagatgtgggctgggaggctaggcctgtctccctttttcatgattttctgcctgttttatattccctgagagctgattagatggtgcccaccagataagggtggatctgccttccccagcccactgactcaaatgttaatctcttttggcaacaccctcacagacacacccaggattaatgctttgtatccttcaatccaatcaagttcacacttagtattaaccatcacagtgtgtttccaggaattcatccatttcctctagattttctagtttgtgtgcatagaggtgttcataatagtctctgaggatcttttgtgtttctgtgggatcggttgtaatgtcacttttgtcacttctaattgtgcttatttgaacttcttttttgttaatctagctaatggtctatcaatcttgtgtatcctttcaaataaccaatttttagttttgttgattatattaatttctgggtctcaatttcattcagctctgctcttattttagttatttctctttttctgctagctttgaaatgtttgttcttgtttttctagttcctttaggtgtagtattaaatcattaaattgggatctttctaacttcctgcggtaggtatttagcactataaaatttcctcttaacactacttttgctgcatcccagaggttttggtacctgtgcctctgttttcatttatttaaattttttttatttctgccttaatttcattgtttacacaaaagtcattcaggagcaagttgtataatttccatgtaactgtggttttgagtcctttaaggtactgatttctatttttattccactgtggtcttagaatatggttgctatgatttagattttttcaaatttattgaaacttgctttatggctgaacatgtggtcaatcctggagtatgttccaggtgcagatgagaagaatgtatgttctgtggttgatgagtgaagtgttctgtagatgcctattaagtccaattggtcaagtgtttactttaagtccagaatttctttgttcgttttctgcctcagtgatctaatagtgacagtggggtgttgaatttccccactattattgtgtggttgtctaagtcttttcctaggtcttgttttatcaatgtggctactccaatattgggtacatatatatttaggacaattaaatcctcttgttgaattgaatcctctatcattatgtaatgcctttctttgtccttttttactgttgttggtttaaagtttgttttatctgatgtaagaatagcaagccctgctcttttttgttattcattactttgagcctgtaggtgttgttacctgtgagatgggtcacttgaagacagcagatgactgggtcttgttgttttatcaaacttgctactctgtgccctttaagtagactgtttagaccatttacaatcaaggttaatattcacatttgaggttttgaccctatcatgaaattgttagctggtggctttgtagtttctattatgcggttgctttatagggtctgtgggctatgtgcttaaggtgcttttgtggcagcagctgtttccatatttagaacttgatatggtttggatctgtgtccccaaaaactctcatgttaaattgtaatctccagtgttggaagtgggactgggtgggagggaggtgtcacaccacccttccctctcctgcttctgccttgtaagacggctgcccctcctttacctactggcatgagtaaaagttccttgaggcctctccaaaagtagatgctgccatgcttcctgtatagcttgcagaaccataagtcaattgaacttttcttataaattacccagtctcaggtatttcttttcttttttcgagacagagtctcactttgtcacccaggctagagtgcagtggtgcgatcttggctcactgcaacctctgcctcctgggttcaagcaattctcctgcctcagcctcccgagtagctgggattacaggtgtgcaccaccacgcctggctaatttttgtatttttagtagagatggggttttaccatgttggtcaggctggtctcaaactcctgacctcgtgatccgcccacctcggcctcccaaagtgctgggattacaggagtgagccaccatgcctggcctcacgtatttctttacagcaatgcaagagcacactaatacagaacacctttaaggaactcttgtgaggctggtctagtggtaacaaattcccttagtgcttgcttgtctggaaaaaaattttatttcttcttcatttatgaagcttcatttgacaggacatgaaactcttggttgcaatttcttttctttaaaaatgctgaaaatagcccccccaactcactttgcttgtaaagtttctgctgataagtctgctgttggcctgatagggctcctgttgtacaaaatctgacctttttctctagctgcctttaagatatttttctttagcaccgaccttgaacagtttggtgactatatgacttagtgatgttcattttgtatagtatctcacaggtgttctcaggatttcttgtaactggatgtctacctctctagcaagcttagggaaattttctttaattcctcaaatttgttttccaggttgcttatttttttccttctctctcagtaatgccaataatttgtagttttggtcactttacataatcccatatttctcaaagactgtttattttattaaattattttttcttcctttttgtctgactgggttaattcaaaagactgatcttcaagttctgaaattctttcttctacttggtccaaaccattaataaaactttgaattgtatttttaaatttcttaagtgagtttttcaattccagaactggttgatttctttttaagatatttatctcttccttcattccctggatagctttagaagcttctttgtgctgattttcagtcttgtcttggatctcattgagcttccttgcaattcatgctttgaattacttatctgtcatatctgagtttccattttggttaggaaccatttctggaaagcttgtgcaatcctttggtggtgttactacattcagatttttaatggtgccagtaatcttgtgctgattctttctcagctgaagatgctagcacttctaatttttgtaattattttcatgtaggtaggatgtttctttctcttttcttcctctataatgttactgggttttttttccttctctttccctttcccctgcttcctatgggtatgactacagattattttgggtaagatctatttgttttgcttctatctttgctctgcctttggttttgtttctaccagttcttctggtaggttttgtatcaggctgtgcagttcaatctacatgccagtagatgatgcttataggtaagagccagttgcagccaatgtagctggatacttgatccttgtttactggcagaagttctctgttgcctcagacaatgggctgatacatagaatgcatagtggtctgagctccctgctcagccccaagggcatggggccagactggtcaggtccacctaaaggtcccctgatacaggcacaagcaccagcactgacagagaatccaatgggtggctaccaagcacccagaggtatgcctaggcatggagctcctcagtatcaagttctctgcacaggaatgggaaacctcttcagcatcaacttctctacacaggaatgggggatgccctaaactccaaatccagaagagctctgcctaggtgtgtagtatagtgggctccccctgaaccaagatctctgcataaaaggggtagggtgactcgaactgctgaaccaggcaagcaggtgttctgaatacctggagatctgtctgggcatggagcagagagagtccccctatatgaggatctctgcacgggaaggatggagcagctcgggctactgacccaagtaagcttgtgctccaaatgcctgcagacctgcctgggcttagagcagagagggtcccactgtcccacaggaagagttgcgtggctcaggctgctgaaccagataagcaggtgctccaaatgcctggagatctgcctaggtgtaaagcagaaagggcctccctacaccaggatcttttttatccaccagacactgtcgcagaggttgtttgccagtgttctgctcaccaggatctgggtgtccctcacgattccagtggattcccattttccttttgttgttgttgttgttgttgttttttgtttgtttgtttcttttttgagacagagtcttgttctatcaccaggctggagtgcaatggcccgaccttggctcactgcaacctctgcctcccaagttcaagcgattctcctgcctcagcctcctgagtagctgggcctacagagctaatttttctatttttagtagagatggggtttcaccatgttggccaggatggtctcgatctcttgacctcgtgatccacccgcctcagcctcccaaagtgctagattaccaggcgtgagccactgcgcccagccccattttccttcttgaaaaaaagctcatacagtttatcttcatgcactatctagccatttccaagtggctgaggcatgctacaagcctcttatctgccatcttagagaaacaatctgcactttataaatggacaggtaaatctttgttgagagagaaaaaataaaggaaacagcttgtagagtgacccaagtacagtcctgaagctgctctcaaggaaagtaagaaaaatagcagcccaaaccctccccttagaaggaaggcttttcccacagagtctcgccttctggctggaagtcatctctttctgggttttgttgttgttgttgttgttgttgttgtttatttgagacggcgtctcactctgtcacccaggctggagtgcagtggcaccatctcagctcactgcaagctccgcctcctgggttcacaccattctccggcctcagcctcccaagtagctgggactacaggcgcccgccaccacgcctggctaattttttgtatttttagtagagctgggtttcaccgtgttagccaggatggtctcgatctcctgacctcaggatccaccctcctcagcctcccaaagtgctgggattacaagcatgagccaccgcacccagctctctttgttttttttttttaatgttaccttatagtcacagcattttatgctttaatgataattcacatttaattttagaaaacttttattttcttaaagatataatcgtttattatatttacatattgaatgttttcaatgacaataaatataggaaggtcatcaacaagacccatagaatttaaacaatcacacataaaataattggtgtagaagtcaaaattttttaaatggttagctcagaaaatacagaaagctcaagacacattactaaaacatgaactgaccttaacaaagaaaaacactgctttgtttctattatacttcaaaaaaaaacagtaataagaatttaaaaaaaaaatcagttctctgttgcatagaaggagaaatataccattttctctttctgtgaggaaaaagaggaaaatcatatttaaaacgaatgacattctgtacagatgggcataaacagcgccctctgtctcatgtacacacatccttttcttgtcactcagctttatttctggcaattcttaaatcggagaaaaaagttacaataaatctgtaagatccatattgtgtatagaagtaagtgaaaaataagctgttcaaattccaatacctactgatctccttctgtggccaaagtttctctgacatcattctgctgcttgtttattcttccatgctctcctattgttacagagggcaactaattttaaaaagtatttgacagtattaagcaataactttgtgccgattttctttttcacagaacagaattaaatttgagtgcagatgtgagtagatatagaagagtgtatgatatttttgtgtgtgtgttttctttgtagagtccaaaagccctgtggattgttagtgaagctcaggcagaataaagcaaatagaagaacaaggcaactgaagtctaacgatatggtggataagaatccgattttaaatcttgacattgcttgagaatgggaataatgtgttacttatttttcgcactatgactaacaattattaaacatctaatatgtaccaaacacagttctggacatattcccatatcttaactcgtttaatcttgacaacaatccttctgaggtaggttttattacccttcatttcagatgaggaaataaactcacagacattactaatttgggtgactcagacagacacagtttccattttgttcttcctttcagttaacatatatttcttatggactttctgcttgttccaggcactatgcttggcacagcgtctaccatttctctttctactaaaccatatagccggtctctgacacctagcacagtacctaggtcatattaggttctcaatgaagattcactgaattatttggttaatttacttgtctctataaaataaacatttacatagaaatttgggtccaggtttatattatcttaaaacatcttgtaattcaacactgttaaaacatgtattttaaaaatagtttttcaaaagagaaaatatttcattgattatagacatctaggaaacccaagtcaggtggcaaatacctgcactgaaaactaacagaatcatggaaaggaagcctgacacagcatgatgcacattctctcaactttgtatgtaaataaatcctacattctttaattgtctcaagaatgcgtgatttgaatacctaattctattacaaatatcacatgggaatggtcttccaatgttggtacatgtactcaaggcacaatgcatagtgttgaccaaaaagcaaaagcttaccatgaaaaaaggtaagtaatggatggattactttgtagtcagacatggataaggttgaatgttagctctgccatttactagctaccttattttgagggaagttatttcacttttctgaggctgtttctgtactataaaatacagataattctaacagcatctactgtgcactcagagattatggtgaggactaaatgacaggatgtatgtgacctgggcacatacccaggtcagagttagggctcattaacagttagctgtatattgaagtagaaaagttagggaggctgggaaataaattttctggtaggcatgaggtggagcagactacataatgatcaccttctttttactgtctaacctttaaagctccttagtatgcaggaaaatgcctgctcctgaatgagctgatcttcataccagcgtatttatctttcctaattcaaaaacagcctccttaaaacacaaacatactttttcatactgtcattcaaaatagctgcttatgatataacttaatagtaaaaatgggaaaattactgatttctttttgtacaattctatgtaccttcaacaaattatgccttttcattttcaaaggataataccaattccttccaaaggcatgatcaaacctaaatagtggttaatttgaacatttcttttaagtcccagaagaagaaattacgttaaccacttcttcatatcttaagtgaaaaatgtgtaagacagtaactgtcttaaataattacatttctgcttattaggtgtaattaatattttatccccaaattaagccaaaataattccttagatataagatgcctacacaaccaacaaatcaagcttttaatttctgagttctagccaaaaggccatattgcctaagaagagcagaaataaatgtttttttttttgttgcctttttaaaaactttgtaacctacatataaatagaaggaaactcagatttcgaatacagacttctgagggaaatcaaatgaatacaaaatttattgtatactaagcagtaactcttgtttattctatcacttgggactgtatattctttttaaattagtatatcaattgttctgaatataataattcaatacagtcatcttcctaagggtccattttaagcatcattcaaagcaagtagtagtaaaaaggaacaaagcataagccacagcagtgctaaaaatatggtaattgattaaaacaaaaacaattagctgggtgcaatggctcatacctataatcccagcattttgggaagccaaggtaggaggatggcttcagcccagaagttcacgaccagcctgggcaagatggtgagaccctgcatcttagaactgatgaaagacggtaacttttctatattttttcaatatgattttattctcacacatcaacaacattctaagatgtcttacaaagaatagcttttgtaatcccatggcctctaatgcaatacagtgctttatacacattctatgggaattgcaggtaccatctccatagcctaagagtatgcaatctgaaccaaatccttttctgtccacatcttgaagtgcttcttaaattcctaagatctaactagttacttctctattacctgttagtggctctgctatagaagaaaaggtgaaagtaaatatctacaaagaaagacagtggggatagtgacaacaataataaccactatttactaagtgctatgttctaaacactttacatggactttgttacttaatgtttgcaattctatgatgcatacagaatcagtcttattacgagatgaacaaatttagtttccaactgataattgtgaagaaataaaaaactacaggagagtgatttttaaatcaaaggtgcatatgaagagaagcatgctaatgaaataatcctgctagcttttcttttttgattttgtaaaatattaattgctcttgcactgttctttattgacaatggatcagactgaagcttctggtcagtgtatctttattatttttcgagacagggtctttctctgttgaccaggctggagtaccagggtgtgagcatagctcactgtaacctcaaacacctgggctcaagtgatcccacctcagcctcccaagtagctaggatgtgggagtatgccaacatacccagctaatttttgtattttttttttttgtaatagacagggtctcactttcttgtccatgcttgtcttgaactcctgacctcaagcaaacctccctccttggcctctcaaagtgctaggattataggcatgagccactatatccagttctgcttcgttttttttgttgttgttgtttgtttgtcttaagaaaaaattctcattttgtgaagtgtgagccaggagaaagagacaagaggctgactccagaaaaactgcagtcttcattcttaaaaagcacatctttcagggatgatagctattgggatattcacatgtcagcagctctcagtataaacaaaacaacaataaaaagtcagaaaatcagcaagaggaataaacatgtcagaaatattgtgggatccagtgaccatcacatgtcttaataatgagctcatcatccagcctgtatgagccttctcctgtgagagcatctttttgaaccaacggatcaacagaaaatactcccgcagtgcttgctttttaaagtaggattatatgaaagtaactgagaattactcccatctccttatattgacaatcttccagttaatgagaagatggattttctcctcaagctattgggtttgagaatcttctgttctgtgttagctaatctctcatgaatgtttttaacactgaaggtccttgtatttgctattacaaaaaagcaggtgcaactgagttccttccttagaattttgagctcgcaatcatttgttcaagatcccactaatctttttagttcttgtttgctgaacacctgattttaaaagggaaccccacaaatcccctttaaccactcttccatttgagtccatccttcatagtcatctactaaacattttgtttacaatgtatcaaaggttatgattcctaggaagtttggctttctttttttgtaaaaaacagggaaagaactctattgggaatgtcatgccctgtccatccatcccatctttttttaatcgggcaactttatattcatcctaccaggaccaactctaatgtccaaactgcgtgacagaattaacagttccttcctctgtattcctaaagtattttgttcacattattattattagagtattaatatattgagtatagaatgttttggtatgccgatagtgaagtcttattcatctttatatgttccaacggtacctggtacagagtagttactcagtaaaagtatgttgaataattttattaacgtgattccaaatccctaagtgataatcttatttaaggaaaatactataacactgaatactctctgaatagtctctgaaacagtaatgagaaatacaaaaatcagctgggcatggtggtgcacacctgtaatcccagctgctagggaggctgaggcaggagaattgcttaactgggacccgggaggtggaggttgcagtgagccgagattgcaccagtgcactccagccgaaagaaagacagaaagaaagagagaaagagagagagagaagagaaagatagagagagaaagaaagtaatgacagagaaaatactttttcgagtaaaacctcagaaaagaatatgatcccaagtaaaaaaaaaagtaaactgcgaaaataatatttttttccttttcttattcattttccacagcttcttaattctcttccattaaatcttattgaggcaattttatttatggatagttatatctagttttataagcctggcaaatatcttgccccaaagttacagaatatgtatctagtactggataatgcaaaattcactttgaaactttttattagaatatttgcttgcctaattaaagatggaatagagcaatattataataaatgtgcatagcctgaatacaaaggagctaagagataacggaatacatacatacttggccaaagaagacagaccacaattataaatatagcctagatatatacaaagcaaatggtcatgcattaacatattaattgaaggtgatgaactgaagttttatcaattaagaaaacactgcaagctatattctgggcccaattttaaaagtagaaaaaaaatggtattattttatggtttatgttatttatgtttattttatgttatttgattattcccagtccataggcacatccttaaaatttcatatgaacactttggggaaacattttaaagttttcatttgaacttactcctcgtcctcaaatgccagcaaactgttcctggtatatagaaaacagatcttatctaagaattcaccgtttacatgtgaaagcctttgcttagaattcctcctcctctcctgtctgcctgttgaaatcctgtcattctttaagggtcagacattgtgcttatatattgtcagaccacatcttctgagtctctcttgcagccccttcctggattacaactctaaggcagagactgcaccttaggtacgggagcatactgttgcatgctcaacaatatttgatgaattgaaagtaggcttttatcaattcataaacaaaatcaattattttaccaattccagctcatttcaacagatttctattcccaaagtctagggtcctttgtctttgttctgtcaatccctaaagaagcaagatcatttctgtcttttcctatgagcctgagagaggacaggcctcacacattcaccattcccaggtgtgcagtagtgtaaaaataattcacactgattccaaggtatcacttatcaattgggaattgtattgtcagaggcgtgtgaaccagaacaactccatcttgaacaggagctgggtaaaatgaagctgaggcctactgggctgcattcccagacaattaacgcattctaagtcacagcatgagatgggaggtcggcacaagataaaggtcataaagaccttgctgataaaacaggttgtaaagaagccggacaaatcagaccaaaagcaagatgtccatgagagtgacctctggtcgtcctcactgctacactcccaccagccccatgacagtttacaaatgccatggcaacatcaggaagttaccctatatgatctaaaaaggggaggcatgaataatccaccccttgtttagcatatcattaggaaataaccggccaggcgcagtggctcacgcctgtaaacccagcactttgggaggccaaggcaggcagatcacaaggtcaggagatccagaccatcctgaccaatatggtgaccccgtctctactaaaatacacaaaaaaaagacattagccgggcatggtggcacacacctgtagtcccagctacccgggaggctgaggcaggggaatagcttgaacctgggaggcggaggttgcagtcagccaagatctcgccactgcacaccagcctgagtgacagaacgagacaccatcaaaaaaagaaagaaaagagaagaggaaagaaaagaaaagaaaagaaagaaatgggcaaccagcagcccctagggctgctctgtctatggagtagccgttcttttattcctttactttcttaataaacttgctttcactgtgcaccatggactcgccctgaattctttctcgcgccagatccaagagccctcccttggggtcctgcaacactatcactgttaataaaatgatccaaacttcatcaccgttaacccaattaaccctaaagtagctgaagagtaaaaagttacaggttcccattactaaattagaatcagtaaagaataataagcacgtaactgaatctaattaataaataaaatctctcccttttccatcccactaaatgccagtaatcccactgtaatcccaccataccatctaaaatgtatgcttcaaggcccagggttaaggcccaactacatgaagcctcccagtttcctttgttttctctgaaactggctgataccaccctttccagatctcacactttagttagtagatcgactaacaacacagcaagagcctgtgttagtaactcaataaatactgaattgaacggcttctaagttatcactttataagaatgaatataatcttcttaacattatgacactgatattatgttctcatttttgacgttaggaaatggagggtcagaagattagctggtggtgatagaaccacgattagaatccttatctgtccaattcatactttcatactcttcccccatattccagtatgaccctggaatttattctgtcaaatattattgttttctttctgtttctttttttttcttttttttttttgtttttgttgttttgttttgttttgttttttgaggcaggctcttgttctgttgcccaggctacagtgcagtggtgcaatcacagctcaccgcaacctcaacctcccgagcccaagcaatcctcccacctcagccgtaagcagccgggactacaggcacatgccatcttgcctggctcattttaaaaaaaatcttttttgtagagaagctgtcttcctacgttgcccaggctggtctcaaactcttggactcaagtgatattcctgcctcagcctcccaaagtgctgggattccgggcgtgtaccaccacacccagcggtcaagtattattcctgagtgactttgtacatgaggtttaccttcccaagaaccatgttggttcctgaagaatgacctccaacaccagagacagagttttcaaattgaaatggtactcaagttggttaatttgaacagattgtctcttttgctaggtcattctcaattaagtcttggttgaataaattaataacattacgacaaacaaggattaacttcagaccctaccctcttaatccctgaaagaactggacattatagccctacccataggaagacagtgatagaattttctttaaaactatatataacatattatatgaattaacataattatttattcttgctaccatgcatttacatcaaaccattcatttctcaaggcatagatgcatccaaaatcctcctagattgaaactgttttcattttttattgcaataaaatatgcataaaaaatttactatcttaaccatagttaagtatacactttagtgttactaaatccattcataatgttgtgcaccatcaccaccatccatctctgtaactcttttcatcttgcagaactgaaactctaaattcattaaacagtaactccagttccctccttctttctagcctctggcaatcaccattctactttctggctctaagattttgactcctctaagtatctcataaaagtggagtcatatagtatttgtctttaatgtggctggcttatttcacttagcataatgtcctcaaggttcaaccatgttgtagcatgtgtcttcatttccctcctttttaatgctgaatgacattttatgatatgtatgtatgtaccacattttgttttcagataaatgacatgagggttgcttctacattttagtcattgtgaatagtgctgctatgaacactggcatacaaacatctctttgagatcctgctttcaattcttttgggtacatacacataaatggaattgctggatcatacagtaattctatttttaaatttttgagttgccgccatactgtttgccacagtggctatacagttttacacgtccacgcagtgcacaaggcttccaatttccccacatcctccccaacacttattttctggggttttttaaatagcagtcatcctaatttgtgtgaagtggtatctcactgtagttttgatttgcatttccgtcatgattagtgatgctaagcatcttttcatgtgcttattggcgtatcttctttggaaaaatgtctacttaagtcctttgcccattttaaaatcatgttgcttttctattgttgagttcttaattatatattttgatattgatccattatcagatataaggtttgcaaatatcttctcccatactctgggttaccttttaactgttgatactgtcttttgatgcaccaaattttttaaattttcataaagaacaatttgtttattttttttctttagctgcctgttcctttggtgtcattcccaagataccactgacaaatccaatgtcatgaagcttctgccctatgttttctaggagttttatagtttggggtcttacatttaggtctttgatccattttgagttgatttttgtatacaaacttagataaaggtccaacttcattcttttgcatatggatacccagttgtcctggcaccatttgttgaattgactgtgctttctccattgaagggtcttggcacccccatcgaaaatcatttgaccatataggtgaggttttacttctggactttcccgttgattccattggtctatatgtctgtctttatgccagtaacacactgttttggtcacagtagcttcttagcaaattttgaaatcagcacattgagtcatccagctatgttatttttcaagataactttagctatttggagtccctcaagattccatataaattttagatttttttttccttttctgcaaaaaaacatcattgcgattttgatagggaacgcattgaatctgtagaggcctttgggtaggtaatgacatcttaacaatattaaatcttccagttcacaaacatgggatatgtttccacttatttatgttgcctttaatttctttcagcaatgtttttctgcttttcattgttaagtttttaacctccttgttaattcctaagtattttattcttttggatggaattgtttttgtaatttccttttcagattgttcactgtttgtttgtgtataaaaatgcaacggatttttgtgtattcacgttgtgccccaatactttgtttaattcagttattagcattgatagttttttgtgggatctttaggattttctatctacaaggtcatatcatctatgaacagagataattttacctcttcctttccaatttgtgtgccttttatttctttttcttgcctaaatggtctagctagaacttcagtagtatgttgaatagaagtggtgaaaagcaggcatccttatctcatcctcaatcttaaaggaaaagcttttggtctttcaccagtaagatgttagctatgggtttttcatatatggcttttactatgttgaagtagtttctttttattccttatgtgttcagtgatttttgtcatgaaagggtattgaattttgtcaaaatgatttttctgcttcgattcagatgatcacgtggggtttttttccccctacaatctgtttatatgatatattacactgattgattttcacattttgaaccattcttgcagtctgggaataaatgccatttggtcatggtgtataatccttttaatatgctgctaaatttggtttgctagtattctgttgaaaatttttacatcagtgttcataagggatactggtttgtagttttcttttctcataatatctttgtctggctttggtaacagggtaatgttggcctcataataaaagcattaggaagtatttcttcctcttcaatactttggaaaagtttgagaaagattagtatcagcttctctataaatgtttggtagaattcacctgtgaagccctccaagtcagcttttctctgttgagagattattgattactgattcaatctcctaactaggtataggtccattcagattttcataatttttgtctttcacagttttttatatttccagaagtttgtccctttcatctagggtattcaatttgttgtcatacaactcttcctaatgccctcctataatcctttttcattctgtatgattcataataatgtccctgttttctttttttttttttttttcttttttttgggggggggacagagtcttgctctgtttcccaggctggagtgcagaggcacaacctcggctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctgacctcaagtgacccacccacctcggcctcccaaagtgctgggattacaggcatgagccaccacgcccggcccagtaatgtccccattgtcattttttattttagcaattggaatcttcttttttcttagtccatctatctacaagtttgacaattttgttaatcttttcaagaacgcagcttttggtttcactaatctttttttttttttttttttttttttaaagacagagtgttggtcttgtcgcccaggtgggagtgcagtggcacgatctcggctcactgcaacctctgcctcccaggttcaagcgattctcctgcctcagcctcctgagtagctggaattactggtgcccactatcacaccctgctaatttttgtatttttagtagagacagggtttcaccatgttggccaggctggtctcgaactcctggcctcgtggtccaccggcctccttaagtgctgggattacaggcgtgaaccactgcgcccggccactaatctctcctattgctttcctattctctatttcagttaacactgttctaatctttattatttccttccttctgctagctttgcatttagttcttctttatctagttatttcactttaaagttaggaaactcactaattttggtattaacttctttatcagatattttagaattagacctatcgatcatgtcatactttcctcagattcataactgcatgatataataatcctgtgtattcgagtcaaaagacacagggactctaaagcaagttcttcatgctctgaaagcatattattctttccttttgtctttatgtgtcctagaagtcattagacacaaaacatggagtttcaaggttactgttagagaacatatcgtgagtctaatggttaattacttccatattatctaagttttacaaacctctgatgtattcttcctttggttttattgttccaagcttcacatctgggcttctcacaatgcctgatttttatagaaagaacacagtcatataataaaaaacactgatgtcagcacactgacattcaacccagtgttttatctggggctctgcttcaggccactgttgctgaatgctgtggactccattctccaagtgcacgtatttgttttgtgctttaaaatagctaaattattatatataactacaacatagaacttttaaaaattctgtaactcaggattttcacaattcaggttgagtccctctatccagtccaaattcatccaaattttactgactagccctcaaacctgagaaatagaaatgcctcctaacagacacaggccgtccgaaggtcaatcaaatcccatgggaatatgacaaaaagcacctttctctgacaagagagagccagtaattaaggtctcagccttgttcccctcatctctgcttggatcagaattcagtttttcaaataatgccctataaatgttaagccaaaaacataggcaacactctaccggggtcagtaccaggacaaagaacatcacattttatggaatctatctttacaatcgtatttttatgcaaaaaaactcaatgactactgtagctgggacacctcacagttgttcctgctacattcattttcatccttttgacttttataggcagattttttttgagaatttttaaaaattatatataaagacatttttaggaaatctgagctggtgtcctcctttcattccttagaaccagacaagaaggcaggaacagtgaagacaaaatacaatgcgcaagagcaggggcaggcaactgttttctgtaaagggcagccttcacaggccaaaccatctctaccgaaactactcagctctgctgctgtaacaatagacaagacatgatacatacaagaacggcatggctcattctggcacccaggcttatagtttgcctgctcctggccaacaacaaagatatggagtctgatgcccaagtttgaatactaactctgttttttactagctgtattaacactggcaagttatttaatgtttctagtggagtctgatgcccatgtttgaatactaactccgttttttactagctgtattaacactggcaggttatttaatgtctctagtggagtctgatgcccatgtttgaatactaactctgtttttcactagccgtgttaacactggcaagttatttaatgtttctagtggagtctgatgcccatgtttgaatactaactgttttttcactagccgtattaacactggcaagttatttaatgcctctagtggagtctgatgcccatgtttgaatactaactctgttttttactagctgtattaacactggcaagttatttaatgtctctagtggagtctgatgcccatgtttgaatactaactctgttttttcactagccgtattaacactggcaagttatttaatgcctctagtggagtctgatgcccatgtttgaatactaactctgttttttactagccgtattaacactggcaagttatttaatgtttctagtggagtctgatgcccatgtttgaatactaactctgtttttcactagtcgtattaacactggcaggttatttaatgtctgtagtggagtctgatgcccatgtttgaatactaactctgtttttcactagtcgtattaacactggcaggttatttaatgtctgtagtggagtctgatgcccaagtttgaatactaactctgtttttcactagtcgtattaacactggcaggttatttaatgtctgtagtggagtctgatgcccatgtttgaatactaactctgttttttactaaccgtattaacactggcaagttatttaatgtttctagtggagtctgatgcccatgtttgaatactaactctgttttttcactagccgtattaacactggcaagttatttaatgcctctagtggagtctgatgcccatgtttgaatactaactccattttttcactacccgtattaacactggcaggttatttaatgtttctagtggagtctgatgcccatgtttgaatactaactctgttttttcactagctgtattaacactggcaggttatttaatgtctgtagtggagtctgatgcccatgtttgaatactaactctgttttttactagccgtattaacactggcaagttatttaatgtttctagtggagtctgatgcccatgtttgaacactaactccattttttcactacccgtattaacactggcaggttatttaatgtttctagtggagtctgatgcccacgtttgaatactaactctgtttttcactagccgtattaacactggcaggttatttaatgtctgtagtggagtctgatgcccatgtttgaatactaactctgttttttcactagccgtattaacactggcaagttacttaatgtttctagtggagtctgatgcccatgtttgaatactaactccgttttttcactagccgtattaacactggcaggttatttaatgtttctagtggagtctgatgcccatgtttgaatactaactccgttttttcactagccgtattaacactggcaggttatttaatgtctctaggtctcagtttcccatctgcaaaatgggggtaatgaaagtactaatctcatatgtctaatatggagatgtacatataagccagtatgtgtaaagtgattagcacatggtaaataatatgtttactacattaatatgtgagcaaatatacattaaaaaggtgttattttgtgaacttgtaaatagttgaaataatgcattcagcttaggcaaccttgtttcaaaaaaaaaaagtgcaaggtttcagaaaagaagatgtacaaatgaccaataagcctatatataaaacgctcaacatcatttatcaaggaaatgccaactaaaaccacaatataacgtccttgcacactgttacaatggctaaaattaaaaagagactacatcaaatgctggtgaaggtgcggagcaactgctgactggaatgcatcatcactttggaaaatagtttggctgtatcttattttaacatgtaaaaacaagcaaacaccaccaccaccaccaccaacaacaacaacaaaaatgctcttatatgacccagcaatctcactactggtatttatccaagggaaataaaccacatgtccacccaaagactcatacatgaatattcacagcagctttattcacaatacctaatcaggggagacaacacagatgttcatcagcaggtgaatggataaacaaattgtgttatcccaatacagaccaccgctcagtaataaagaggaacaaactactgacacaaacgacatggatgaacctcagaatcattatgctaagtgaaaagagtcagaccacagtctataacgtacagttccatttcttcaaaattcaaaacagacaaaagtcatctatagatacaaagcagatcagtggttgctgcagccagacgtgtaggaggattgataccaaagggacatatggcaacttttggggtcacggaaagttctgtatcttcattgccatgataatcatcgtatattatattcatggcatacatatttgttaatacccaaagtatatacttaaagtttatttaaataaaaaggtacaaagaaaacagaaatgaggaagggagtacaactgcaaacagccaactttaaaaggtgagtaaggagctcagcacagaccaaaccaacaactgggattttcaatgcctcaggtcggcctggaggcccacaagtgctgtgaatgtgaaacccaggaacaaatctcctgggttactctcatgtatgtcgatgtccctttccgtctcccctctgtttaagaaaaaaaaaaaagctgagaagacaaactttaagttggcccctcccctaagacacctagctacctccttggggtgtgcaggcctttgtacaatcccctcgccttgccccttatgtatgggcatgatctgtgacttgcttctaacagaatatggcaaaggtatatgtcactcctgccaattacatttcataaaactccatcttgccatcagatcttcactagaagctcttcttgctgacttaataaagtacatggtcatgtggggaaagccctacctgagaaggaactgtgggtggtctccaggaactgtgggtagacttcagccaagagccggcaagaagccagggccctgagtcctactgatgcaaggagataaattctttcagtggcccaagcgagctgggaagtggcttcttccccggatttccatacgagaacacagcccagctgacaccttgacgagagctttatgagaccctacatggaggatccaggtgtgtgtggacacctgacccacagaaaccatacgattaaaaaatatatgctgctttaggccacaaagtatgtgataattcattatacaaaataaaaaatataaacagaggagaagatacctaaatggttaaaaagaaaaaacaatacacccaataaagtcggcattttcagaacacaagcgctaggcagagctgcctgactgttgtcaggatcatgcagcaacttctttaacaagtcatgctgccctgtgttccttcctgacaccatgacaggagcaaccactcaagtccagcatcctctaggccctaaagtgctactacatgtgactcacagacttcacaacagttctaagagcactggagaacagtacctactgtcctttaaagccagggccttactcccttctgtggagacacacaccccttggctctaagtggccccagtggacatgacacaacaatcccaaagagccacttaagctacaatgtaagattgttgagaccagccgggcgcggtggctcacacctgtaatcccagcactctgggaggctgaggcgggtggatcacctgaggtcaggagttccagaccagcctggccaacatggcgaaaccccatctctactaaaaacacaaaaattagctgggcatggtggcgcgtgcctgtaatcccagctacttgggaggctgaggcaggagaatcacttgaacccgggaggcggaggttgcaatgagccaagatcatgtcattgcactccagcctggcgacagagtaagactccttctcaaaacaaaaacaaaaacaaaaaaaaagattgttgagaccaatggttatgtgcatggggttctactctacagctaaagaggaagtgggatgcaagacaaaggcagttatttaacctctataacatatttagcaggaagctcaaatatgcagactattgaacagggaagaatagagtagggagagaaaagacgatagtgtagtaccatggggaagaacagtccaagaagtgtgaattgctctgccagggacagccctgcctgtgacgcatcacacaacttctctataaaacaaggctttatgatccttaaggcgtcttccaggtctaagagtctatcattctacattatataaaaatctttagttgaacaattatagtatcttggggggaaagtgtactaaggcatcaagaaaacaattttatctgctaagagtacttactcgtagtaagtaagattagtatgcagaattctgagtttagcacacacgatgttcttaggatttgggagcctagtcttataaatgtgaatgccatacattaggttgcaaagaaaaggccattcatatccacgaagataacaaaggaatatatatagtagcatgaggtgattttatttaaagtttaatgtcctcaagtaatcattccatgctcagtttcttataactgtaacttggaaatattgacatttcatatgcaagctataactaaaactaacttttctttataaccagctaggaaaaaaataggcacaaagtattattttataaagtctaccaagtaacgaacatcaaagaaatgcacatgatatagtcaggctttttctagcacttgtcagtacaagccagttagtggagtaaatcggtttggctgaaagtcctatgctgccatgcgacagaaaagagagctaaactatccacattccatagtttaccttctgtcactaataatctccatcatctacttaaaaatcttagagaagctgggcacagtagctacttgggaggctgaggcaggaggattgcttgagcccaggcgttcgagtccagccagtgcaacacagtgaaatctccatttctctctttaaaagaatgttaaagacatctacctcaatttttggcaatctcctactgtagcttgaaatgttaaagcttacatttagactgtgcatgtcagtttctattatcattccactttacagagaattaaaaaaacactgtgcttgcaacttaaactggtattaaactgacccctgctggcctcatcttttctgtttctgcatttatcagatgcttcaagagctaactgcattctatagttcaacctatatttgatcaggctgccacctcaaaaacaaaacgtgggacaaagatggctagttgtaccaaattccaaatggaaggatgccttcctcagacctttgtctattttatttgcaaaaacctagcaattaaaatcacactaatattccaaagaagtatctcctatagcctatgaatttattctaaaacctaatgcactcaatagacatttacagatttctcaaagactgccgggaaataaagatttttctaatcacagcacctgccctccaggtacttacaggcatttatgagtcattgaaaagatacatctgagaattcaattctagcatatcattggacaccacacaggtgagaaggaagtggggtccccattcagcccgtggtagagcctgcctcactggtgccaggtcacttgagattcgttactgaaatggcccaggacaatgtgttctcttccttctttgtgaactcactgtgctttatgaattataatggctgccattgattggcaacctactatgtgccagagactactacagttaggtgctttccacacactatcacatttaccctactcagtaactctgtgagataggtgattttatgctcaagcttgtatcatgggtgagtaaagctctgtgagaatactgatcatatcataccgcaatgtttttcctttaaagagatgtttctcctctaaacaacagcaaacaccttaagcacaggaaattacgttattgtcatctctgtatcctcagaacctcatatacctcagtaaaggcacatagtaggcactctaaaaacatctgcaaaacatacaaatgaaaatattattgaaagaatgtagctactaaatacatactatgggcataacctatgcttaggcactgagaaaacagtggaggaaaagaaagaagaggcaaaggctttgattcctgagcacagacacccatacgtgactatggaaagaaaaggagaagttccaagacataagtaaacagaatgctatgtcaatacagctcatactaccagtcagctcaaaatcaaacagaaaaaggactcctaaatcagaggacaatgacacactggtgctgggctattggaaatgaaacctattaaagaggaaaaaagagagaggaggtagaatgtcattaaattcctttctgtttttgtaacatatctacaagaccaaatgatgtgaaaaatagttctgcaagacggggactatgtgaatccagttttaaaggtccaaatatgtatactttacttatatagatcatggcatagtaggaaagacagaagatcataaaaacaaatataatgtagaggtctaaaaattgtttcctggtcaggtgcagtggttcatgcccgtaatcctagcactttgggaggccaagccaggaggactgcttgagcccaggagtttgagaccagcctgggcaacatggcaagaccctcatctctacaaaaaaaaaaaaaaaaaaaaaaaaaaaaaaaaaaagcaaaaaaattagctgggggtggtgttgcccacctgtaggcccagctactcaaaaggctgagatggaaggatcgcttgatcccaggaggtcggggctgcagtgagctgtgggccaaggtggcgtcactgtgctgcagcctaggcaacagggcaagaccctgtctcaaaaaaattaataataattttaaaaaataaaattatttgttccaaaaaaaaaaagctgcatgtatttttcttttcttttgcttacctatcattatttttccacatctcttttcttggtacttcagacagatgaagataaatgaagcacagtagttaacttctttgtttggatacaaaaaatcttctgtatcaacaatattgttatgcaagcactttaaatgttgcttctagcagatgagacttctgcttcaacatatgttatggggaaaaatgataaaaatttattcatgactagaataactgaacagtcaacaaaatctaactagaaaatgtaataaatcaacctggtttgttgcagttgttaattatctaaagtaaactgaagatccagtctctcactccaaacaagaataaataatcccagattctcagcactgtcaatactttctatatcatcctaccactgctgcaaacttcttccttcagagtgatcggaatttaacttcctctgcctgcaccttccctgagacaggaaaagccacaaaagaaataaggagctctaaaggttcttctgctcaacaatggcaccttaaaaatctaaaacttactgagggagcatgtaaccccccatagaaaataaaacagtggtcaagcttttgggatctggactcagggtggcttgggttcacaccacagttctacaaatgtaatcttgggcatgtcatctactttcctaagccagagataataacattgccaagagtgtaacagtgagtgatcatatgcacagagcttagcattttacctggaacctatgtgtttcatgagcatgagctattgccattattacatcccctttgctacatccctcccaaagtcctaccatcgactcgcaatctgaacaaagagaaaggacctcaaaatccttactctggctaaactgggctttaaatgtgtcagatgtgtccatcttgctttccttcctcaccacccctgcctgccaataatcagagccatggaaaagcttcccttgctcatgcataaataacgtcctcattcatatatacctgtgtatgtttaattacagtaactagaggtctcaaaataactcatatggttctaatttcaaatatttaaagctcttaatgacacttgcttctgtgagaccagaagaaatataattgccacagcgataacatctaaagcccaagatcatttctcccagaacttatagcactcacagaaatcgaccaggatctgcttgcagtatcttttagaatttctgtctcccactgacacaaccgagtcataaacaaaaactgcagcacttgccagctttcacagcccatgacaactgtgagttacacacaaccttcaggtacaccattcaccctaataactgatttcaaaataacaaaaggaagtcaagcatttaaatgtagcacattaatatttgactaaaatagcatatcaaccagtagaaaaatcaaacaaggtaaattactcatgaaagaagaactacatgaatttctcagaaacgaagtcttgctggagaggtacatgccatgtcacttgcaaccaaaagtacttcctcagagccaatatcaaaagcaccggtgagtatgctgcaaaacggcatagcaggctgtcagatgctgcatatcagctacttgagcagttagattaagctttcccaacaggcaagtgctgcagtacttctgcatctagcatctggtaatgtgttgcaaacgcagaacaaagaaagcagcaggctccgaaatctttcagctttcctttgaccatctgcagcacttaaacacttcagggttaccaggtcagcaacgtgaattctctcaataccatgaaacatgagcaaaatttccattctctgaggtttctaattcttttctttttcttttttttttttttgagacggagtctcactctttcgcccagaccagactgcagtggcttgatctcggctcactgcaagctccgcctcctgggttcacgccattctcctgcctcagcctcctgagtagctgggactacaggcacccgccaccacacccggctaattttttgtatttttagtagagacggggtttcaccatgttagccaagatggtctcgatctcctgacctcgtgatccgcccacctcagcctcccaaagtgctgggattacaggcatgagccaccgcgcccagcctctaattcttttatttttctttactttttctgattgtattgagataatcaaatgatttttctccttaagggagtatggtaaattgtattaataggtttctaatgtgaaaccagccttacattattggaagaaaacacaatctggtcatgttgcttttaaattatttgctggattcaggttgctaatattttatttaggattttaaaaactcatgtttactagtgatattgactagtaactgcctttccttttttttttttatttccataggtttttggggaacaggtggtatttggttacatgagtaagttctttagcggtgatttgcgagattttgatgcacccatcacccgagcaatatacactgaaccgaatttgtggtcttttatccctcacctccctccaccctgtcccccaggtccccaaagtccattgtattattcttatgcctttgcaccctcatagcttagctctcacttatgagtgagaacacacaatgtttggttttccattcctcagttacttcacttagaacaacagtctccagttgcatccaggttgctgcaaatgccattaattcattcctttctatggctgagtaatattccatcatgtatatataccacaatttctttatccactcattgactgatgggcatttgggctggttccatatttttgcaattgtgaactctgctggtacaaacatgcgagtgcaagccacatgcaggagaataactggatcctcacctctcaccttatacaaaaatcaactcaagatggattaaggacttaaatctaagacctgaaactataaaaatgctacaaaaaaaaaaattggaaaaacccttctagacactggcttaggcaaagacttcatgaccaagaacccaaaagcaaatgcaacaaaaacaaagataaatagatgggacttaattaaattaaagagttttggcatggcaaaaggaacagtcagcagagtaaacagacaacccacagaatgggagaaaatcttcacaatctatacatccaacaaaggactaatatccagaatctacaagaaactcaaacaaattagcaagaaaaaaacaatctcaccaaaaagtgggctaaggatacgaatagacaattctcaaaagaagatataaatggccagcaaacatatgaaaaaatgcacaacctcactaatgatcagggaaacaaaaatcaaaatcacaatgcaataccacctttctcccgcaagaatggccataaccaaaaaaatttaaaaaaaatagaagttggcatggatgctgtgaaaagggaacacttctacactgctggtgggaatgtaaaccagtacaaccactatggaaaacagtgtggagattccttaaagaactaaagtagaactaccatccagcaatcccactactcggtatctacccagaggaaaagaagtcattatatgagaaagacacttgaggtttctgattctaaagtaaaacctccatcccacaaaaagcttaataaaggataataacaaaaccttgctttgccagcacttttgtttaaatttttgtttttaagttccaggatacatgcgcaggatgtgcagatttgttacataggtaaacacagcactttttttttaatctgacaaatcacaaatcaccacacagctcccatcaatgcctcttaaaaacaaatattttccactgtcttagggaagtcccaatttctttaaaattcatcatacaaattatttcctcaagttttcactcaatgaaaattcctgagtataacacaagactgacattagttctgtactcaaactctcagaaaattagtgctagttttctacagactccctgaaggtctttttaaaaatttttagaaatttgtatgtagtaatgacttgccaatataaatgtaatacagagacactgtttttgttcatctttgtatatccacctagtatagggcatggcacataccagacactcaatatttattaactaaagagtacgtaggtctgctgcctctcaaatatttgataatcagacttttgaattctaaatttcaagtggagaaattttctccattgaccatcattataaaactgtagtggtatatctttggaaaatatatgacctcaagatataataaaaaaatctttttttttgtttttttttttgagacagtcttgctctatcatccatgttggagtgcagtgacggaatctcggctattgcaacctccgccccctaggttcaagcagttctcatgtctcagcctcccgagtagctgggattacagttgtgcgccaccaggaccggctaattttttgtatttttagtaaagacagggtttcaccatgttggccaggctggtcttgatcccctggcatcaaatgatccacttgcctcggcctcccaaagtgcaaggattataggcgtgagccacagtgcccagcctaaaataacattttaaaaaacaacaatcattttagaatttcatgaatatcaattgatcagaaaacattagtgaaagtccagagttgttttaaacttagaaaatattttctaatatatatagttttcggaataataattaggtcaatgagctaaagatttccttttacagtttcattacaaatttaaaaagcttttgtagtaaaaacccatgaatgtaatcactatttaatagtttatgttttctaaaaatgtgtttggcattccatctgttaagttaggactccagaagaacttaccgctatgtccaaactgggttggagggggacaagctgggtttaaattgcgtttctttcacttgctaggtgaccttgggcaagtcatactaaacctcactttgcctattaccacatctctaagatggacatagaaataccaagttttgggaatactattcttgaagtatagtaattagatttgggggggttttgtgtggttccttacacctgaccctgtctctgttttggccaggggcatccatctgcctacgggatattcaggtttatggaaacaggaatacaaagagaaagactcagtgttcaattatgacacctataaatcaatattttcagtcaacaagcaaaattcttgacagccaagctttgtcaagagaaaatgtgctttctaaattcctaaaacactaatttttaaaatgagggctgaaaacggaatgagaagctcaccttgcttccatgagcacagctgcagggtagaaccacctaggaaggccttggaacgttacacggcctggggcccccacccccagacacttagattggtctgggctcaggaactcaagcattggcaagtttttgaaatgccatcaggtaattctttttttttttttttttttttttttttttgagatggagtttcactctgtcacccaggctggagtacagtggtgcaatctcagctcactgcaacctccacctcccaagttcaagcgattcttctgcctcagcctcctaagtagctggaattacaggtgtgtaccaccacgcctggctaattgttgtattttcagtagagacggggtttcaccatgttggtcaggctggtcttgaactccgccatcaggtaattcaaatgtgcagcctggatttagaaccgtagctccacagagaagcttctggtttggttcaaaactacgatccacacacaacaggagggaaaacccagaagtggcctcctggtcccctacagccccatgcgtatgttatgcagtggatcctgagctttcctgtgacccagtgggggtaatgcagagactaagactccccagagtggagagatggcaagaataaaagctaaggctagtccaggcacaagactagataaaccaaccacctggggcagaagagaatcaggaccagtctgcagtcttgctcccattgccatggaaggacaaggaggggaaaatgcaaagaattgagcatttatctgaaaaaaagacaagctacccaaggactttaaactacaagaaacagaagcaccattaaggggtaagtttgtccaatcatgtacattccttacttaactgcttccccagatgggctgaggtaagaaaatgtagttcaattataaaatatttaaaagcctggccaggcacggtgactcacgcctgtaatcccagcactttgggagactgagttgtgtggatcacctgaaggtcaggaacttgagaccagcttggccaacatggtgaaaccctgtctctactaaaaatacaaaaaattagctgggtgtggtggcgggcacctgtaatcccagctacttgggagggtgaggcaggagaatcgcttgaacccaggaggcggaggttgcagtgagccaagattgcgccactgcactccagcctgggcaacaaaagcaaaacttcgtctcaaaagaaaataataatcttaaaaagcgattgttaattaaaattatccaaaacatgaaaaaagaaaaagattagggagctgtgtggccttctcatattactctagagcactgtttcacagcttcacccaaggattatttaattccctagaagaatgccaatgcatttgactttgttacttgctgttagagcacagatagtgtgaaactacaacgttagcttatagatttctgtccagcagaaaggataactctaaaaactgtggttttagtgcatgcagaacgtcaccagttttgtctccaatctagcaatcttattctaatgcctaaagatcagttccttcagtactctggacctgcattaactctgcctggtttcctcattaataagttaatacatctttggcatttcgttttgtatttctgtgagagtcaggttttaacttttcaaaaaatttactttgatagtatattttctttgcatgactggtagtgtatgtaaatctaccactcactgacactgatctcagtggacattttataagataattcgactgcttggtgcagtgcatggcacttggtaaatgctcagtaaatgttactgttcgtgggtgctagtggctagaggagattttacctgcatctaacagtaaccatgaactcaccaatggaggtccacaaccataatccagggcaaccccgggtaagtggatacacagacttcctcagtagggactattcccatatatcataaatatagggagccactctgctcaaaataattcccaaactatcaacacagacagtacgactcacttgtatatatttatcacgagtgtgtgggcctgtgaggaaaaaactatcataacttagcaaaatcagaaagtacacagatctaaaagaagccatctccttggcgaccaaaagtatgctgctccatacttaaaggaatcttcaaatgatgttcaaatatatgatgacaggagaaacagcaacacagcaaaataactacattagcatatgaagagaggaaattggactggggaagacctgagagttttccagcaaaaactggagaaaagggaactaaaccatctacattccatagttcatcttctgtcactaatagtgattattatccactaaactatctaaacttttggccaatttctactgtcgcttgaaattttaaaagcttctttttggactgttcatttcagttactgttctcatttcactagacaagagaagccctgaaaaccctagtaaagctatcagggaagagatatatggttaatttcttaaattatgaactccttaagtatgacttctctacaaaaagtttcttcatcaatgaagtgcacctgtaaaaaccattccttgtctaaccttgaaattggcctgtaacttcaaggcttaactttcgagtgtgagagtttcagacacatcaacatattttcaaggccataaacactgggtaatttttcatgctcaagtgtctggagtttcgttttcctaatatcaataagcaatatcacaactagcaaggcagaaggaataaaagcacctcagcctctcacaatgaactgaaaaaccctatattctttccttttttttccttcacatcccatttcttttaccttgcccagctggtggaaaaaaatctagcttccttctgaactaaacacacataattaaatacacacaatcttaatttaccacactgatgtcttcatcatcagctaccctagcaccatttcaaagcagcagaaagaaatataataatttataagccagctcctgaggttatatatttattttaaaacatgccagtttcaacaatataaaatgctttcccatgtttaaaaaacaagactatttgttaccttgtgatgggacaattaaacaagcttttaagcgtgataaaaaaaaaaatacataggttaataaagtagtcttgataaaaacaaagcaaagatttgaaaacattggtatttccataacctacagaatactgatgactagatggtcaagacaagcatcagttacaaattatgtatacagcttgctaacaaattagggaaacgttcccctctggtttctttcccgactacttgtaaaataatattcgcatacaaatttgcaattcaaatttgatgtcttatgagtgcattttgcagatcatgctctgagaaggaagagagtgagctaagagttgcatggaaagtataatttgctgctggcttttagccagaaacactagaccaaatgtttatggagaccacgaggcacctaagcaagcccagtgcatctggacttctcaatactagttgttgctatttatttatatgttaacctccaaataaaaggtcaaatagagtaatatctacattacacattcatacattttaaaatatatttattttacttacacagtacaggaaaggaagtgatttgccgtcactttgagaacacttgcaatagcaatgacaagaaaaaccagtaatttaagcaacactaataaccatatgtctggacctatgttcaactgtaatttacacattaagtataagcttttattttcatacttgagaaaacatgccaggtattcagtatttataatcatagttaacttgcagaatgaggaagctaattacagtagaaagaagaaaatattagccttgggaaaatatgaatttgacgatcacacaggtaggtagtaaaggagccatttctacctcccatgaccaatgcaatacaccagcatcttagacttactatccaacacaccagcatcttagacttactatccaatacaccagcatcttagacttactatccaacacaccagcatcttagacttactatccaacacaccagcatcttagacttactatccaacacaccagtaccttagacttactatccaacacaccagtacattagacttactatccaacacaccagcatcttagacttactatccaacacacaagcatcttagacttactatccaacacaccagcatcttagacttactatccaacacaccagcatcttagacttactatccaacacaccagcatcttagacttactatccaacacaccagcatcttagacttactatccaaaacaccagtgccttagacttactatccaacacaccagtaccttagacttactatccaacacaccagcatcttagacttactatccaatacaccagtacattagacttactatccaacacaccagcatcttagacttactatcctacacaccagcatcttagacttactatccaacacaccagtaccttagacttactatccaacacaccagcatcttagacttactatccaatacaccagtaccttagacttactatccaatacaccagtatcttagacttactatcactgtcaagtattaaagcagatatgatcactatatggataaatatattgctaataaaaatccactccaacataccagtcactccagcacagcacaatataaattttgtagggatatgctgcagtaaaccatgtgacacagtaaaaggaatgacacattacaagcttcccttaaacagaagaccatgaacacgtattgccaacctattacttgagagcatttgggggcaaaagagtcatgctgaaattggagtctctgcaaaaggaacacaaagggctgagcaaacaacaggaagcttaggcagggagcatggcagacactgaaaaaacataaggaaagggtcaacatatagccatgttcaagaacataattttagttaatgctaagtattaagactgaaaactgaaacatgggttgggaaaaattgctgatgaaatcaaggaagatcacaaagaatcattccaaaccaccatatttggtgggtaaatgtatctgtactgtaaaaacactgtaccataaaaaacaacaactagatcatgtatgatgctattccatacatggtggtaattatgaggccaatttgcatctcctcaccgagaaaggattgtgaatccccaaactacatcatatcaccccctaaagaatgttatgggtccctgacctagtggatgatctctccctctctccatgaggccccagcactgacagatatcttctgaactatatttggtcatgtagtctgaacaacaaatcattcgcttgctacctcatctacatgtattatgtacttggatgttttgctggcaccctagagatctggagcttttagaaggctactttaccataggtgtggtaagtgtgatcaatatatacctttaattaaactgtaacttattttaagccagtatcagaaggcaagttaaaaaattagaggactgtaacttctaagtagtataacacgcacattagcattcacccacgtgcttccacttttgcagacatggagcaaaagcagccctcctgctagtgagactactccaagaaaacccctcccccggcacagtggaaaaacccacgacagtctcagaagaagagcgtctatcccaggattcaaggttaattcctttgctctcaccttctcagaaatatcacttcatcattaataacccttttgcccacttatctttaaatcttcatctttgctggctcacacattcaaatctcttcaaaacaaaaaaacagaaccaaaaactccacactcctaattagtgccctattcttttcttctattcacagtcaggtttctcaaaatgatcaagcactcatgactctaaggtgctctagcaaagctcaccaaaggattccctattattgaactcaatgaaccttttcagtcctcacgttaactgacgtctctgcagcacttgaagctgttgacctccatgaagtgctttttctcccttggtttctatgatatctttctctccaggttttcctcccactttactccctctcagtcgcctttgctggcttctctttttcagcttgccccttaaatgttcctgttccaaagtgttccatccatgctgctcctattttcttttctacctaccctctccctacattccttccacctccacagcattagccatcatctgtatactctagagaatgtcttcctcatttctaaataccggcgtccccagcacatagcactcactcagtaaggtcagatgaaagcctgatgaatgatagacaattacagaagcaaccagggcccactatgttgcagagttagctttagcaaattctaatttcttgaccagattaaatctatctacaaatggtcagtcttactgagggctgactaccattgcctgtaagtgttcagctaagtgttcatttagtcaacaaatatgcagtgcctgctatgtgtcagcacagtgcctactatgtgccagctacatgataggccaaagaattcgtggagaaagccctgaaaatagaaacagacaactctttctgagtccatgtatacatctgtgtgtgatctgggcaaaccaattaagcttcctttttttttttaagacagagtcttactctgttgcccatgttggcgtgcagtggtgcaatctcggctcactgcaacctccacctcccaggttcacatgattctcctgcctcagtctcccaagtaactggaattacaggcacccaccacctcgcccagctaatttttgtatttttagtagagacatggtttcaccatgttggccaagctggtctggaactcctgacctcaagtgatctgcccacctcagcctcccaaagtgttgggattacaggcatgagccatcgtgcccgacccaattagcctttctgcctacaaatgtcttcatatataaggtgagaataatatatctattttacagggttactgtggaggttacatgagataatacataaatctaatatgttgcatattacttatgtctgttattcactgtgaataatatgtaataataaatattttatgtactcctttgttaaaacaagcttataagacaagttaaggcaggaattagtattcccactcagaatactaattctattagtattctaatagcagcaccagaacctaagcaatctccccaagcccactcacgcagtccctaggtggtaacgttctttagtgtcagagaccaaactgtgattctctttacttagtatctcttacagatcccactgctgcccagcagcataaaagatcctacccagaaaagggtctacagttgagaagccaaaggtcctaagatagtagccgaggagttgatgagcaaacaaagtgtttgttttcttaataaagaaaaacagttttctgcttggacacagtgtaattccaactataagaggcagcataatgttttcagtcagggaaaggtctccaatttcataagttttgatttaacaagaagattctaatattaaaaactgtcaggttgccacggtaacaatctatttgcaatcaagatgctggtggtattctgttatatttctctcaaggaaaaagtaaactagatgtagccaaggaatttaataaaagtatctgttggaccaaaaccaagatatgactgtttttaggcaatatgacaggatttaaatatacagcaagagaccctcaggttacaataccagttccatcaataaaattaaaagattttgaccttgacaccagtacaagctatagccatatgatctggaaatctgaatcctctgagcaagaaaaataaatcgttaaacaattgagatgacaggcatgggacaagaaagtcaaaattcatcagaaggagaacaaaatcaatccccaagggaggtatgaattataaagactaaatttctcacagaaaattcaaaggtttgatttgggtgttttgttctgctgttgtatgtatgcatgtatgcatgcggaggtaggttttgcactccaggacattcttggatgtttttaacttgctgctttcatctagaaaatgttagaaggacatattgaaaatgaactgattctagacaggagaggaaggaagtgactgtcaggaattaggccgctctgagtctggacatgcagactatgcagacagagaaacttcctccacaaccaccgaagcctcagtcacgcccatgaaaatcacatggattttctctacagttaagacttttcaagtacttgtttctacaacgattcaagaaatggtaacacttgcccccacaactttagccatgaacaactcatttctcttcaatgtgttaataactttacagaactgtatatgcatgctgaatgtctagaatgacaaccagaataaaaactgcaactcctttggcttcgacaataaattggcttcacaagaaaatacctacattcatgacagaagaaactggctcttgccttaacctatatagttaatgcagatttatatataaataacattatatactttttagaacatatatttttataaatgtatatttatatacaaaataactaaattattttctgaaacagccttgaacattgtgtgtaatctcattttctgtaagtcattttccttctactttctctataaaattggagcactgtcctctacccctccgaaaagacatttgttaaaatcacagtgaaggttcagcataccttagaaaatcagacattttaaattctatgaagttcagacaaaatattaatacaatatgatattcctatttaaataaactcctatttaagtgattaatgaatcatttatgtattattgtactatacttagtacagataacatatttttgttgagatagcgttcttaaagatcacagagattctgaaaatgcttctaggttgaggaacttaggtagaggaagctaacaatcgatgaatacaataaaggaaactcatgagtgatagagatttgaggaaagtgctagataatcatccagactttaaatagtttgggcaatgattcagggacataaatggccagcagttagaaatagagttggaactcaggagggggctctgacacagagacaaaaatttactcattcacaattaagtaatagttgaatctatttagaaaaacaatgtgaaaaagaaagtaagaaagagaaacaaggaccatctttgagagatgccaacatttaaagatccatggaggtgaaacaaacaaggtgacagaggtatcttcaaagtcataaaagaggagtttcattaaggaaacagtcaacaatatatgcctcagaggagtcaaacaggacacagaaagagaacaaaatactgtattcaacatttaggatgtaactagttacgtgagtgaattcacttcagtacggtagtagaggcagcagctagcctacaatgggttaatgagttagcagggaaacaacgcatccaagaatttgtcttatattctaagatcaagaaccctcaacgaacaaaggtaagtgattcaggcttacatcataacccttcctaagttaaaaggacaagagcatttgttcaataaggacagaacctgaaattactggcttgtaatgaaaacgtttttaaccctaaacaagaataaatttcttgactagaatatttttctgatgcatcaaatgtcaaatattcaattattctgatgtataaataccagagattcactgtattgaccagagaatgctatgaatctacccaagattcacaatacttttcaattaaattaagcaatttttccttctaagacttccatttcagttctaaatatgtgttatctccattcatccttgtctcataggacaatgatcttcatattttagaggtagacagctttactctttggtttctgttaacaggacatcttgaatttaattgccaatgttatttatgaattataactgtaagagtgcttttcagtatgatgaatattccatcatctttaatttttatgagatgcttaaaatgaagggggatgggacagtctagctgctcttttcctctcttgctacaccctcttctggaaagacaataaacaacataagctttttcctttgtctatataaacctgcaggttcacagacagtgccacttgtcaacagctaaagagaaataagaaaagaacttcagaaggggaaacattcataaagagcaagagcacactgaggtaaaaaaataataataataaatagaagctattacagcaggaaaaaaagaataaaacataagtgcatactaatatcaagaactacaaaggtggcaaattgaaataatctaaatactgaatattaatttttttctatgaccaaaatcatattaaagcttacaaacccaacctaatgcctaatgaactcatttaagttcaaagtacatgaatgtaaaagaaagctgaatataaagaggctatcttgtgttttcaatacaatttaagtgttattataggagctgccacatttgttcccaagtatcccttcataaaatatcagagacaagatggaggttttgtactaataaagtaaaaggtatacttccaccaggtaaaaactttctggacctaacagctttaaaaataagattgtaccaaaagctatctttatataatgatgatgactggaccatcaagaatatgcaacactccctgtatattatacttcatcatataaagaaggaacagctctacttttaaaagccagagaaaatgtctaggtctgcctagaactgtcatggccttaaaaatttcatggggaaaaaaaagagtcaaagtctcatggttttattatgcaaaacttcatgatttcaaacccaccagaatcaaataactaaaaaatgaaaatgaaaattacaaagaggcattacttatatcacttttaagattggcaaggatgaaaaagagtaacagtatcccgtactagcaaggctgtgagtaagcaagcagtgttcttgtatagggttggtggagtgtaaatgcaatatatattagagcacaacctggcaacatatataaaaatgtaaaatctgtttctgcaacttcatttctactaatttatcctatgtaaaaaccagtttcatatgcaaagatagatgtatactgatgttccctacagtggaaaaaaatggaaatacttcaatagcgtactggttcattaaattttaatgttacatgcagccaacaagtgtatgaaaaaaagctcaacatcactgatcattagagaaatgcaaagcaaaaccacaaagagataccatctcatagcagtcagaatggctattattaaaaactcaaaaaataacatgttggtgaggttgcagagaaaaaggaacgcttacaaactgttggtcggagtgtaggttagttcaaccattgtggaaaacagtgtggcgattcatcaaagacccacaaacagagccaccatttgacccagcaatcccattactgacacatacccaaaggaatataaatcatttatcatgaagacacatgcacatctatgttcatcgcagcactattcacaatagaaaaagcatggacaccctaaatgcccatcaatggtagactgaatttttaaaatgtggtacatatgcactggggaatactaagcagccataaaaaaggagatggtatcctttgcaagaacatggatggaactggaggtcattatccttagtaaactaacatagaatagaaaaccaaacaccgcatgttctcacttgtaagggagggctacataatgagaacacatggacacacggagaggaacaacagacactggggcgcacttgaaggtggaggatgggaggagggagaggatcaggaaaaacgactactgggtactaggctgaaaaatgactactaggtactaggcttaacacctggtgacaaaataatctgtacgacaaaccctcatgatacgagtttacctataaaacagtcctgcacatgtacccctgaacttaaaattaaagtttaaaaaaaaaaaaagttaacaaagtttaacatgttcatacaatggaatagtatacaaccattaaaaaattatacgtggtatgcatgtagctgtgtatatactaaataaagatataaatgtggacccaactgttaacagtgttggtctctaagaagtaaggtttctagggtacttggatttctcatttgtgcttttacttactttaacttttcataatgcacatagtttttttatagaccccaataaacatttcaaatgagtgataaaatgtattagcacagttgaaaatgcacatttgcatgtattatagacaatggcttttgttgtgttgaaggatcaaggggacttagatgtattaaaggtaatgtgatggctgtctatagtctgctgttgttattaccaaagagatttctaaaatacccaaaattgccttcttaggtgtacgggtgaggaaagcggccagcaatgtttaaagtattacctgaatgagaatgctattgatctttgtggtggtgtgggacgccaaggtatgaatctggaattttcaaatgcctctgtgctttccaggtactaaaaacatgaactctaaaattacagacacctaggttaaggatcagttctaccactgactagctatgtggctctgggcaagttccttcatcttcctaggcctcagtcttgtctcctggaatacagggataataatagtacgtacccccatagaactgttgtgaagatttaaaatataatatatgcaagccacagtgcctggaatacagccagtattcaatgttggctcttatccttctcaaagcacatcaagtttgctttttcattactgattacaaagacctcaggaaatcaaagtctggattttattgcaagcaaaatagaaacaagggatattaacttcagatcagataatagaaaacacccagcctgtcagtgaagttcattttctttctagaataatgctacccgtcctaagggtagttcagctttgtagagatagaagtcgtcactgattatcaataccaaccctctgactgtgtgaaaagtattaaaatactaccagtaccaaatgtgcacatggaagactaatgaagagcaaaacccaaatctgcctattaagcataaatgggaacttaagggaaaatctgaacaaagtctaatgaacaaataaaatataaatagacaatgaaaaaaatattgaaactagtccccaggacacttccaccattcgacagattcaaatcagcaaacatttattaagcaattcactgctctcaagaatgttcaattctcgtgcaggagccaagacaaaccaataagtaactgtgataaaagacaggatgagatgagtgctggaaaaattccataggtgcccgaaagggaggtagtacacttcctgcagggacaagggaaaacaataaagctacagtgggaatggttttcaggtatgagtacaaacaagatggccacaaattaagattgattcacctagcaagtctgaagtaatgagaatatgttttaataaactgcatgcacacattttatactgtctattgagagtctgttttataagaaatataatgttacgtgctataagggaacacaataacatttctgacatctcctaagctttacaatccagctggggagcaaattatgcatattgtattgtgaattccccaagggcaactgatgtgtcttttttatctttctattcccatcctcttgcacaatccctgcaacatcactggcactaaatgtctggcaaatgaataaataaataagtgactataatacaaagcagaatattatacgtgtcactgataatccgtattagagaagtttaagagagggacagaaagtaagcaaggaagctgcactatttctgtcatctagcactcactcctcatattcctctgaaaatcatcccttcctcattatctgtctctgtgattccttggaacagactcccagggaggacatgcgagctaaggcaagcacatagaaataccgcgtttccctggttatagcaattgcttcaagagtgcatacctgccccaagccccaccagtgaaatacaatcaccactaatcttggggattatgcttaagcaacaaaataataagttacttttcctgttgaatttggagctgagaggatgaaaacctagaacttttggccactgtcttgccaccctaagaagaaaggctatcagagaatcgaagcaactcacagaaggaaagcctagcaatggggggagaccagaccctaataatgttgtttgagcccctggccttagcaatgctaaaaggaagcatttttcagtcatagccaacaaattccttttgtgcttcattcaatgtgggctggatttttctgtcatgtgaaactgttttcatgaaaagactgaattagatttcatcactgaaaactgcagtgggtttttaaatacagaaggaattcaggtgaaaaaaactgtataaacaataagtgaagtaagaaaacagaagactacttctgttacaatgatttatatatatatatttcaagtttaagttcagatgaagactgaatagaatgggttagggttagctaagtaggctgagtatagcaaattggacagttcatgcttcacgaaggggtggctgctacccagctcaagaaaattactgcgatgtggaaactgacccaatatggccacaactcccaattttccaacaaaaagctcaatctagactttacaagaactggcaggagttaatagcaaaagaatgagtttatagcaacatacagaaccaataagcaagtctatgaggcaggatccagcagttagctttgtgactcagaggttacttaaatggccaagaaagtaaaatcaaatccatacaaaaggtatgtggacccaagtaaaggtttcctaaacaccacaaatatgtgggtcttctacggaacactatatgacaagagaaagaagagagaattgcggatatacagaaaaagcaatggaatgaatagctacagcactgagctcctaacacaacaatagctgaagagcagacagagtctatgctctcaagtcaggctgcctgagttcctacccaggctctcctactttgttgttctgtgactcctttgaccaagtgtcctcaagtataaaattctgctaataatagtgcctgcttcacagagttgctgtgaggagtgcatgagttgatacttattgtggttggcagaattttaaggtggccccaagattcctgcacccctggagtacacactctgtataataaatgagtgctgttttaagccactaagatcatacattcctccctcagtattgactctagcacccctgtggataccaaaatccacaggtgctcaagtcccttagattacatggcatactatgtgcatatagcctgtacctatcctcctgtatactttaaatctatacacttataatacctaatataatgtaaacactatataaattagttgttatactcttttttaaattttatattatttttattgtactgttatttttcatttcaaacatattttatttgtggtgattgaatctatgaagaacccaaagatacagatggctgactgtagtaatttattatgcagcaatagaaaaatgtgtacagcgataaagtacttagaacacagcttgacacataggaagccctcaataaatatcagctattattattggattctatttaagtgtacattctggtacatttaaaatagcattctaattacaaaaattcagtttgtccatatcatgtttgctagcacagaagatgcacaggcagacagatgcatcccagtgatacaaagaactagggcaggcaattgactaaaaaatactttctacaacacgtgtattgagagtgattttaaagtgattttgtagaaggaaactaattattgtgttcatctactttagactggaatccagttggaaataagttcaggatattcaatgatagtctactaacctaaaaacaaaatataacatcacaaagttatttgtaatacatattgggtcaacaaatacttagcagagaacaaagcataataattttactggtaaatgaaattatagttttatgtatgtgatagtattaaataaagatactatatttcagatgctcgtaactaagaaaacaagccataatacaaaatacatttgcatgaactcctatatagcacacgtacaaaacaaatagtataaatctgtataaagcaggcagcaaaatataatgaacttgaagtcattcccatggacatagccataatacatatagaaatttatttcagtttaaaaaactagttcaaagcacattgtaaaaataataaacatgaaagactttcaatgtaatgtgtacatatgccataaaagtacatatttctctgaacattagtaaatgaccagcaactgaaaatatgataaaaatagacttcaatgaatacataagcaggaaaaaaaatagagaggaaaaaggtatcataaagattttgatgtttagcctcaaagccaagtaaagcaagcccaaagcatgaaaatccacttactagcactgctagagtttggagttttctctttatcccaagcatttatcccattagccacacagtcaccattatctttaaaatacaccccctgcagcctaatcgctgtacaactcttgacattaagtttgaacttaatgttctgtcaatgcctctgctgctttctgagccataggctacaaattaataacttcatatgtaaagaggaaaagccccatgataaacctctgtgggctgcggcttgtttgtttttaaaaactaccaatgagacatgaaactttcatctttgttgagattttttatgttcctgcactccatcattaagagcagccttgcttgctacagcccaccaggaacaactaacatatacctgcttggtcttacaccctgcaacaggcacagaagatagaagctaaattctcatacgattacttggaataaggagcatgtgttactttacaatctattgcctaacataagtcccttttcctgaggttgccataagcttacatgagaaggtgtcctaaatctctcacagtaatgctgaatccgaaagggttcggagcactcattttgaggagcacagacctcattcagtgaaacaatgattaaagattctgtttcatattttattctaaaatcttacaagaagatacagaatcgcttccagaaaaatgttgaactccaacaacaatttaatagaattatagaaaatctcatttcaacacaagcctcagcagaagagcttccttgttatcttcaatgtaacacaaatcatctttttaacataaaatattaggaatcatgctaatttcacagctttgttacattagaaaaaaaagttaatggtcaattcaggctgcatccattttataatgtacagataaggggtattttctcataaatctgcttaaaaatgaatattaaagagggataacgtgacaccatgtcaaataaacaaataaggatgataaaggaaatatagctatttgaagaagattatttgaaataacacatgggcttccatagtcatatttagagaaacattctaactaaagtcagactttgtattaattaccacagaattcttaattacaaaatctaacatgaaggaataaaaaaacattttaaggttcctttcttcaaaaagtacacaaagttagcttgtcctacaattttcagtcattatcttatcttaataaatgagtatgatatttaacagcccaactctcctctttaatttgctcttgatgtctaatggcagcgttcaaccatgacaaagcaaaattactaaagttctcaccttcaagtttagaaagagctattgttgataggtgagccatgtactcacacaacttacagtggatttgctgaactctcttggtggcaccacaaaatatatttctgctcctgtcttcattacaaatcaaaattgaaggcttatacaaatttaagctgcattaaaaatattcaacaggatcccagcacattgggaggcggatcacttgaggtcaggagtttgagaccagccaggacaacatgacgaaatcctatctctactgaaaatacaaaaattagcagggcgtggtggcgcctgcctgtagtcccatagtcccagctacttgggaggctgaggcaggagaatcactcgagcccaggaggcagaggttgcaatgggcaaagattgtgccactgcactccagcatgggtgacagagcaagactccgtctcaaaaaaaaattcagcggggtgtatcttcaaactttgtgccattttttcccttgaaataaaaaaaaaattagaaactgggacagatatatttttcctatttgaatgctcatgaataaaactatattttatactctaaaattataataccttaacagcatggtggaaccactaacagatatggcttttcaatggatagtcactttagtactttagtataatacttaagagatcacacaatacataaaaataaacctctatctccaatttattatggtataagtattaccaaaattaaatttgtacaccacttttaaggtgtaatattgtaaaactctgcactacaaagaattaattgaagcaaactcgctcagataagatcattttgacctctgttcttcacgctagacattttcattacagaacaaaacagtcacaagtttactaatcctaaatgacttggcaaagccaatcctaatgacaaggattttgccgagtcatgtaggatttaagtgactctgtggttcctggtgagatacagtacttcaaaacacactggctgatcctcagaccaatgacctgacatcaagtcagatggaagtaactttgagtttcaaacataggggaggatgggtttttcttaagaatgaaaaaaaaaacaactcagcttttcattcagagcaatatattctgagaaacaacttatcattttggtaaaaacaggagaagcctaatcactcagcttctactctggagtataaaatagttttcacacttttagtccacatgaaaaatagctccgctgaatttctaattgctgtatttagtgctgaatttgtccttttatatattggccacctcctttttgaaactctcttcttttatagatctcaaaccacctgagatcccaaatcctgagtcaccttaagtggctctttctcttcatgtctttctaaaaatccttctcagtttattctgaaaagcagaaaacaaaaagcaaaataaacaaacaaaggcctacagccacgtttcccatttgaagaaccctgctctcataaattaggggattcttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcatgatccgcccgcctcggcctcccaaagtgctgggactacaggcgtgagccaccgcgcccggccaaattaggggattcttatcaggaagagaaagcagcacgaggagggctcacaaagggaagtgaggctcactagaacagccccaggcataaattgcaggggaaacctgaaatcaactgctcctaacccaaaacaggcacgtccgtcaagcatgaaccagcagcaagaagctccttggcatccagtcacaaggatctaatctcaactccaggtacctcggtagcctatttgcaatggtgactgttaaattctaggaagtcagcactgactcttccacctacagtatcttccattaaaggccaaatcaaatgatctccccactccaaatctccatcttaggtctccgcatcaccattatcgcagtctgctggagaatactgtgagcacctccatgtactgaacgtggaaagcaagatttacaaaaagaaggcagcacagttttgctttcaacgaatcttcaatataactatatttatttatatatttctttcatttatcctaccagacagggcggaaatgaagtcttaattatccttatttctccacatggtgctgtgaatagagtcagtacaaatttgttgaactgaaatttattaaactggttctttctgacctaaaagagccaagtaagaatcccactgctttgttttggccctatttgtccactttttcaatatgccatagaaataaaaggatgacaagtcaaaccaattttcccccacttctttactgcaaacaaataatactaaatattataataatataatactaaatatcacagtgatatagagaatgagggagagagtttcgtcccagaagaaggccctcctagccgactacaacagcaatctctagaaaaaccccctaccaaactgacaaattcaaaacagcaataccatatgatacttaagaggaagaatggttcacatttacaatttatgatagcacaaaggcactccagaattttatgttcagtgtactgaatagaaagcagctgttaggcaaagcatgattaaatgacttcaatatgggagaattaatcacattttcttatactcgggattctgctgtcactcaaaaataaagatggaaaggactgtaaggtcagtatttttaaaaacaacatcaaaatgggcacctaaactagtatccatctaaaaaatgtaaaatgactcacaggcctaagatagtaagattttattatccatctaaaaaatgtaaaattacttatgtgcctaagatagtaagattttattatccatctaaaaaatgaaaattacttatgtgcctaagatactaagattttaaaagcttatttgcactaaaagtttttaagaagcatccgttctgtattaatataattagtagaacatcaaaggtgcctccaaaaccaatatgtattttttaattgtgaaaaaaagtttaatactagcaatactaaaaaaaagttaaaaaaagcttaattgttaaaaaaaagtttaattctcatttaattttcatttcacagactaggctacaattctagcaaaacaatgcatttatcaaaatacatgatcacattatgccatggatgggaaaacagaaatataaaatacatgcagacaagaaaataaaagcaggcacttggattatcatactcctccagccagacgaaggtatagtgaactagagagttcaccacaaacaggaatagaataaccaaaaactccaatacatcaaacatgtcagaactgaatggctgcctgaaaatgaatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactgcaaatgagctttactttatggaataccagacactacatgaggaaatctaggtttttaagacagagcaatgagcttgccaaaataaatcttcttccacaaaaaggttcataatagaaccctgttaaactctaaattttcctagttaatataacctggtatattatttataaacattataagcaatgttttcaggaaaaaaatttgctgtacaatacagcactgaattctatgtttatcattttgctataaagataattagaagtaattagtaacttggcagctccaatgaacaagacctgcttttttcagaaaccattaatcctttgattcttcatagaggacaagagaaatcggaggcaagtctacctgaaaagagagaatgacacgaatagactggaagaaaagagctccaaaatgtctggaggtgagacactgacattcattttcagcagccattcaatcctgatggactggagcttttagctcttcccattagtgatgaaatggccagcttaagatactagcacctaactggaggagcaaaataatggaagttgctgccctttctcttacccacttatattttacacttctgctttcccattcctgtcctaatggacatgtctaagagagttgtgaaaggtttcctagaaaaggcaccatgtttaaacgaaatttgccaggcagagctgaagaaactgtacgagcaaagcttggaagaagaaaaggaatcctgagttttaggggaaaggacaaagagtaaggcttttttttttttttttttttttttctgagagggagtctacctctgtcacccaggctggagtgcagtggcgcgatcttggctcactgcaacctctgcctcccaagttcaagcaattctcctgtctcagtctcccgagtagctgggtctacaggcatgtgccaccacgcctggctgacttttgtatttttagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaataaactaaaagataatttttaactatacagaacataatgtcttgtttccacaaaatgctaaatactttgcaagattctccttgctgactctgaggtggcagaaagtgacaaatatcatccaaatcttactgatacaaggaaaatattttcagcacaaaaaaaatctttgtagcatcatcattgctctaaagaaaagctagaagcctgccataatgattagcaaactcatatagatatctccaggaaaggatttacaaaatgtcatcacatccttgtaatcatctaattatcaaactcagcagtgttgacaaagcacaagcccactcagctactgctaatgattattattcaaagctacatttctaccaaatcagaataacttacaggtagaagctcattagccttaggaaccaccctccttgaacactcacacgcacacgcacacgcgtgacacgcatacacacacgcgcacgcgcgcacacacacgcacacacaccccagccataactaggccttgctgaattgtcatttgctttcatgaccctccttcgtgtatatgagcagctttacgaattggttcaaaaatacccagcctttcaaaaataattccctatctagaaaaataccctacagacatctatatctagagaaataccctatggacattagtttgctaatgtcatagcaacagtgcggcaggcatcgtcaagctttggtggcttgaagaaacacactggcaatgcaacaatgggaaggagctaaaacgtaatgtaagtgacaatgcaacgtgaaggaatggaggcataaaggcaatgcaacaatgggaaggactgaaagcataatgcaagccatggaggaaaagcatacactcactgaatctccgcaatctacttgtcactacaccaggtgctaggaaaatggttacgaccctcaagctgcttgcagtctatgcaagcagtcagccagctccaggaacgtggcatgagatgaagcttgcagggtcctcaaatgccatacttaaaagccttgatttcatacaaaggcagtagggaatcaacagacatctttttgcaagagattaaatgatcaaatctgggttttttttcaattatctctaatggcaaaatataaaaatgaattgagactcagggaaacagtgagaggcaaggatatgagttagaggccatttaggtgagatcggaaggattttaataataactgggacagtgacaaaacaatataaaaataaaacaatagagtcaagagatctttaaaagcagcataagcagggcatacagaagtttgggggaagaatcagaggtattcctgatattcctggcacggctggctcaggagattgcaacgtcaagagagaagacagcaaaggtggagaagcagtatgctgtgcggaagaaaaggcagagtttaggcactgcacacgacgaatctgaagtaaaaccaggtcacatagatgaagatttttgttggtatatagaaaatatgggatgagctcagaaacacaggcaggcaagtaaagccatggcagcaccatattgtcattcaacaggtaaccagagacaaatcagcaaataacttttaaaacaaactggtgagacaggcagaaggacaatgatgagcaggttaaaagacttccgaaggttaaacactatcacacctcaaatctgcataccttgagatttaagtgggtattgttggttttggtttgtttgtttttcgtttttttgagaccgagtctcgctctattacccaggctgcaatgcagtggcacgttctcggctcactgcaacctctacctcccaggctcgagcgatcctcccacctcagcctcccaagtagctgggaccacaggcatgagccaccacaatttttgtattttttgtagagatgggttttgtcatgttgcccaggctggtctccaactcctgagctcaagcgatctgcccacctcggcctcccaaaggactgggattacatgtgtgagccactgcacctgggcaaagtgggtattgttccataaaatcttggccaaatgggaaacaagaaaacccacagtatagtcacttcttattacagaagacttttgaggcccccaaacaatataccttaccaacttctgctctaacctgaaagacccacagccactgaatgattgtgaaggaggaaaaacagaccctaggacaccaaccagcaagtcacacacgcctctgcagatgctgtattggctgaagaaaatgctgccacccatcggggaaggaaaggaaattctattaaggatatttttaattctgatcctaattcaggtgatcctaattaaacagctctgcataaacagtgtcttgataaatttttcctataagcatcaaaacgaaaaccaaatgtcaatcaaaacttgaaatagcgcccatgactgccaagtctggtcacatgtagctctaatgcttttcttttacttgacaagtatttattcaaaaacaacattttaaaattatttgcctatgtcattaatatcaagtataaatgttaaggtcaaataaatatcactaaaagaaaaagaggtgttaataaggccaaagagtattttcttatacactgcatatatagtttatagcatagaaaatgtttaaatctataaatgcatgtatctatagaatcatagggaaaagcacacccaataatggcttgaaaatgataaagactcaatctggagggctcctgaataattaatgttttaatatgcagtactaaaagattgtagaatgcagatttcaaaaggtaccttaactccatgcaaattccatgtcaattatctttattttcacatacagttgtggcaacatcagcacagaatcatttgacatgaataatccaccctcctcccactcaaactaccagcatttatttagatttgaatatatgaaggacagaggtatgtaaggcatgatgtaccacctggataaaaatagcagaaatcctgattaaataatttacagttttgcctagagcaatactttagtattagagaatattatcaaatattcttatttccatcattctggattttgctaaggcttataatggtccataattagggctctaacagagaactaatataacacagaatgcagtatggtggaatgcagaaaataagaactctggaatgaagaaagccatgttaaagctctgtctcttttacttaaatatagtgtgaccttacgcactttctcatctacaaaggcacgatacccataactcagagggctactatagaagataatgtgaaagtacacattaaagtacttggtagaataaaaaattaaaacaaaggagtgcggcactaggaaacttgtgatcaatccgccaattgtcccttgatctgttgatgtaagacaggtaccagtgtctaatactcatttgcttcctggaaagtatgggccaaaaaatgggaaatacaagacaaatccacatactcaaatatgtaatacagcagttctgtttataactgagttatctgaagggaaggcagacagctggtttgggaagccaaaatcatttaaacacggacatacagaatctctgaattgaaactcatcattagacaagctaatctagtttcaaatgtcgaacgatactattctgtaacttatttttaattttctgcctttacacagataggcttcaatataagaaacagatattgctgaaaggttgtctgtaatttaacttctgtttgctgtatcacattttcacttcaacttagcagctaagttcttgagcacttgggcatcaactaacagaaagggcattagacagaactcagaagacttcagttctagctttcttcctgtcactgggtgactacttccccctctctaagccacaactgatgtattctggagaaagggagaggagaaaaaatgggaaggctatggtatcagagagtttctgtgatctcttcagccctaaagttgtataattttattttgcttaaggaagaaaatggggacacatgacctattttcatgaaatttatagtctaagtgggaacctaagaaaaaaggacagacaacttagaaagtaggggatagtcacagttgtcaaatgcttggcatagaaaataacagtgactactgattttacaaaagggaaagctcaatcctaaccaagtagatttcaccaaagatctgagtagaaaccttaagaataagcaggacctcaatagagagggcgagggaagataaactacacccttccatgatgcaccagaaatatcacaaactcacaaattcaaagagcagtttacatatcatctaggcctaccttatagagacaacccatcctgacacgtaattctaatcctcagtgaaactcttccaggaagaagtagcttccagctgtaccaggacacgctgatacgttgttggaacgctctggttataaagctcttctagataataaaacagtatttttgtcctttcttcatcatgctttgtaaatagacatttatttgaatatgtctctttaaacatgtaacattaggtactaaacacagaaactgtaatgaaaatcaacttttgaagatagaaggaagactcttcctctttgattaagatgctttaaaagaatctggtttggcgaagccatccccaaactcgcctgcttacctttatgatataccaagtcatcttattttccacatcaaatggcaatgtctgatttttgcccctaaaaaaaacactctgtttctgcctattacaaaatttaatagagcagtttatcacagtttttcatcactcttaatattatatctctaaaacatatttgttttttcctcccatgaaaggtccttcttatttgcaatagaaacagccaaatcataatttaaagtttgagggcaataatccacaatctaagaaaaatcaaacaaaaactttgaacctgagttacataaccacaatatttctaatagaaaattttatctttatgtttcatttcaaaacaaaataacaaaatataacacctttaattaagaaccaaaagcatgatagcacatgtctgtagtctcagctactcaggagactgaggcaggaagattgcttgagcccaggagtttgaggtcagcctgggcaacatactaagaccctgtcttcatgggtttttttttttttttttgagagagtttcactcttgtcgcccaggctggagtgcaatggcacaatctcagctcgctgcaacctccccctcccaggttcaagggagtctcatgcctcagcattctgagtagctgggattacaggcatgagccaccacgcccagctaatttttgttgttttggttttttttttttttttttttgtagagacggagtttcaccatgttgcccaggatggtcttgaactcctgacctcaggtgatccacccaccttggcctcccaaagtgctgggattacaggcgtgagccaccgtggctggccaagaccctgtcttttaaaaaattaaaaattaaaggccaggcacggtggctcatgcctgtaatcccagcactttgggaggccgaggcgagcggatcacaaggtcaagagatcaagaccatcctggccaacatggtgaaaccccatctcaactaaaaatataaaaattagctgggcgtggtggtgtgcggcctgtagtcccagatactcgggaggctgaggcaggagaatcgcttgaacctgggaggtggaggttgcagtgagctgtgatcacgccactacactccagcctggtgacaaagtgagactcctactcaaaaaataaataaataaataaaataaaaatttaaaaaaaaaggaaacagctaagaatgacagtttaaaatattaagacaataaagtccctgctttttctattttataatttctttctctctttagtaaaataattgcagttttcttactataccattgagataaaacatttttaaattattgaattaaattggctttagagtaaaacaaaaattgactcaaaaaacaattactgtgtgtgtactgtgctcagaaatgtgaccagcaatgtaaaccgacagaaccaatggctttttagaaaataacaaagtatttccgatccttttttaagtagagaattttctcccagcacatcctatttccaattgtgtgcaaaaaaccttccagcttacaaatgttaattcaggggttggcaaataaaggcccagaggccaaatctggcccaccacctgctcagtctgcaagctaaggatgttttcttacatttttaaatggttggggagaaatagaaagagtatttttgaatatgtgaaaattacatgaaaaatcagtgttcagtgtcaatgtttctttggtatacagccacacccattcattcacgtattgtacacggggcctttcaggctacaatggcagagttgagttgccacgataagcatgtgaggtaatgcatatgttaatttgctccatttagccactccacaatatatacgtatttcaaaaaatcatgttgtacatgatatatataatttttatttgccaatttaaaataatttttttaaagaagcagctaccacagagaccataagtagcactctctttacacactacaaattgtcatgaggcagttgtgactcacttttgtctcctgcctggaaagcctaaatatttacaatgtgagcttttagagaaaaatgttcttcaaacctggaataattaatatagttattcatcattccttgaagaacttagtataatggcagtctctatgagtcagagctatcaagtaattactagatttcttgaatcttatcatgatattagtgtttctttttgtcaagtctcatatatttatattatgtattaatttttaaaaatacattatctgggccagctgtagtggctcatgtctgtcatcctagccctctgggaggccaaggtaggagaatcacttgagcccaggacttcaagaccagcctgggcaacatagcaagaccttgtctctacaaaagtaaagcaaaatattagcaaggcatggtggcacacacttgtagtcccagctgggcaggggaatcacttaagcctaggagttcaaggctgcagtgagctatgatcacatgactgcactctagcctgggtgacagagcaagatcctgtctttaaaaataattttttaatgaaatgaaataaaatataaaaacatttatcaaagtgtgctccacaaaacggaaaagggatactgttttctcacattccttcaatccgtcaaaaattaaagacctcctgcatacaatgaaggttgctaggaattcaaaataaataagatgtaattcctggctccacgtaattgcattctagtagagagacacagtattccagtagattgttgtcactaaaggaaaagccaaagcaatgacagtaacctttgccatttcataatgtcatacagacatttaaaaaatatcacctctgtctgcattaatggcaagttatacacttaaatagataaagcaacaaggcttgacaaacacatttatccatcaatactttcaagcaaagcattagccttacataagcaattaaccttgaccaacacgggtataaacaaaaatgctgattaagaacttactaattatccttcccaacttcagaagtttagctggcatctggtttttaactatgataaatatacaccaactcatcataggttattaacacataagtgaaaagaaatatttaaccaaatggctacgaatgaagaacacgataaacaaatatcatcattaaaaatccaaacaatgagttgttttctttgaaagcccaagtgtcctacaaacatcactttatttgaaggtagagaaatatttctgagaataattgtctcctgaatcaacttcgagattcaatctgttgtaataaagacaacatatataaatcatagatgcatgacaccgtttcataattagaatgccaggatctgcatgcagttaagcatcctagctgtttgcctgctttacttaacaccagaagagaagtataatcccaacagctaagtattctagcagctgttgtgagcagagtagagagatgtggcatgtagcagtcaccaccacacgtaaacacacaagcaccccggtgactggaggttagcaatcctggtgtgcctgctcgcttttagtgttaaatatttaatggcatatttttccttaatggaacccaggcacatctgatcagtcactgggatcatttagtaatgcagtcaaagttatcatactgccatttcacatcaactttgtaattagataatccatcactttattaattcaaaagattgctttctttactaccttatagcaggctacagcagtgaaacccaacagagctcatcaacaaaaaaggctctaaaatctggtcctacatgaacttgaaaccctcaagtgacaaacatatacacactcctgacctttcaaaacaacagaggtaatactcttcccacaaattagcccaccaacaacaatgaagtaacagagcaccagtgtatccagaatgagatggttaacagaactgaaaatttaagcttaaaagctgaatataacatgatcaactttgttctcgctttttattgaggtacactgttcaccagaggatgaaaaggatacacaaaaaagtcatttagtaattttccctccatgctgatttatatacttcactaaaattatgagggaggttatagcagaatatcacatccattatttatgatcactctaaatgtaaaggcacataccggccaaacacaagcatgtaatcttgaatatagtatcacgattttctcttgctttatttctaacataccacaaaatattaaatcgcgatttcttatcgtattgtgaattggtaagattctcgttttaacaccttcacagcttctccaatttaaaaaaaaaagaatcctccaataaaaaataatttactcagaatgaaactgtaaaatttaaatatcatagtaccaaaaacaccctctaaaatactcactttccaatctatgcaaccagtacatattgcaaaaccagctacagctaatataattaaaaattagattttggaaaagcaagctccggaggtcacatacgtgccctaaagaacaaaaataacatgctaccaggagaattattaatttgaaagaaagaaggagagaacatcttctcaaacagatgtggaatttctaatcaaaaaaattctgtggcagttgcacaacattataaagttcagcagtactttgcagagctccggaaacactaacaatggcatatgttctgtggtcaggaaggtcacttttattcttgttgccgccaatctaatgcctgtttttgaaacattctatgcaactagtctattttctattttattgttcagattttaccacatttctaatcaggctgccaaataaatttttagaaaagaaagttataagcccagaaaaaaaaattatatatttttctagaactctgtacaataatccctaaagaaatcttttatgtgcataaaaaaaatctcaaaacaaattctactgaaattacgttgagactatcaataaccattgccaataattatcaatggacattttaagggatagaatagagaaatacaatacattccatggcgtttcaattaattagaacatgacaactgaagcacgcttaattccatccttttaagatgcatgtgtgagaaagatttccatcatcaagggaagcctacttttacatttcccacgtgaaattccaagaaactactttgataccatggagtttctaagaatgttggcaacagtacatgatttctgtccacaatggctatgactgaaactaagcctcaagaaaagacaccattgcctgtttgcaaaatttcttctcaacaaaacaggtaattctcaggatctcaagagacaccagcactgggcacaactgtgagcaaccatctgagactctagtttacaaacagtggcagactgcgctcttggctagatgacagcacagggagatttaaaacaccaaagttctataatccaataaaaataaagctgagaggtgggagcaacagtagtagaaattaataatatgtgtcagacactactaagtacgttatagttgatcctccttgaaatctatgaagtagatattagtatttccatttacagataagaaaattgagatggagagaattttatttacttgactgaggaaaatgacctaaccatcatattattcagcctcccatttaaatttggcctctctctaactgtaatttttgtttgttttgagttggggtctcactccgtcccccaagcagcactcatggttctctgcagtctcaaactccggggctcaagcaatcctcccatctcagcacaccgagtagctaattgtaattttctgagtttcgaaggatatatttatgcttaggagtatatacattttctatatttgtagcaaatgtttcggacccaatcagtacaccgaatcacagcatttgtcatgccatgataaatttttttgagacagggtctcactttgtagtccaggctggagtgcagtggtgagatcacagctcactgcagcctcgacttcctaggctcaagcaatcctcccacctcagcctcccaagtagctggaactacaggtgtgtaccaccctgctctcagctaattttttttttaagtttttttgtaaagatggcatctcgctatgttgcccaggctgatctcaaactcctgggctcaagtgatcctcctgcctcggcataccaaagtgctaggactataggagtgagccattgtgcctgaccaataaatccatttcaaaatctaacaggtgctgggtggggtggctcacaccagtaatcccagcactttgagaggccaaggtgggtggatcacttgaggtcaagagtttgagaccagcctggccaacatgacaaaagcccatctctactaaaaatacaaaaattagcccggtgtggtggcgcatgcctgtaatcccagctactcaggaggctgaggcacaagactcaacttgaaagccaggaggcagaggtgcagtgagccgagatcacgctactgcactccagcctgggcaacagggtgagaccctattcccaaagagggggaaaaaaatctcaaaggaaattttgtttgaaaatggaagtggagatttaaaaaaaaaaaaaagtgtgtggtagagaggagaaacagcttgtagagatggagacatacatcttctcttctctaaacaatgtgaaaaagagccagcagagatgaaattggcctttattttttatatgcatataaataatcacatctcctgtgttcatctgtatatccccggtgcacttcctatcctttcaacaccttcattgctgtctgtggaaattaacacctttcattgctcacactttacacttttatctccgttcagccacacactccccagggaacatacaatctaagttttttaaaaaaaacaaaactatccaaataaagctgcaagtaatttgctctagcctctccatccaacagattatcactcagcatcccctcctctagagaaattctgggagtatccctaccctcactttctattacatttagtgcaaaacaaacattttaaacatcaagctcttattctaactctactgtaattactaaatataactgaaatctgtattccacaggtaacaacttcctttgaaaaccttctccggaggaggttgatatatttccctcaggaggttggaggaatcaacaccctcactccccaacagcatttctagaccactgtatatcactgtttcccaacaccagcctcgcttttgaaatttacgtcagtttccacttctgatatgaggtcctccttgacacccacccctagaaaaattcctccttcctatggctcatgttactcagtttttacagccaggcaacaaattcataagtggacaggatatatctatatagaaaactccacaatcaaactccaattgctattagggtgtgtgtgtattaacactggtgctaagagtcagagtcagactaacactggtgctaagaagtggggtgaaaaggaggaatatctgggaatatgaccgggaaaattacaagtaacagaagaaattttccaggtaaaattaaggcttacgcagcagatgcacgttcagcattgagaacccggtccgacaggaaagacacaccatttttccgccagaaactccagtgttcaaaatacaaactgccaacttttcaggcaataatcatgagcttccattagaaaaagccatcagctcaccagacgacgaaatatgctctcgggattaagaactttctcatcctccctgagccctttcctttcaggggaagtgcaagtttgataaagatatgcatattcttcaagtaagacttttgacctgctgaagttttctgccttgatagataattttgagatttagaattagccacatacttctacaaccctgtgtcaagagtattttgtacacactagacctgcaaataaataaataaaagtctgctgtacttgctaagcaaattcagattcaactaacaaacacctctcagcagggcaagagacttggtaagaaaagactaattctaatgaaggtttaaaactccgaagagaaagaacatctgtgtgaactgtaagtattaaaaatgacagatataaaatgagtctgaaaattagggaaaccagctgatagaaacatgaagattcattctactagtccctctatttttgtgtgtgtttgaaaatgtccataatttaaaagtcaaaaaaattaagacataagcaattttagaaaagctctcagaattccatatgcctttcaatgaaaattagatggtctaaaactggccgggtgcggtagctcacgtctgtaatcccagcacgttgggaggccaaggcgggcggatcatccgaggtcaggagattgagaccagcctggccaacgtggtgcaacgttgtctctactaaaaatacaaaaattggccaggtgtggtggcaggcgcctgtaatcccagctccttgggaggctgaggcagcagaatcgcttgaacccgggaggcggaggttgcagtgagccgatgttgcgccactgcaccctagcctgggcgacaagagcgaaaactccatctcaaaaaaaaaaaaaaaaaaaaaagatgggctaaaacataagcttagtatgtctattatctgcacagaacctgaatgaatgtaaatgagaggaaccaaaagaaaaacaaaaaacaagatcttgtttattgaggccaggtatagccagccttgttgacagcgtaaattcagaagtcagcagcttcctctgtatgtacaaactgtcagtcagggatagttgcatgttgacccgctttccacagcctaatgaactgacttttgaattttcgctgtgaagaaggctggctttacctggcctcaataaacaaaatcctgttttatgttatttttttatggtgcccgtttcttctctttgattaattaattttataccagagtaaaatgaggagaggagcagtagactgggataaaaatctctgcccagggatcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggagaaggagtcgggggagcgggaaggagggagaaggagtcggggggcaggaaggagggagaaggagtcgcgggggcgggaaggagggagaaggagtcggggggcgggaaggagggagaaggagtcgcgggggcgggaaggagggagaaggagtcgggggggcgggaaggagggaaaaggagtcgggggggcgggaaggagggaaaaggagtcggggggcgggaaggagggagaaggagtcggggggcgggaaggagggagaaggagtcgggggggcgggaaggagggagaaggagttgggggggcgggaaggaggggagtgatttaaggacaaatttataagcagaaaaatacaaattaaaaacattaacaaaactttcaccagaaagtacagaagccataggttattggctgctttcatctgattattaacctatattttaatgcagaagtgacacactaaggccaattatgcccaaaaatctcaaaactgtgtattttctagcaataacaaatattatgtggggagaagggtaagcattatattaaaaattggtacacttaatcatagcaacagaattttccccctatacaacatggagataatttcattataaaatacatgagactaaaatcttcagaaagaaagaagaactaggatagtaattcacattttacatgtagcaacagaaagtattttaaaatatttttcatggatattaataacatcagtaattatcactggaacattttccaacaatagaaataattaccacagaatagccacaaacttaacactaggaatgaggtaataatcatcataaggtatatttttatctttcagtaggtgttcgtgtttatagtgttgaacatgaaaacagccttgggcacggcacacgatactactacaggttataattttcagaagcatatgaaatagatgagaaagttttcagatgcactgtaagaaatcagtaaattttgaaatcaattttaaattatagataaccagaatataatgctaagatgacattaatcagaaaatcataaaaatgtaccatacagaataaaaatacatttgagaaaaactggaataaatctccagcaatcaaaccaattacatttaatttttcagaaaacagtaaattttaaaacatgccttaaaatattaatggcataaatatatcttcaaacgtgtgcttacaaattacaaaataagtggcaaaattgtcaaaagtaaagttttacttgttattaaattgtgatcaacattaaaacaaatgcaaacacacaatgtgagaaagcgaggacagcagatccatagcagtgagggggtgtttctgtcatccctatcccagggtaaatatcaagaagcaatcatttcatgcctatgggctagtgaagaaaaaaaaaaatcaatcatcgcactcttcctccctaggccaagataaaccctcggaatcatttaaaaaaaaaaaaaatacttcaggaggccgggcgtggcagttcgcgcctgtaatcccagcactttgggaggccgaggcgggtggatcacctgaggtcaggagttcaagaccatccgtctctacaaaaacaaaaaaaaaaaaacaaaatttagctgggcgtggtggctcatgcctgtaatcccagctactcagaatgctgaggcatgagactcgcttgattctgggaggcggagattgcagtgagccgagatcgcaccactacactcaagcctgggtgacagaacgagactctgtctaaaaacaaaaaagaaaagaaaagaaatggatttcaataaatttttcatttcaaagacaggctctatgcttaaacaaccaccataaaactcaatgaatgcaatgcaacggcaaacaagtccattcacaaaaaataatgggatatgctattttcttctgagaaaagaaagcatactctttcttccaagggtacactttgagaattcacaatgaacatactcaggcaataacaagaatattaatcaaacagaaaaattcatacccttctcaatgcacacaatacattctctcatgctctactcactatgataaggaagtaatataaggcattaagggtcttgaatttcctgtcaagattctcgacatttttgtaactaacaacaaaataaggagcaaatggttgatgtatggaattagcaaagagcaaacttaacacttacttttgcaaaggcttcaaaaaggtcaaaggcaggtggcagctgagaggcatcctgtatttcttctctcatgaaatgttgaaatgtcattacgagttgcctgaggccctctttcttatcttcagtcagtttgttaatatcttttttaaagagaaaataaatagcacaatctcaaagtaaacttctgaaggataattttcaagtgttcaatgctggctgttaaaccagatatttcctaccttacattggattttgacaaagagcaaatacatattgttttatcttttgacaactaaatatgatgcatatgttatcaattaaattctgccaaattttgtctgcaatgtaagatcaaacacctatcaaaacataagtacgcacatatatgaaaaagcattaaaaccaaaatcactgagattgtgtgttaccagattttctacatcattctgtacacacatacaaacaattatcagttcttattaagtcagtaaacttaagcagacttttccatgaaataatttacaactaggtcatgactaaactaataaacagcatcacctctaaggcaaaaagacagaaaataagaactaaaaagttcagataaagttcaaataggttaaatttgtcatatggctagtacatcatgaatagaacagggatcaagcacagcaatttcaacttcaagttatctgagttgaataaacaagataaaggagcctggcgccgtgactcacgcctgtaaccccaacactttgggaggccaagacgggcagatcacttgaggtcagtagttcgagagcagcctggccaacatggtggaaccccatctctactaaaaatataaaaatcagcagggcgtggtggtgtgcgcctgtaatcccagctactcgggaggctgaggcaggagaatcacttgaacccaggaggtggcggttgcagtgagccaacatcgcgccactgcactccagcctggacaaaaagagagactccatctccaaaaaacaaagacaaaaaacaagatatgatgtggcatcaacccaaacagaaggagatggttctaaaacaaaagaagaagaaaagttctaacgccaatactacccccttaaatatcattttcaatcataccacaaatggggtgttaaggctgaaaggatacaacaggtcaattaataacatgtgagagcatttcacttaaggtcatgtgtatgacactagtactgagtagggctaatgtgaagagtaaaacccatggtaacagatgttatttacctagcagtaatataacaagaaaatttgaatactttgctgtcttttaaaacttgaaaagatacatcaagttgaactacagcataactctgttgcttatgtctatgcatatcctttagattacttattcaacagaataacccaatgatttctttttttttctattttatatgcttgttaatttttttttgatggtaaatatatgtttttttattttatttattttttcttttattattattatattttaagttttagggtacatgtgcacaatgtgcaggttagttacatatgtatacatgtgccatgctggtgtgctgcacccattaactcgtcacttagcattagatatatatactaatgctatccctccccactccccccaccccacaacagtccccagagtgtgctgttccccttcctgtgtccatgtgttctcattgttcaattcccacctacgagtgagaatatgcggtgtttggttttttgtccttgcaatagtttactgagaatgatgatttccaatttcatccatgtccctacaaaggacatgaactcatcattttttatggatgcatagtattccatggtgtatatgtgccatattttcttaatccagtctatcattgttggacatttggcttggttccaagtctttgctattgtgaatagtgccacaataaacatacgtgtgcatgtgtctctatagcagcatgatttatagtcctttgggtatatacccagtaatgggatggctgggtcaaatggtatttctagttctagatccctgaggaattgccacactgacttccacaatgggtgaactagtttacagtcccaccaacagtgtaaaagtgttcctatttctccacatcctctccagcacctgttgtttcctgactttttaatgattgccattctatctggtgtgagatggtatctcactgtggttttgatttgcatttctctgatggccagtgattgtgagcattttttcatgtgttttttggctgcataaatgtcttcttttgagaagtgtctgttcatgtccttcgcccactttttgatggggttgtttgtttttttcttgttaatttgtttgagttcattgtagattctggatattagccctttgtcagatgagtaggttgcaaaaattttctcccattttgtaggttgcctgttcactctgatggtagtttcttttgctgtgcagaagctctttagtttaatcagatcccatttgtcaatttttgcttttgttgccattgcttttcttaaataataatttattaccatgggaacttcagatcccacaaccttatataaatctgtactagatcatcttcttgtctccatccagaagtattaaactgtgcagcaaatttactgtatgtgccctggctagttttgagttgaaatcacttacaaccttaacgaaaaggatctgcgccaatacaaaatcaaaacgaaacctacctttgcttagcactcagatatgggaagctttttaagtcatcacaagaaggtggctacctacatggtagtttcagagaagaatgatgcttcacactgccacagagactgagtcatctgttccttctaccttccttaatgtctaaaagatcagtaaccctaaaagctctgtggaatccccctgttcactaatcactcttctctgacatcaaaaagaaaacagaacaggaaaccaagagacagaagaagggaaacagggaagaaaaaaagaagaaaaatgattttgtcaactggactaatggttacactaccccatgtaacctgaacatcttcatggcgctttactaacccttatcaggacgaagctaccctggaataagtgaaataaaccagtgtgacagttgtatataaaaataaattttgttaggtttgcatcacattataaagaaacagaaaaacatagttaaaaataaatccattcaccaactcagcaaacaaattatagaaacttttttaagatgctgatagacaatcacttacttgactccagatcataaaatgagtaaagcttctctgattctgaaggtgctccatccatctgtgaaggaaaaggggaaaacgccaataacaatttcaagtgttccaatatataaacaaataagtttgagtacctttgtatatttaaatgaaagtccatcaaaaagaacattttctatatattctttctattcatcactctcattagactgaattaatcaacaactttaaaataaaaatctaacttgtatcttcactcaacagtttaatctccaaatgcaaaactcttgtacaaaaagttcccatatttttatattcataaaaccctctataaaatcgtgtaccggccaaaagagtcagtaaacaataggaaaaggtggggcatggtagctcacacctataatccccgatactttgggaggccgaggcaggcagattgctttagcccaggagttcaaggccagcctgggcaacatggcgaaaccctatgcctaaaaaacatacaaaaattagccaggcatggtggcatgcacctgtagtcccagctactcagcaggccgaggagggagaatcacttgagcccagcagttcaagcttgcaatgagctatgattgtgctactatactccagcctgggtaacagagcaagtccctgtctcaaaaaagaaaaaaaggagaaggacaaatcgggagcctacaataatttgagaaagatattcacactaaagatgggtaaaaaaatctaaaaggcttcaccacagcaagatttcacagagtttactgttttgccacttatgaaaaagggccgaagaaatcacttcagtgaattttaggaaataagataagtactcttccagtcaatactaattatgtatgtgtatcttccttgaagaggaaagtagaaaatgacatgctcgccctgtgcattagtttacaatacccaagttataaaggcaatgtaacagagattactaccatctcatacctcagagatagaacctcctccatctttattcccacaagaagatagcagggccttcaaagagagactgtgtatttcttcactgctacagattccatgattaataggaaaagaacaaatttttttgtctaagacactccctggaataatctaccttctacattaacatggggttaatttcagccttaaataggaataacacaggcatacctcattttatcacacttcactttatagtgctttgcagacattgcactgaagatttacatcatcgaacaagtctgtccataccatttttctaacaacacgtgttcactttgtgtctatgtgtgacattttggaattctcacaatatttcaaacttttggttattattatatctgttactgtggcctgtgatcagagatctttaatgttactactgtaattgttttggggtaccacaaaccatccccatataagaccacaaacttaatcaataaatgttgtgcgtgttctcactgctccgccgaccggcttattcccactgcctggctattcccctatctcttccctctcctcaggcctctgtattctctgacacaacaatattgaaattaggccaattaataactttacaatgacctataagtgaaaggacgagtcacacatctctcattttaaatcaaaagctagaaaaatgagtaagcttagtgagaaagaaatattgaaagctgatatagaccataagtcaggcctcttgcaccaaacagccaagttgtcaacacaagggagagttctgaaagaaaatgaaaagagctactcccatgaacacatgagtgataagaaagcacaacagtcttattgctaatctagagaaagtctgagtggcctggatatagaagatcaaaacagccacaatattcccttgagccaaagcctaatccagaggaaagccctaacttgcttcaattctgtgaaggctgagagaggggagaaaattgcagaagagaagctggaagttaacagaggttggttcataaggtttaaggaaagaagccatctccataacataaaagcacgaggtggccaggtgcggtggcttacgcccacaatctcagcactttggaaggccaaggcgggcagatcacctgaggtcaggagctcgagaccagcctggccaacatggtgaaaccctgtctctactaaaagtacaaaaaatttagctggccatggtggtgggcgcctgtagtcccagctactgaggaggctgaggcaggacaatcgcttgagcctaagaggcggaggttgcagtgagccaagctcacgccactgcaccccagcctgggtgacaaagcaagactccatctcaaaacatacatacatacataaatctaaaaaagtgcaaggtgaagcagcaagtgctgatatagaagctacagcaaatgatccaggagacctaactaaaataattgaatttggctacactaaacaacagatttttaatgtagatgaaacagccttatattggaagaagatgtcacttaggactttcatagctagagagaattcaatgcctggcttcaaagaacaagtggacttttttttagggactaatgcagctggtgactttaggttgaagccagtgttcatttaccattcctaaaatgccagggcccttactatttgtggtaaatcgactttgcctatgctttaccagtgggaggtcaaaacagcaacatgaaccggagttcagaagattcagaagaacttggttccaaccttcatggataacactgaggggtcaagacttcagtagaggaagtaagtgtagatgtgatagcaagaacgaaggagctggaatcaagatgaaaacctaggaaatacccttctacacatcagtcttggcaaagaatttatgatgagtcctcaaaagcaactgcaacaaaaacaaaattgacaagtggacctaattaaaataaagagcatctgcacagcaaaagaaacctgcaatggagtaaatagacaacttacagaatcgaagaaaatattcgcaaactatgcagccaacaaaggtctaatatccagaatctataaggaacttaagcaattcacaagtaaaaaacaaacaacctcattaaaaactggacaaagggccaccacagtggctcgcacctatataatcccagcacttggggaggcctaggtgggagaatttcttgagcccaggagtttgagaccagactgggaaacatgatgaaacttcgtctttccaaaaaaaaaaggaaaaaacacaaaaactagcggggcgtggtggcatgcacctgtggtcccagctactcgggaagctgaggtaggaggactgcttgagccccagaggttgaggctgcagtgcgccatgatcatgctactgcactccagcctggggcaacagagtgagaccctgtctcaaaaagtgaaaataaaaagtgcacaaaggacaagaacagacacttctcaaaagacaacatacaggtggccaaaaaacataggaaaaatgctctacgttactaatcatcagagaaatgcaaatcaaaaccacaatgagacaccatctcataacagtcagagtggctattattaaataaaaaaaaaacacatgctggtgaggctgcagagaaaagggaacacttatctactgttagtgggaatgtaatctagttcagccactgtggaaagcagtttggagatttctcaaagagttaccattcaacccagcaatcccactgttgggtatatatccaaaggaaaataaatcactctaccaaaaagatacatgtactcatacactcatcacagtgccattcacaacagcaaaggcatggaatcaatctaggtgcccattaacagcacaatggataaagaaaatgtgatacataaacactatgaaataccatgcaaccattaaaaagagtgaaatcatgtcttttggagcaacatgaatgcagttggagggcattatcctaagtgaattaacataaaaacagaaaaccaaataccacaggtttttactcacaactgagagctacatattgggtggacatggacacaaagatgggaatagcagacactggggaatacgagggggaggtaagaagcagggagtgggcaagagatgaaaagctagctactgggtaccatgctcactacctcggtgatgggatccatcataccccaaacctcagcatcatgcaatatacccatgtaacaaatctgcacatgtaccccctgaatctaaaataaaagcaaaactttttttaaaacagagagaagtagagcctaaagaattataaattaactgattaaaaattaactgattttctgcaatctcatgataaaacttgaaaagatgaggagttgcttcttatgaatgaacaaagaaggtggtttcttgagatggaacctactcctggtgaagaagctgtgaggcatcatatgttacagtgaaatcatttgcgaaaggaagaggcaatcaatgcggcaaattcgactgttgtcttattttaagaaattgccacagccaccccaaagttcagcaaccaccacttgattagtcagcagccatcaacatccaccagcgaaaagatgatgatgcactgaagggtctaatgatccttagcagttttagaaatatattttttaattaaagtatgtacattgttctgttggcataatgctactgaacacttaatagactacggtataatgtaaacataacttttatatttactgggaagccaaaaaatttgtgagactcattttattgcaatatttgctttattgtggtagtctgaaactgaacctgcaacatctctgaggtataccggaaaatgcaattgcatatgtttatttaaccaaaacccagctatatttcatgagttttatactcacaagtttgaagacaactctgccaagaagtcgaacggagtctggaggatatctgggtttgcagcttttaaggcatttgcattcccgcttgtggtctggccaagcttttttctattaaaacaagagtggggagaacataggtgacctaaaatttaactttcatttatactggttttgaacatcaagagtcataaacattaaattttaatagtccaaatgtaactgcacaatagaaaataaaagcaatattctaaatctgaaaataatccaggatgagtctttgccaaatatgcaattactatgcaaggacattaaaagcctcagcttcacctctgtgctttcatttgtcccctggttattacctggctagtggagtccaaagaaagagccattacagcttacttaataatgtataagatggtcttggaactgattaaacaggattcaacaatagtcattttgaatacaaaaggaaaatgtcactccaaattagaaaataaaacgtggttcagaagactcaaaatagggatgacagccttctgaatttctgtgctgctacagaaatatcaggagggctaacacacccccaaatataaaatctctttgttttaaaagcaacataaaaagaactattagctaaaatcattaaatgtccagtttgtcctggatgtgtctaggtttgtatctatgtcctggcttaaatattaatagtgccccttttcactctgaaaagttctggttttgatgacaaattatatggtcacctaagccatgatcctagccatgtgttgatgtggctaaagagaccattgagtcagttgccaatgtacagatgaatggactaaagggaaggacactatccttgagccttggatcagaaaggcgacggctcctttcacacggaatcactttcatatggaaataaaatccagatcatctaatatttagccctggtgagtagaagaagcctcaatcaaatgtctctcgtgttatattctgaaaattggaatttccattactgaaatgcctgataccacttactcattcttatttcaaaaattataaatctgctcctcaatttctgggtctacaaaatcaatgtgctgttcataatttttgttttagcatttacacttcactcacttctaaacaagactgagctgattcaaagtaaagatgtgtatgaaataagactgcaaaaccagaaacagaacatattaaaattatggaagggggaaaaaggaaagcacgctagcatttacttagcattctacaaggtactagatacatggctaagcaaataacgaagcacgtttcacttgattttcgtaacaatccaaatggtaggtattatccctctattacaaataaaggctcaaaagctgatatctaactatcaaactgcccaaatacaaaaagagagagtaaaaattcttagcatgctaaacatgagagctgaataatttctgcattacatttgagtatttgtacgtcacatttatttgagatgccttacaagcaaggcaaaaaagaaggcataatggcttatataatcctcaactgacagaaagtaaaaacatacagtttcaccaagtattaaatcacaggagggatttattccaagaatgctaatcaacacactgaacaatgtccttaacaacagttcacaactataatggcctttcatatgacttctaatatcagtactcactgaaaggcataatattaaaatacaactcagtgaaagaacaagcttctgttgctcagggggctagtccttgactagcaattagcaattaccaatgtgtgtaagaggcctaaaatatacatggtacaattgtcaagtaagttttaaaaacacaatatcatgttgaccctacttagagattcaaaatatacttagcatcctaaaagttctaaaagtctatgcactaaagaaatgtgtataaattatttaacacagtttcccatgcttgttattgtcaccctttagagagttaggttggtattcactaactcagatatatctatatattttttttcacctggtctttgtatgtgagtgggttaagctaacaaatttacattcatttgcactcacaagaaacaagaatgttaacttttttggttttttactgatagaagggagaaccataactttggcgttagttttcctttgattatagaagttgagaaacctgtcagatgctctcatggacagagcgtgtaggcaggaacggataacatagtgccagtgggtctatcagaaagtaccttaggctctgttcaaatgcctcagtgtccagctgaacagggctcacactcagcaaaacaaggcagagataatttgaggcaaaagaccttaagagcagattttaatcaatgctcattttaattacaagagatcatccataacccctctgttaaaacctaaatatttgagcagctcagcctcctgatagcttaccagggtgagataagtacaaaacgtacaccagataatgaacaaccgatcagttagatgacagcatttggaattaaacatccaaattttggaaaattcctgttaaaacaactttaggtccttaacataattgatatagagctccttttctcaacaataactagaaactagacaaaatgtttcttaaacttattcctagatcattgcctgaaaacatacttattttctcatttgcttcagcaaaaatatgttcattatttccatgaaaagccaaatcagatcatttaggcataaatagagaaagcaatcataccacttaaaattggtctgtaatatggtaccacatatcagcccattccttttctttttaaaacattaactgttaaaatttatcattcagcttcacctatcacatcttaccataagggttacgaatacaagcataccatagaaaaggcttacaaagaaatctttttacgcagctcctttgactttgaagcaaaacgtgacaatcatacaaaaacaaaaggcattatcttcactcaacaaactaaccttggtcaagacctcgatgacacatttgtcatatatatttgccaatttctcaaaagacaaccttcctgatttacattttttcctattttcttacattacttccaatacaggatataattaagattttgctcataacattggctgtagtattttcttttgtcatagctgaaaattaacaatgatgtacaataagcatgaactggcttgagagacaaaggaaattaaaatactacattaagaagtaaaaacaaaaggagacaagagtttcatgctggaaaaaaaggaaatgacatctataacacaattctttcagtgcatgcatgactcaaaaaacaacttcagaatctatacagtttcataatgtatttttatagtatttataacagttcacgacataaactcattaaccacaccagtagttctcaatgggagtgacgcctatcttgagggttgtttgagaaatttatgcgggtatttttatttgtcacaaggtttatggaaaattacaggcacttaatgagcaggaaccaaaggagccagacattctgtgtcggacagttctccacaatgaagaattatccaaatccaatgcaactttcaagtgtccaaccaaattccatgacggtggaaaacttgtttataattgtctgagcctagaactaaatctccttttacatttaaaaacaaagagctcgtttttacataatcctaacagcactgaattttctaggtaaatcaaaggaagactgtattttaagaattttacctaaattactcaattaaagccatatcactgaaggcaacaccacttagagtacttgagttaccaatacaacacggcttctgacccgcatctctacttcccttctcacagtgactctatgtataggtgcaaatatgtgactaatgatgtcttccagtctaatacctcagcatttatatactaaaatacatattattttatcataggttttaattttctttttccttatattccaattatggcattatattaatgttttgaaaatatgtaactaggtatattgcactacctgtaaaatttcatttcaagatagtagagagggcaataaaaatagttctcacaaaaatggggagttgggtctgaaaagaactgagaagcccagatctaaaaaaatgctacacagttacacatgccacacacatacacaagaatatatttttaaacacatagcctaacacccaccctagggattctgacactacccatgagacagaatcaagcatcccactgcagggctgctatggtttcaatgtgtacctcaaagttcatgtgctggaaacgtaatccccagtgcaacatgttgagaggtggggtcgttcagtagcacagcgctcacgaacggattcatgtcactattgcaacagtgggtttgctataaaagagagtccggccctctcttgttccctctcaggagcacgctcccgtcatgtgacgccttctgccatgctaggatgcagcaagaaggcccttacagatgtaatccctcaaccttggacttcccggcctccagaaacaccagccaaataaacttctattgtttatgaatgacccagtctgcggcactctgttaatagcagcacaaaaacagatcaagacaagggcattccatgagtagctaaagttgaaaaaccactgagttaaactaaattacaaaggaggtcgttatatatactaaatagatgaaacaaaatacaattctataattatcattgaactattgttctatagaaataaatattgtataatattaaggtggaaaaagtgttttaaacagaacataaaatgtaaaaaccataaaggaaaataaatatatattcaattacataacaataaagaatttttgtcttgggggaagaaaaccagaaacaaggtttaaaggtaataaaccatgaaacagtctaaaatacatatatagacacagtgttaaatgtctccaatatacaaaaaggccttacaaataacttttgaatatttcaaaaaatataaataaaggtaaaggaaatgaataggaaattcatgactgaaaaagaaaaaccaatagacaactaatacaaaccacaccagtgctcaaagacatgataacagaaactagataacatagtgtcccattaatttggcaaaaatgaataaaactggcagtatttagaagcatctaggatttggggaaataggcattttccagccttgttagtagagttgtaggctgctctgatctttctgatgggtatttggtaatgaatatcaaaattgtaatgtgcatattgttgacacagaaatattattcataaagtaatttattttaaaaaatttaaatagtataaagaaataaatttaagaatgttccaccctaagcaacatagggaaatcccatctctataaaaaaaaattttttttagttagccagacatgatggcatgcacctgtattcccagccacaccagaggctaagaggagaggatcactcccagctatgctggaggctaagatgggaggtcgagactacagtgagccatggtcacaccactgcattccagtctgtgtgacagagtgagaccccaggtctcagggggaaaaaaaaaagaatgctcacaatagaagatgattaaaatactgaaagttaacttttccagcttttcctaaaagaaattgctatttttgtctttctctttatagctttccattactatttaaattttctacaaagagcatggagtttatgaataaaaacaaatataattttatgtgtagtaactgagaatcagggagaagtacttttatacgaaagggacagcaaaattactgtttaataggcactggtgcttcttaactttttaatgtttattttggaaatctagttgcaactcaaagcatgatttaaatgtgttaatttttaaatgttaaaaaatgcttcagtgaactgttctgtaatgctgatgcaatcttttttaattcagagattcactcagtaaattcttttattagtttggctatattcatgtctgtttttcttaaatgagtatagtaccaattaagtacaccttgcatgaaacaggtgttcaatacatattttatgatttattctaaaaccagtaccattcagggggtaaaatttactatatattatcattatttgaaattaaggccatacaaaaagaagaaatgaaagtagactctcacaattctttctttgaccaataagagatggtcttgattacatgattatgaaaggagtgtattgatgagatgttacactaataagagaaaatcaatttatttctttcttacgcaaaataacatttgcactattatcatatttccctctcctctttacatacaaagtccctattgctcactcaagaacccatttaaatgctgttaaacaccaagttttggttggagtggatatccattttagggtagctcattattgtttgggatagagtgtaagaagggtcatcctgtattgaaccttggattgggtaaaatacatccaattcatgacatcagctcactaggtatttattccataagaagattagattcaaagatctgcaaggcagtcttccaatgataaaattctgagtctgtaacatccattcctaacaaatatctgaattatgtcaaaataggtttgaaacctgcttgggttaggcttacaatcattgaaaatttgcaacagtattttcctcagctatttggtcattaaggatgaagaagctgtctttaaaaatatagaaaagaaaatgaattttttgagcccacttattcaacagtttcatataatattaactaaacatcttctacgtgaaatatcacagtgatttttttcctacatattcaggacttactccactcacaaacaatcatctacagaggtttcctatgggcaaaacttaggatagttgagctgccacgcaacttgcaggaaataaaagatactcgacagttttccatttacatccagtttgcttgatagcaaataaataatgcctcctcctttatccttgaaatgtagtccaatattgaattacagattgtcagatgcaggcagatctgaaaagctggaatctgggaaaagaaaactggaaggctaagcaggttgtctaacagctacagttgactgacaggtattgattaagatcttgcaaaaaaatctctttagagcacactagagattagtgatagatatgagacttctcactttaaaagcttactgaatgctgtatcaaatgtagagcaagagcatcttctcactagtcttaatcaaattagatgaatagagctaaatataaagaaggaatgtgccatgaaaatggtcttagggcataaggttgacaagaggaaaaaaagaacgtgaataaatgaccatttcttgggcaaatgggaattacggtctcctgttaagtgaggaacctataatatgagacaataataacaacagtgcccccaaagtaagtcaatcatcatctactgcagggttccaaaaatatatggctcataggtaaaattcattttacatttttacatttatgtaaaattcaaattcatgtacgttctaattcgtgctacatttttagtaaaattgtacattacagggatagagccacacttattagttacattcattcatttcatgctacatcagagttgaacacatacgacaaaaatcatatggccacaaagcctaaaatatttactatatagttctttacagaaattagccaatgcttgatctaatgagagatcatatgaagacgaaatgacttaattgatagtttggctggaaagcaaaataaatcatgcacttccacagacttccaatcttatttggaaaaagcatctatcctagattaatcaaaatatcaacaccagcttctagctgaatacggtaggtgagcacatgtattttatttcctcaaaacaagtaattatcaaattttttactcccaaagtgaactggaacagccatcaatggatgagtggcagggaaggatgtggttagccccatttgagagtgaaaaagtggtggtaagaggacaggctgcagaagcagggtcaaagaggccacatgtagggacagtcccatctgagagggaaggtcagcctgccaagcagaattccagaaaggatctagaatcaaagactatacattggtagaatggaattgaaaaatagatgagaaagagaaaattaaccacaagtctgtatgccaaagagtctcaaaacaccccttctctacttttggcttgattgagtaagcaatggaaggttaatgtacagaatcttgttgaatttgatgctaagattatctctgatccagattattgctatagcctcctatttggtcttcctgccctgactcttacccttctacaacggcttcttcaaacaatagtctaattctttgagtggcttaaaaattgtgatcactgtattacagaaaaagaaataaaatctatgcatacttaatagctctgtggtgaccaatatgtttcaaactacttacttgaaatataatttacattattaaattatatttaggttggtgcaaaagtaattacttttaatggcaaaaaccacagttacgtataataaaatgtatccattttaacagtatagtttgataaatttttgtttttttgagatggggtcttgctatattgtccaggctggtctctaactcatgagttcaaacaatcctcccaccttagcctcccaaagtgctgggattacatgcacgtgccaccacacccagctttgataagttatgacacatatatctccatataaccaacaccaaaattaagctacagatgttagtactccccaaaagttcccttgtgccccttacattcaagtcctccatcccaggcaactcagtggttttgtctctataattgtaagatcagttttgtctagcctagaacagtcttacttcttttcatctggcttcattccctcagtacagtgttttgagattcactaacgttgcggcatgcatcagtagtttgttcctcttaatggacaagtaatagtacagtatgcatctctttattcatttacctgtggatgaatatttcacttgtttccaggtttggaacattgaacatttatgtacaagttgtttttgtagatgtaagttttcataactcttaggtaaataactaggagcagaactgctgggtcatacagtaagtacacctttaacattattacaaactactaaactttcccaaaacaatgataacgctttactttctcaccaccagtgaacaagagttccagttgctccatcaccttgccagcacttgacaaagtcagtccttttaattttagtctttctagtgggtgtgtagtaatatctcattatggttttaattttcatttatctggtgaccagtgacaatgattatcttttaatgtatatcttcttaaagtatctattcaaatcttttacctgttttactcagttttcttactactgaattataagtattctttataaattctggaaacaacttcttggttggggtgagagagagagaaggagggagagaaagagaaaaggagggaaacagggggaaagagaggtctcaaatattttctccatgtctgtagtttgtctttccaaggagctgaagggtttaattttgatgaaaatcaatttatcaatttttcttggaggcttagtgctttctgtgttctacataggaaattttatgtaccccatatccaaagagtttctcctatgttttctcggttttatagttttagcctttaagtttaagcttattgaacctaaatcttattaaatctagtgaagaattgtttttacttttatcatttattttccatgtgcatattagcacaattttttgaaaagatcatcctttcattattgaattatgttggcacctttgttgaaaatcaactggccatatatgtgtagggctatagtttttatatttttatttctgaatacaggttgagtatgccttatttgaaatacctgggaccagaagtgcttcaggttttggatttctttggattttgaaatgtttgcgttatacttactggctgaaccatcccaaacctaaaaatccaaaatccaaaatactccaatgagcatttcctttgggtatcatgctggtgcttaaaatgttttggattttggagcgctgcagattttttgatttgggatgctcaacttgtattatgatgtgttgacattttaaaaacctttctgactaaggagaagactgctcctgctcctcccagggacagccaattctaagaaatagcaaaaagctcaatcctgagcatgcctttgataggcaaactaaatgatccacagccatacatcctctgtctggccctaacaccctaagaggcaatattcttctgccttaatcatcccagggccaggtaccaggcaaacagagaccacccttaaaccccaggatcccctgatattactcaaactagccaatcctaaactgagaaacacctatgaatgccacagtccagggacaaaggctcaccaaaaacccaagacctaatcatagaactatagaactggccgggcacagtggctcacgcctgtaatcccagcactgtgggaggccaaggggggtggatcaagaggtcaggagatcgagaccatcctggctaacacggtaacaccccatctctactaaaaatacaaaaaattagccgggcgtggtggcgggcacctgtagtcccagctcctcgggaggctgaggcaggagaatggcgtgaatccgggaggcggagcttgcagtgagccgagacgttctactgcactccagtctgggcgacagagtgagactctgtctcaaaaaaaacaaacaaactaaaaaagaactacagaacagttcctctcctcttacatcttgccatcacactactaaaggcctatttacagtggttccttttacatcacgtctagctatcaagaaaaaactataagacatactgtattagtacattcttatgctgctatgaaaaaatactcaatactgggtaatttataaaggaagacgtttaattgactcacagttccacagggctgtggaggaaacttataatcgtagtggaaggggaagcaaacacatccttcttcatatggcagcaggatggagaagtgcccagcaaagcaggaagccccttataaaaccatccaatcttgtgagaactaactcactatcaagagaacaggatgggggatactgcccccacgattcaattatctccacctggtcctggtccctaccgcgacacatggggattatgggaaccacaattcaagaggagatctgggtggggacacaaccaaactatgtcacatactaaaaggcaaaaaaacatagtttgaagagacagagcgagcattagtaccagactcagatatggcaaggatgttggaattatcagactaggaattttaaaaaactataattaatatgctaaggattccagtggaaaaggagacagcatgcaagaacagacaggggatataggcatagaaacagaaattctaaaaaccaagaagaactgctagatcaaaaacaccaacaaaaataaagaatgcctttgatatcttattggcagactggacgtagctggagagaagaatctctgagctgaaattatctcaatatggtaaccaccaacattaagaagcaaagacaaaaaaagactttataaaaaaaaaacagaatatccaagaactgtggaatgattatataaaggtataagatatgtgtaataggatatgtcagaagaagaataaagagagaatggaacagaagaaatacttgaagtaataatgactgagaagttctcccagattaatgccaggcaccaaaccacagatccaggaaactcagagaacaccaagaaggataaaagtccaaaaatctatacttaggcatgtcattttcaaactacagaaaatcaaaagttttttaaaatactgagagaagccagatttttatagctaaagataagtatatgtctgttttaggtgtttatagatactgaaatggtttcagtaatatgtcattttctgaaaatctcaaaacacttgaaaggtgtgtgcaatggtttgaaggtctgtaccctccaaaactcatgttgaactttaattaccattatatcagtgttaagaggtgggaccattaagaggtgactcagccatgaaggctctgtcctcatgggcaggattaattccagtatttgatgccctcttgtctcctggcccttccaccatgtgatgtcacagcaagaaggccctcactacatatagccatcttaatatagaacttccaggcctccagaaatgtgagtcaacaaatttccgctcttcacttatacactgatggtgggaatgtaaattagttcagccactgtggagacagtttggagacttgaactaagtcttgaactaccatgtgacccagcaattccattactgggtatatacccaaaggaagataagtcattctaccaaaaagacacatgtacccatatgtctctccctgcgctgttcacaatagcaaagacagggaatcaatctaggtgcccatcattggtggactgaataaagaaaacgttatatatatatatatatacacacacaccatcaaatactatgaagccataaaaaagaataaaatcatgcccttgggccgggcgcattggctcatgcctgtaatcccagcactttgggaggccaaggcaggtggattgcctgaggtcagcagttcgagaccagcctggccaacatggtgaaaccctgtctctactaaaaatacaaaaattagccagacatggtggcaggtgcctgtaatcccagctactcaggaggctgaggcacgagaattacttgagcgtggaaggcagaggttttagtgagcctagatcgtgccactgcactccagcctgggtgccagagcaagactctgtctcggaaaaaaaaatatatatatatatgtcttttgcaacaaaatggatgcagctggaggccattatcctaagcaaagtagcacagaaacaggaaatcaaatacagtatgttctcacttacaagtgggagctaaaattgggtacacaagtgtataaatatgggaacaacagacattggagaatataaggaaggggaaggaggaggaggtgcaagggttgaaaaactaccttttgagtactatgcttactttttgggtgacaggttcaatcatactcgaaacctcaggatcacacagtatacctttgtagaaaacccgcacatgtacccccagaatctaaaataaatgttgaaaacaaattaaataaatttgaaacaataaaaataaatttttttctttataaattactcagtgtcagttattctattatagcagcacaaaacagactaaaataaacaacttacatatagaggaacaaagaatcatagccaacttctcagaaaccatgtacaagagagtggaatgaaataaagtactgagagaaaaaaaaattactaatctagaattctgtaccctgtggaattacccttcaaaagtgaagggaaaataaagactttttcaggaaaacaaaagttgaggaaatgtattgccagtagacccacccgcatgaaatgttaaaagaaattctgtagagagaaggaaaattataaaggttagaaacttagatctacataaagaaagaatgagaatcaaagaaggaataggtgaaggtaaaataaaaactttcatttttcttattcttaattgatctaacagataatagtttgttcaaaagactgctaatagcatcaatgtatttaattatgtatgtttatgtataagctaaataaatgacataagagagggagcaggggccgggcacagtggctcaggcctgtaatcccagcactttgggaggctgaggcaggtgtactgcctgagcttaggagttcgagaccagcctgggcaacatagtgaaatcccatccccacacaaaatacaaaaagtagccaggcatggtagtgcacgcctgtagtcccagctatttgaggaggtgctgaggaaggaggatgagttgaactgaggaggtcaagtctgcagtgaggggtgttcaggccactgcactccagcctgggtgacagagagagatcccatttctaaaacaattttttttaaagagagggagcaggaattaaaagtattttgttattctaaggtactcattctacctgtaaagtggtaaagtgttatttgagagtaaacttggattcgtcgtaaatgtatattgcaaactctggggcaatcactaaaaaaggagatatatctatatctgatgttctaatgaagagaaaagaaatcatacaaaaggctcaactgaaaccacaaaaggcaaaaaatagtgaaagacaacaatcagaacaaataacaagggcaacaaatagaaaacagatacgataaatattaacccaactatatcaataatcactttgaatatcaatgatctaaatgcatcaattaaaagacaggaatggtcgcagtggatcaagacacaaaacccaaccatatgtcatccacaagaaacccattttacatataaatagattaaatgtacatggatggagaaagatataccgtgctaacactaatcaaaagaaaagcagaaagagctacattaattctagatttcaggttaaatgtcacctctacaggaaacccttctgtatccacctactcacaggtgagtttgtgctcaccccaatcacattcaatcatataatcatgggcatttgtcactgtctctctactccataacagaagctttatcaaagtcaggaccttatttacttgctcactgcctattacttatcataccaaccaccaggacttagagcataataatcactctaactcctgtgtagaaaataaattagaagttggaaagaatcgtagttaacaatgcagctaatccagaaaagagaccatggtaacaggtagtactaaagaagctgacgagaagggaaccaattcagatctttaggtagtaaaatagtaaaatcagcacgacatgatgactaaatggatctgtcgccaagaaaggatgagaatcggagatgacacctggcaactcagactgctgggtggctggtgaaactgttcactgaggctggaaaacatgaagggaagtgggtctgggggaagataatgtactcagatttacacgttacaccagagacgcctgtgcaacagccaagtggaaatcaggagaaaggaggctggagacggagtcttgagaaggattaatatacagatgccacttgaagtcataggagcagataacatcacacagcaggcaaaggtaaagtgggaaaagaaaaacttccggctccagacacctgtggaggtcaaaaactgaaatacgaccaaatcgttttaaacttcatgtagtactccctttgtgttgacagttagatacaaagctgacttatctacagtacattccgtgcaaagcctatcagtttcaggccgaatttatgaagtaaacaaagcttgacttccttcattatcactgctttggttatggtagtctaagaaccagcctattaaatcactctgttaagtgcttactaatgtgggattaattttctacccatcgaatatgaatcaaatcattccacaactaagcataaaatgtaaacccaaaaatacgattcacatttttaaagaggtctataattatcaatataaaatagagcttgtatctgctaatacagtgcttttaaaaagtatataaattacaatttgatggagtgcctaactccttattttgctcagcaattaattcattcaactagaaatgtatatattatcaatcatattaaatcctcaaaaggtaaaataatacttggtgaattacttgaaattgacttacttgctatcaccactgctgccattttttgttttgaaaatgcttttttataagaaattttagcctgctcctcctctttgatctcataatcatgtgtgatgttctgtttatagcaatagagaaaaaagactggacctccttctatgaaattatatgatagacacctgataataaggtatagaccagaatataaagccagtgatgacaaaaatattttgaccagtaacagaaacagtactgtacacaggagtaaatacatatgtcgatgtgtacgctatatatgatgcataaaccaatagtttggtgtatatcctccatccataaaatagacacatatggattatctctgaaaaacagaagtagaagcgggggaaggaagctggggaaagacttttatgttttaccctgtatgattctatatggtgtttttataataaaaacatatccttgtattgcttatgtttaaaaatgaaatgtgcaccagatgcggtggctcacggctataatcccagcactttgggaggccaaggctggcagactgcctgagatcaggagcttgagagcagcctggtcaacatgatgaaaccccacctctactaaaatagaaaaaattagctgggcgtggtggcacatgcctgtagtcccaactacctggggaggctgaggcccaagaattgcttgaacctgggaggtggaggttgcagggagctgagacggcaccactgcaccccagcctgggcagcagactaagactctgtctcaaaaaaaaaaaaaaaaaaaaaaaaaaacataaagaaagaaatgtgaataccaatagcactgacaccatcctgtgggcacaaggtacatgttacacctgcaataccccaatagcctctctcagacaacttgatgccatggtcccacacatcaaatgctaagctagtgaaccaaaatcatgtccccctggggtatacatattatggattttatactacagatttacatcctctgtttcaatttccattccaagtgcttttgcgttctgttcatcactgttcacagttcagtatgtcatttaattttgcgtagttttgtgggtatccacaataattacaatgtttaatgttgtattttaaggttgagataaacacagcagtttaaacgcatatgttctggccaatctttaactccccctccacacacacaaacacatactctagctgttattacatatatccttcatcttgctagctgttttcctgttaccttccacagtatatctgacagtgacattgttattgatgccacagtaaacagctaatatatgtagtaaaaacacatgcactacaggtaatcaaaatgacatacccacccaccaaactcctgctactcattctaatcagataatggcttttctcttccctgagtgtactacaaaaggatgatgtggcactagaggaaaaatagtcacaaaacaggggaaaaaaatgttttattaagtaaactgtttattaagtgttttattaataaactgtttaggtcattgagattagaaagcaagtttgcctagacttgtgtcaaataatatgataatctgtcgcttctctatgtactctgtttaatctgaagttcctagaaacaaatagctgagcttcacgtgaataaaacacctagaacatcaccataaaccaagctttctggaacgaatactgtataaaaagcagtattaatgtttcactttttgcttttagttactcttgttggtaacaatcttacataaatcagggatctttctagcttcgacaaaacttttgtttaaaaaatgaggtagaaataatattattgttttgaaatttcctatcctattttaattagaaagtgttatactggctgggcacagtggctgacacctataatcccagcactttgggaggccaaagcaggaggatcactagagctcaggagtttaacatcagcctgggcaaacagtgagatctcgtctccattaaaatttttttttaaattacctggccatggtggcacgtacctgtagtcccagtggctcaggaggcagaggcagggagaccgcttgaacccaggatttcaagactgcagtgaacttgataacaccactgcactccagtccaagagacaaagcaagactgtccccaaataaaaacccaaaagccaagaaacaaaagaataatacaatatataatggaaaactagacctaatcagaatgttagagcaagaacagaatttaggtttaaaagagcagttaaaagtctgaatacctgggtttcattcctgaaacttcagagcctactagttacagaatatttggcaagttggctgtctctctgtcctcattgtccttattaataaaataaaaataataatagtacctaattctcacaagactcttggaaaatcaaatggaataatacagtgcctggcacacagtggatgcctaataaatattaactcttattgttagtacagattcagaaactgaggcccacacagtgtgtgttttccctgagataatttaaccagcaaatgccagaattagcatgagaacctggaacccctgatatttttgaacttttgatttcttttccattaagaccactttttgtgtcgtctcaaattactttcaaaggataaaatgagagagaagaaaacccctgagacaagcatggcctaaatttaaaagaaggaaagaagaaactctggaggtgtgtgtgcatatacaaaacataagaaacaaaaaggatgagtggagggtggcagggaggaggcaagtgacatagacacaaaacctctaattagacttttaataagatgtaactcattaggacataattacatttcttattaaatgattaatcataaggttagaagaaaaggtcatgctgaatgttaattatacatcctttcaagaatttcaaagatgttaacaacagtactcgtaaattaactcaaactcttggcaggatatttggcattatctttaaaaattcaaaaggcatatatcctttcaacaatcaatacaataagaatttatcctactaataatttggggaagtgtgcaaaatgtgcaaaacaggatgtgaagtgcattattggcaataccaaatattagaaaagtgccaagcattcattaacaaagaaattattattatggtcaattcatacaatgaaacatatgggatacaaaatgttccccaaagtagatcgttaaatgaaaaaaaaaaagtacacaagaattcatgccagattaaactatatctttttttttttaaacataggatgtagatacacaaatatgtctgcacaagcaaatgctgcaaagacacatgagaaacttaacagtgattgcctgtggaaatgagaattgaagtcggggggcaataagatggggaggaatagacatttactttcacatagtagacatatacacacacacacccaatttttaaccatatatatttaacatcagttttaacattttaatgtccctggcaacctgtgtgactcagcaggtgaataacaagtaaaagtaaattaaaggctgtaaagaagtagacacaggccaacaggtatagtgaaggacaaatttaagagtaaagaatttgaaagcttcacttatatatggctgaaaagtcttacctgacacttagcactacagtatttggcgacgcggcactgagagcatcgcatcagcttttccttcctgtggggaaaaaaattaattctgcattaagaaatgagtgggaaacatagtacatagttgaagaaagaaaacataagtcaacatacggacacccgtatgttctgtttactccattatgtacagtcccttaagatttggattttcacactgatgagcctcctcttgaaccttccatgtgagacactgatagaaaaactaagtccttttgtctgacagaagatggcggggaagaggcaggaccagcttgcagctcccgatcggacagacagagcagcgtgtggggactcacactgtgaacttttgatccaacaactgccacagcaacataccaggtaaactaagagaatccacagaccctctgaaggaactgtatcgccactgcaggctccctgagactctgaaaagatgtgagctgcctgcttgctcagcagggaggctggcggtctggggcaagttctcagccacagtcaccagctgcctggaaacagactccgtgctgctgtgggggcacggtgggagtgagaccagcctttaggactgcgggctgtgtgggagtgggatgaggcctgtgactgctggctttcccccacttctctggcagcctgtgtgacccagcagaagcagccataatcaccctgggaacataactccattagactgaaaaccacatccccatcccaacagcagccgcagcaatccccagccaaggagaatctgagctcagacacacctatccctgccccctggtggtctttctctaccagccctgggtgccaaagacaaaggccataatctcttgggagctctatggccctgcctaccacctaagaaacctgaataggtaaccaggcgaccttagggcaagtttgcttcctccctgtaggaccacagctgatgtgttcctgaaagcaccaactcctggctggaggccaaccaacacaaaaccagcacactaaacaaaaatacaaccaagggcccttgtagagtccacttcacgcccctgctacctccatcagatcacaggactcttagcagtcactccccagtaccagcccagagcccagtacctccactgggtggctagacccagaagagcaaaaacaatcactgcagtttggctcttgggaagctccatccctgggggaggagggagaacaccacatcaagggagaaccccttggaacaaaagtatctgaacagcagcccttgagtcccatgtctcccctctgacacagtcacccaaatgagaaggaaccagaaaaacaattctggtaatatgacaaaacaagctctttaacaccccccaaaagatcacaccggctcaccagcaatggatccaaaccaagataaaatatccggattgcaagaaaaagaattcagaaggttaattattaagctaatcaaggaggcaccagagaaaagtgaactccaacttaaagaaatcgaaaacctgatacagaatatgaaaggaaaattcttcagtgaaatagcataaataaaaaatgatcacaacttctagaaatcaaagaaacacttagagaaatgcaaaatgcactggaaagtctcagcaacagaatcgaacaagcagaaaaaagtacttctgagcttgaagacaagtcttttgagttaacccaatccatcaaagacaaagaaaaaagaatttttaaaaatgagccaagcatccaagaagtttggaactatgttaagcatgcaaatctaagaataattggtgttcccaagacaaaaaaaagaaatctaaaagtttggaaacattatttgagggaataatcaaggaaaacttgtctgaccttgctagagatctagacatccaaatacaagctcaaagaacacctgggaaactcatcacttagacacacagtcaagaggttatccaaagcaaagatgaaggaaagactcttaagagctgtgaggcaaaagcatcaggtagcctataaaagaaaacctatcagagcaacagcagatttctgagcagaaactgtcagaggcatgcatgtgaaccagggcaactctatcttgaataggagctgagttaaatgaggctaagacttactgtgctgcattcccagacagttagggcattctaagtcacaggatgagactggaagtcggcacacaatacaggtcataagtaccctgctgataaaacaggttgcagtaaggaagcctgctaaaactcaccaaaaccaagatagtgataagagtgaccagaggtcactggtggtcctcactgttacactcccatcagtgccatgacagtttacaaatgccatggcaacgtcaggaagttaccctatatggtcaaaaaaggggaggcatggataattcaccccttgtttagcatataatcaagaaataaccataaacatggacaaccagcaggcctcggggctgctctatggagtagccattcttttgttcctttactttcctaataaacttgctttcactttactctatggactcaccctgaattatttcttgcatgatatctatgaaccccctctgtaacaaaaccctataagctagaagggattggggtcctatttttagcctccttaaacaaaacaattatcagccaagaattttgtatgcagcaaaactaagcttcataaatgaagtaagatacagtcttttaagacaaatgctgagagaattcgccactaccaagccagcactacaagaactgccaaaaggaactctaaatcttgaaacaaatcctcgaaatacaccaaaatagaacctccttaaaacagaaatttcacaggacctacataacaataacacaataaaaaaaacacaaggtattcagacaacaaacagcacaatgaatggaatagtacctcacatctcaatactaacattgactgtaaatgacctaaatactccacttaaaagatatggaatggcagaatggataagaattcaccaactaaatttctgctgtcttcaggagactcacctaacacataaggactcacataaacttaaggtaaaggggtggaaaatgacattccatgcaaatgggcaccaaaagtaagcaggagtagctattcttatagacaaaacagactttaaagcaaaagcagttaaacaaaacaaggagggacattatataacaataaaaggactagtccaacagtaaaatatcacaatccaaaatatatatgcacctaacactggagctcccaaatttataaaacaattactaatagacctaagaaatgagatagacggcaacacaataatagtgggggattttattattccactgtcagcactagataggtcatcaagacagaaagtcaacaaagaaacaatggacttaaactataccctagaacaaatggacttaacagatatttacagaacattctactcaacaactgcagaatgtacattctattcatcagcacatggaaaattctccaagatagaacatatgatagggcacaaaacaagtctcagtaaatttaagaaaatcgaaattatatcaagtactctctcagaccacagtggaataaaattggaaattaactccaaaaggaaccctcaaaaccatgcaaatatatggaaattaaataacctgctcctggatgattgttgggtcaacaatgaaatcaagatggaaatttaaaaagtctttgaactgaacaataacagtgacacaacttatcaaaacctctggaatacagcaaaagcggtgctaagcagaaagttcggagcattaaatgcctacatcgaaaagcctgaaggagcacaaatagacaatctaaggctacacctcacaaaactggagaaacaagaacaatccaaacccaaatgcagcagaagaaaagaaataacaaagatcagagaagaactaaatgaaattgaaacaaacaaaaaaaatgcaaaagataaatgaaacaaaaggctggttttgaaaagataaataaaactgatagaccattagcaagattaaccaagaaaagaagagagaagatccaaataagctcaactggaaatgaaatgggaaatattactgataccacagaaatacaaaagtttattcaaggctactatgaacacctttatgtgcctaaactagaaaacctagaggggatggataaattcctggaaatatacaaccctccaaaattaaaccaggaagatatagaaactctgaacagaccaataacaagcagcaagactgaaatagtaattctttaaaaattgccaacaagaaaagtctaggaccataaggattcacagctgaattctgtcagacattcaaagaggaaccagtatcaatcctattgacactattccagaggatagagaaaaagggaatcctccttaaatcattctctgaagccagtatcaccctagtacaaaaaccagggaaggagttaacaaaaaattaaaactacagaccaatattcctgatgacacagatgcaaaattcctcaacaaaatacaagctaactgaatccagcagcacatcaaaaagataattcatcatgatcaagcgggtttcataccagggatgcacggatggcttaacatccataactcaaatgtgatatgccacataaacagaattaaaaacaagaatcacatgatcatctcaatagatgcagaaaaagcatttgacaaaattcagcattcctttatgattaaaaccctcagcaaaatcggcatagaagggatacaccttaaggtaatgaaagctatctaagacaaacccacagccaacattacactgaacagggaaaagttgaaatcattccccctgagaaatgaaatcagacaaggatgcccacttttaccacttctactcaacatagtactggaagtcctagccagagcaatcagacaagagaaagaaatcaaaggtatccaaattagtagaggaagtcaaactgctgctgtttgtttgctgatgatatgattgtatacctagaaagccccaaagactcatccaaaagctcctcgaactagtacatgaattcagcaaagtttcaggatacaaaattgatgtacacaaatcagtagctctgctatacagcaacagcaaccaagctgagaatcaaatcaagaactcaatcccttttacaatagctgcaaaaaaataaaataaaataaaatacttaggaatacacctaactaaggaggtgaagacctctataaggaaaactacaaaacacagatgacacaaacaaatggaaacatgtcccatgctcatggatgggtagaatcaatattgtgaaaatggccatattgccaaaagcaatctacaaattcaatacaattcccatctaaacaccactatcattcttcacaaaactagaaaaaaaaaatcctaaaattcatacggaaccaaaaaagagaccacatagccaaagcaagactaagcaaaaagaacaaatctggaggcatcacattatccaactccaaactatactacaaggccacagtcaccaaaacagcatagtactgttataaaaataggcacaatgaaacagaatagacaacccagaaacaaacccaaatactgacagctaactgatcttcaacaaagcaaacaaaaacataaagtagggaaaggacaccctattcaacaaatagtgctgggacaattggcaagccacctatagaagaatgaaactggatcctcatctctcaccttacacaaaaatcaactcaagatgaatcaaagacttaaatctaagacctgaaaccataaaaattctagaagataacatcggaaaaacctttctagacattggcttaggcaaagacttcataacaaagaacccaaaagcaaacgcaacaaaagcaaacataaatagatgggacttaattaaaccaaaaagtttctgcacagcaaaagaaataatcagcagagttaacagacaaaccacagagtgggagaaaatcttcacaatctatacatccgacaaaggactcatatccagaatctacaaagaactcaaacaaatcagcaagaacaaaacagttccatcaaaaagtgggctaaagacatggacagacaattctcaaaagaagatatacaaatggccaacaagcatatggaaaaatgctcaacatcactaattatcagggaaatgcaaatcaaaaccacaatgtaataccacctcactcctgcaagaatggccataatcaaaaaatcaaaaaaataatcgacgtaggcacagatgcagtgaaaagggaacacttttacactgttggtgggaatgtaaaccagtacaaccactatggaaaacagtggagattcctaaagaactaaaagtaaatctaccatttgattcagcagtcccactactgggtattctaccaaaaggaaaagaagtcattatacaaaaaagatacctgcatacacatttatagcagcacaatttgcaattgcaaaaatatggaaccagcccaaatgcccatcagtcaacaaatggataaagaaaatgtggtatatatatacaccatggaataacactcaaccataaaaaggaacaaaataatggcattcgcagccacctagatggaattggagaccattaatctaagtaaagtaactcaggaatggaaaaccaaacatcgtatgttctcactcatatgtgggagctaagctatgaggatgcaaaggcataggaatgatacactggacatcggggactcaggagaaacgttgggaaggggtgagggataaaagactacacattgggtacagtgtacactgctcaggagatggatacaccaaaatctcagaaatccccactaaagagcttattcatgcaaccaaacaccacctgctccccaaaaacctattgaaattaaaaaagaaaaagaatctcagagaaaaaaataataacgcatggccctggacccatagatctccatgtactacaggagaatgctgtggtacgcacccccagcaccgcccccacaaaaaaatgtcctttttaaaaactttggtagaatatacgtaacataaaattcactattttaaccattttaagtgccctacttcacttcatagatactgatctctccatatcaaattcaaatccagtccataaactggttaaaagtattttatacccttcaaatatacaaattttgtcttaaattatcatatagtttaattatgaatatactcctcctgagaaatggttttaaaattccatttaattcaattactactttagacatgctgagttgagatgctttaactatctcccccaaatcacctgggtgacaaaaaagcagatatttttaaaaacctgaattatagctctccctctccctctccctctccctttcccacggtctccctctccctctccctctccacggtctccctctccctctctttccacggtctccctctgatgccgagccgaagctggactgtactgctgccatctcggctcactgcaacctccctgcctgattctcccgcctcagcctgccaagtgcctgcgattgcaggcgcgcaccgccacgcctgactggttttcgtatttttttggtggagacggggtttcgctgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagccgccatcccatctaggaagtgaggagcgtctctgcccggccgcccatcgtctgagatgtggggagcgcctctgccccaccgccccttctgggaggtgaggagcgtctctgcctggccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggttagcccccgccaggccagccgccccgtccgggagggaggtgggggggtcagccccccgcccggccagccgccccatccgggaggtgaggggcgcctctgcccggccgcccctactgggaagtgaggagcccctctgcccggccaccaccccgtctgggaggtgtacccaacagttcattgagaacgggccatgatgacaatggcggttttgtggaatagaaaagggggaaaggtggggaaaaaactgagaaatcggatggttgccgtgtctgtgtagaaagaagtagacatgggagacttttcattttgttctgtactaagaaaaactcttctgccttgggatcctgttgatctgtgaccttaccccccaaccctgtgctctctgaaacatgtgctgtgtccactcagggttgaatggattaagggctgtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaataaataaataaaaaggaaaaagaaaaaaagagagagaggcaggaggcttagagtcagagaagtcaatgtggtgctgggatctgagaaaaagaacctggaagatggtcagttgctggctttgaagatggaggaagacactgaaccaagggatgcaggacaagctggaaaaggcaaggacacagattttccctggagcttcccagaggaagccaacatctggattttagtcccataagactcatctcagatttgtgagctccaggactgtaaggtaataaatgcgtgtggttgtaagccaaaaaaaaaaaaaaaaacctgaattgtaaaataaaaacaataaatctgatggtaaaattcacagtgacaaggatcagacgggactgtgtatagtttcaaggtggtcaagggctctaaaagtcaacctataatactaacatcaatgacaaaacagaacagctctttctaagcacttctgatatgacaggcacagtacgaagctctttacatctattaactcacactaaatttgaaacagttctgtataaggtaagcagtcttattatgccgactttagagatatttcaatacgttttcaaaagataaaaagtagatggagtagtacacactgctaaggcatcacaccataaagtgaaagtggcaggtgatactgaaaggataaaaacggaatcctatagagaatcagaacttgaatacatcaggtacctcacccctgaaagaacagaagtgagttatgggacgtaaaacatggggagtggttaaaagtctaaataaagcaacatcaaaaaattccatccacccccaagtgcagaactctagcttctaggtatcaatactccagcaacaagccaaacccaaacaatcgggccctagagttcttgattgtaaccacacaccacactaccattcttcagtgaaactggatacaatcaagtcaacacttagctgttcatgagacacacttcaaacaaaaggacatgcaatggtggaatgaaaaggatagttcagacaaatatgaactcaaaaaaagcctgtgtaactacataagtttctgaaaaaaagagacttgaaggttaaaagcattaatagagataaagccaatacacagtgacaaaagacttccatcaccaactgttacatacaaagtaaccaatatacccagtctcaaaatctataaagtatacatcacagatctctaaggaaaaaatgacccatatacaataagttaaagcagggcctggaatacagcaggtaccatataagagttagacattataaattctctttcagaaattcatagatctagaagataaagaataagtagataaagaagataagaataagaccagtctgggcaacatagtgagccctcatttctacaaaaaaaaaaaaaattaaaaaattagccaggcatggtgtcacaagcctgtggtcccagctacttgggaggctgaggtgggaggatggcttgagcccgagagactgaggctacagtgagctgtgatcacaccactgcactccagcctgagcaacagagtgagaccctgtctaaaaaaaaaaaaaaaaaaaaaaaattaggaatataagaatattactcaagattcagtcgggttaaaaacaagggaattctggggaaatgatggcagtgatgtaattttttaatctcctcgactctccccataaaaaaaaagtaggacagtaaaacctaatcaccactccccaccctggaaaacatcaataacaaacctcaaaatatgactgggtggaaaaaactatgagtggttctgagagcagaattaaatcagtatctttattgtaggaaacaaggcaacttaacttccaacagacctgtaaacaaggaggccccaaatcgccaaaagctgtccagcatagaatgccaagccaatctgagaaccgcagccaaaactgggagagggttctttctttagcaaacctctttaagatgaattccccagggctgctctgaaccctgccttccctagacctggctcctcagattttctcacttccctctctcttgtctaagttaatcagaggctatgtctgttggctaaaaataaagatccacaagtacatacaaaatgtttgttcttgattttaaaaaataacgagcagaatcaagatacctaagaagctcaggtgatgaacacctagcaaatatcaatccttcatttcctcctccctcccatagctaccaaaaaaacgctataataaatgttgacacagaagtttggtaaactaactaacaagataattcagagtacttgaataatttatgtgtcatttaaggtgtgatggcaattccttaacatgagttatttaaatgtttgggattgtttttacatattaaatgactaaataaataaatctaaattcttactttcaaaaaaaaggcaagttgagtccaagaaaaaagtgatgtgtgcttgattaaaccaactactgaaactttgatatgttactgcttttctctttggggcatggttcagagcagcagccccctggcaggctcccctgcagagaaaatacttgggcagcagtgagagggaacaggaggtcagcagaaacacagccaccagacagtacgagaaaaccttctttttctcttaaaaaaaaaaaaaagcaagagggccacatctgtaatttcaacctcagtgacacgcttggggagcatagaatcatctcaaaaacaaaattggccaggcacggtagctcacgcctgtaatcccagcactttgaggtgggcggatcacgaggtcaggagtttgagaccagcctgaccatggtgaaaccctgtctctactaaatatacaaaaattagccaggcatggtggtgtgtgcctgtaatcccagctactcaggaggctggggcaagagaatcgcttgaacctgggaggtggaggttgcagtgagccaagatcatgtcattgcactccagcctgggcgacagagcgagactccatctcaaaaaaaaaaaaaaaaaaaaaatcaccacatgtcatttcaaattgaacaacaaagccgtattttttggggaaaaaaagagaaatgtctatgtcaaatcaaaaacataattaattagcagtttatagaaaaaggaccacttattttaggtagcttcagaggctaaaacaagaaatagtgaatggaagttagaggagggcagattttacctaaattgtaacgatttttctggtgacagcaactgttcagaagtctaatgcaatgccttgagaagcgtagggttcccagtgacttgacatgtttaaggagaatctagtagtaagtatatttgctagacatgaggtaagagaatttccagtattgcaaaagagaaggagttagataagttttcttccaactccaaaattatttggttttgtttctcttgtgcaaccaataaatataaactaaatttgaagatgacagaaattgtgcatattttaaggcaaagtatggtggtctcagaaaggtagagaacatgctgtttgcagagtgtttgtctaaaaagtcgatccagaactggagtttctgaatgaaaaaccgcaacctctgcctcccgggttgaagcaattcttatgcctcaacctcctgagtagctgggattacaggcgtgcacaaacacgcccagctaatctttgtattttagtagagatggggtttcactgtgttggccaggctgctctcgaactcctggcctcaagtgatccgcccacctcagcctcccaaagtgctgagattacaggcgtgagccaccatgcccagccaaaaaataatcttaaaaaaataagtgaggaatgtatcagtcagagaaaagtgatttttaccttttttcccttcatttcaaagatgaatattagcattgtaccaccaaataagagaagatattgatattattttttaccaaaataaatgggatcgttagcaacccaccctcttcaaaaaaagcaaaaaggaatcccctatcacttgttcatacaaacctgactctagagaacggagtgtcatatcaaagaaaattcttaggttactcagtgtcccagacacagtggttcatggagcacaagttaagtcctctcttctgggtataggctgggccataattagtttctccaacagcctaagctactgaaatgtaaaaagaaaataaaaactgggcaaaattaattgttcttcagtcttccagtatacaaattaaaaacttagatatgggtatagcaggaacaaccatctctaagaaatttttaagaagtggggcgtgaaattaattgagtcactcaaatctcaactatgggggtactatcttagggaccatctctctatccttcttgggtgtcagagggaaagagtatgtccatgtttagaaactctgtgctaaaaccataaaaccagttaccagacagtaggaaggaagtttcctggaatggatatagaaaacaaaaaaatcctagtgactcccaaattccccccagccctgggacccacagaatccactttaaacttcctatagagaaaaaaattcatctacaacacattcctatataatcaactcattattcagagctccttcctagtaacatgtcttaattacctaaaagtctctgtgatggttaatactgagtgtcaacttgattggattgaaggatgcaacatattgttcctgggtatgtctatgaggttgtggccaaaggagataaacatttgagtcagtggactgggaaaggcagaccccccctcaacctgggtgggcaccatctaatcagctgccagcacagctagaatcaaagcaggcaggagatcgtgaaaaggctagactggcttagtctcccgacctacacctttctcccatgctggatgcttcctgccctcaaacatcaggctccaagttcttcagttttgggactcagactggcttccttgctcctccgcctgcagatgacctatattgggaccttgtaatcatgtgagttaattcttaataaactcatatatacagatagaaagatagatagatattccattagttctgtccttctagagaaatctgactaatacaaccacttagcagctgtgtaatactaagcagtttaacctctcaaaaccactgaactaaaatgagcataaataataataataacattacatgggccctgagatttaaatgaaacttaaaaacttaatatcatgcttggttcacagaagtgctcggtaactattactcattatcatcacagttttactattattttaagatttttaaattgcaaactttcaagatgtttctagatatcatctgaaatatcttagtactaacagattaaacaatactaatatattaactagtttagccactgtacacaaattcagaattttataaacctttgaatgtttataatccttagaatatttttcctagttatttttgggaaaatttcagaatttttaaaaattgaagtgattacacccaccatccacctatcaaatggctattaacacacaccagtagatgtggtcaaaattgtacagactcataggaaaatagaattgatttggattcatttttctttcttttttatttttgagacagggtctcgctctgttacccaggctggagcacaatggcacaaacacagctcactgaagcctctacctcccaggctcaggtgattctcctacctcagcctcccaagtacctgggaccacaggtgcatgccactacacttggctaattttttaaattatttgtagagacagggtctccctatgttgcccaggctagtctcaaacttctggactcaagcaatcctcccacctcagcctcccaaagtgctaagattagaggcgtgattagattagagccactgcacccagcctgggattcctttttctacattccatttcatcttatttcacatttctaacacaaagtataaaacaaaaaaaaaaatgtaatggttagtatttcgaggaaaattaatctatacttcactggcaccataccttcctaggagaaacacaagcaccttaaatccagcactttgggaaaagcacagcaaaatatgtggacccagttagaatccgagaggcagaccagctgcttgagtactccccttccactgtctgcaaccctctaaactaaagctaatatccttgtggagcctgtgccatctgataaacacaaaccccaggtgtgaattcaacaagtgctcagcaaccggccaccatgggcatcatcgcataacgtcccgggtggatgacagtggagagggtaatgcagtcactgcttcttggagatggcaatcaagaaaggcagaccaacacacatcacttgcagaatgaaccataatacaaaaccattttttgagaagtgacacagactatacaggaccccagttcaggtgaaggaaatgtcactttctgatgaataaagagtgagtggcagagaatggtaggactattttgggggacaaggaaataaaaggttttagtagtttagggttcaaaacctgcaatacttactaggggcgtacccttgtaacatcttgtagcctcaatttcctcctctgcaaagtgggaataagtgacttactcacgggactgcaaggcaaactatgagataatctatatggagcgcctgctaacacagcaccaagcaaagtatttagtgcagagttaaaactgaggctgctgggtgtattctcaaattgttcaggatagttttgtccatctctatcagaaaagtttcttctatatcacttccatggttactaaaaacggaaaaaagctacatctacgtgtgtcacaaatgtcgtcatctccacacaggtacacagaccatttattaataccactttttgaaacccacatgtagccagactacttggctctaatttcaaattttgactagtatcctaagtatttgatacctcaatctacattcactgaagtcataagttttaatgtgatcagaataactgacttcaaagtggtctaattcaagaagctccaactttaaagttgtaaaaatgctttttgaaggttgcatttgtagaaatgaaatttgaaaagactattaaatattcaataatattaaaaggcaattacaactcctaacattctgtttgctttaggcaaggtaatgtctgtaacaagctaaggagcaaattaaaacgccagggtccttatgttttataacaacacggttctaaactctcctcatcatactaacagtatttaaaagattatacactgcctgttgtaagtcactcggacagctaatcattggaaataagtgaattaagaatcggtattaaaatacactggcttgtttttcaggtggagcacagtgagtagactggagaaagctgtgaccaagatgaactgcagaaaaggaagttttttctagtaacaacacccgtccctaaataagcaacctcttcagtctagtctagtaacacaactctgatcatctaagagatgtgttcaatttccctaagtcttcttgaaatctaaaataatttttaaaaaatgaggaagaagaaaaaaatctgatttttcccaaagattgaaatcaaacaccctttaggtgtataactattgctagtacaaatatcacagtaaatacatttttaaaaagtaccatgggtaaaatttcaaataaggtataacaatatttgatcaatattttcataacatactatgacgtaagccttcaaaatggcaacagatgcccaccttgagttcagttccagaaaatattttgtcactctagaaaaattctctctcttacttcctccaattagaaaacaacacatcagcaccatgcttccacttcagcttcgggggtgggaaaatcaaaagctaaattcactaattggagtcgtttgttcatttaagaggcctgaagccatcttctccttctgcctgctttaaatatttgctcttctgttttacaattatgtataatactttgtttaacttttaactgtaaattgcctcaagtctccttggaactaagcaatgacaaaatctcaattaattcattctctcttttggaaaataaaatgacactttaagtttataaagaaagactagcatgctgcctagttcctaagtaaagaaaccttcaaagaagaggccttaagagacatggaattaaatgttacagctgcaagtgcactataattaattacaaattctcatcgatttttattaagaggtcaatcatctgctgatagccatggaacgacagttaacgggggttggtgcaagcactttgatgcctgctgaccctcctctagtgagcatgttgtatgcccaagagaaggctctccatggccctaaaataccactcagatatttttcttatcaaacacccatctgagtttgagcatatctttttattctatttttttagcacatgtctgtagcagccagagagtttaagaataccttgagatgaagtatagacatccctctaaaaggctatgactacaagtcatttgcacttagtatgaattaatttattcagataatcttacttcctttttccacttagctgagattttaggaatagagattttgcatagagtaggtacagaaagaggagataacagtgctgaacatttaaaaagcctagaaagaagcctgtaatcccagcactttgggtggcggaagtgggtggatctcttgagggcaggggttagagactagcctggccaacatggcgaaaccccatctctactggccagctgcagtggctcacgcccgtaatccaaggactttgtggggccgaggcaggcgggtcacctgaggtcaggagagaggagaaaatgcagtataacaaaaagggagttagaatgtataagaacatttcattttccataaagtttggagtcaggcccaacatgctctcaagtatgaaatacagaaagtacaaggaggaggaaaaattctaagagaactgaagagaactgtactttaagcctggctgcttcatttactgctctccatctacaggcaatgaataaatgtatccacccctaaaggtattctaatcataataataaaagctacctagaatgtcaaaaggaattttcatatcacatatacattgtaaaattaagttttttcaatgtattaaaaaaaagactgaaaagaaatagaccaaaatattgatttttttctttaaatgatacgaattggggtgatttccccctccttttattttttccatttttcagttttatataacaagattattttacttccatgatcaaataaacataaacattaatgaaaaggaaatatgtattatttaacagccttaaattgtgtctagtctaacgcagggcatagagagaaggacagacagacagataggtatgtcagctttaattacaatttattccaatgtttagaatagtaaacacaaatatatactttattcaaacataatttaaattaaatattctttattaattgaatttatttctaactggcattagctacaaaggatgttatcaaatgaaatatttcttagtttttgataacatgagaagctgacaacttacaataataaaatcagtatcatatgctaaatacaaaaatctaatagttctggatttaatatcttccacaatataaaaagcaatcatttcagaaaagaaaccgttattaaaaagaagaaaagcttttgccatatggaacttgggttgctcagcctttttctgaaaagatgtctcaacttcatctgatggttcatattttatcattttctttgacttatatgaacttgaaggtcacccagataaagtaaaactttattcttttatattaacttttatttgatttggagttagtcaatcaaaacattacttgtttgaaaatatagacatggagaaatctttaacaagcaagatatgacagaaattaaaggctattccacaaaacaaccctgccattcattcactgattcattctttcaacaaaaatatactgacccccttccaaatgccaagcacttaattagaaacacagtgggcactgtccattgtttacccaaaaaccaccccactctttcctagcatgaagaaatactgtgatttgctgatgtagcaaacacagaactcttgatttcagggagaggagattgccagagccggggaataaatcatgattaatctaaacttaaaaaaaaaatgtatccctcatgggcactggccactctaagaacaagccatgtggcccggttttggctaatgacctgtaaacaggtacactcacttctcattattcatatattccatatttgcaaattcacttattcacttatatttatctgtaactccaaaatcaacagtcacagcatgtctgcagtcagttgtggacagaagaggaaaggccaaaaatgtgtgtcgcccaatatgtatgttcccagctgaagtcaaacaagaagacactgccttctcagctctcacagtgtaagcgtcctttttgcagaccacttggtgctctgtttttctcatttttctcgatttgactgtataatatggcccctaagcacagtaccacagtgctgtctcgtgtccctaagcacaagaaagttgtaatatatgcctcacagagaaaatgcatgttttagataagcttcactgaggcataagttatggtgctgctgaccctgagttcaatgttaatgaatcaacaatatatattaaataaggtggccgggcatagtggctcatgcctgtaatcccagcaggagtgtgaggccgaggttggtggatcacttgaggtcaggagttcaagaccagcctggccaacatggcaaaaccccatctctactggccaggcgccgtggctcacgtctgttatcccagcagtttggggggccgaggcaggcggatcacctgaggtcaggagttcaacaccagcctggccaacatggtgaaacctcatctctactaaaaatacaaaaatcagcagggcatggtggctcatgcctgtaattccagctactcgggaggctgaggcagaagaattgcttgaacttgggaggtggaggttgcagtgagccgagatcgcgctgttgcactccagcctgggcaacagagtaagactccgtagcaaaaattaaaaaaaataaaataaggtgtctttaaaaagaaacacataataaaacaaggttatgtactgatcaggtgacaaatatgttgtgactagaggctttcaggaacctaatcctgtatatctactaggaggaatgaatggctcagtattggctaattcagttttcacagtaactttataaaacatacctactggaaataataaaaatgaactacatttctaatgagagactttttttttttttttttttttttttttttttaccaattttcaaccttctcagcacaagacacaacatgagagtaaatgccaccactctgttacatcaaatagccaacttccaatttttggatgagaaaaataagttaactatttgtttaagccactacagtggaagtgtattcacaaagatgtaacaaaatggtgcttcctccttgtcagtaaacagtacagtggtcctgaaagaacacagcgaagatgttctacattctagcataccaagtcttacatatgctgcttattttctagtcaaatagagcagcacgtgttaatacttatatttctgcccttcaaaattaaggtcaaaagatcggcaataatgtgaactggctaaaatctaatttttttattgttgttgtttttgtttttgttttgagacagagtcttgctctgtcactcaggctggagtgcagtggcatgatctcggctcactgcaacctccgccccctgggttgaagcaacaatcctgcctcagcctcccaagtagctgggattacaggtgtgcaccaccacgcctggctcatttttgtatttttagtagagacggggtttcaccatgttggccaggctggtctcaagctcctgaccttaagtggtccaccagcctcagcctcccaaagtgctgggattacaggcatcagccaccacacttggccttaaaatccaattcttaataaagttttggactttattattacttagaaatatgcctagcttctcaaaaaaactattttgacacgtgataaaggaatgtctggaaaacagatatggtctgattaagatataaatatgatggtataaatattacagtattacatatatatacacacacagctctctacgtgtcttgctatttcatattgatagaaccgatcttatgttcatattgatggacattagtgttgataacaatgttttaagctattataaacaagcagggcacagtagctttgggagcccaaatcctagcactttgggaggccgaggtgagcggatcacctgaggtcaggagttcaagaccagcctggccaacatggtgaaaccccatctctactaaaaatacaaaaattagccaggcgtggtggcaggtgcctgtaatcccagctacttgggaggctgaggcaggagaatggtgtgaacccaggaggcaaaggttgcagtgagccaagatcacgccactgcactccagcctgggcaacagtgcgacactccatctaaaaaaaaaaaaaaaaaaaaactaaacataaataaaccagtataaacaacattacaatgaacacatacttgaactgtgcacttatacaattctttccaaaactttctggtctcagtcctgacttaaaaattactgaaggatcttaaagaggctttacttaggtcgacttctctactgatatttaatgtattacagattaaaattaagacgttaaaaaaataacgtattggccgggagtggtgtctcacgcctgtaataccagcactttgggaggctgaggtgggcggatcacctgaggtcaggagttcaagaccagactgggcaacatggtgaaaccccatctctactaaaaatacaaaaattatctgggcatggtggcgcacaactgtaatcccagctactcaggaggttgaggcaggagaatcacttgaacccgagaggcagaggttgcagtaaaccgagatcacaccattgtactccagcctgggcgacagaggctttgtctcaaaataataataataacgtattaattcattcaaaagtaagaatcctattacatgtcaacatattttaataaaaaataactaaatttttcaaaacaaaaataagttagtgaggaaagtggtaatgttttacttttttgataatccttttaatgtctggcttaatagaaagcagctaattttttttatgtttcttcattcaatctactgcaatgtagcttctggaagacccacagtatactcatgagataataagaataaaaaaggcaaataattctttttttttttttttttgagacggagtttcactcttgttgcccaggctggagtgcaatgacgccatctcagctcaccacaaactccgcctcccgggttcaagcgattctcctgcctcagcctcccgagtagctgggagtacaggtacctgccaccacacctggctaattttgtatttttagtagagatagggtttctccatgttggtcaggctagtcttgaactcccaacctcaggtgatctacctgcctcagcctcccaaagtgctgcgattacaggcgtaagccaccatgcccaaccataattctgaattattatcatgaaaatagttttcacttaaatccctgaaagtcccatgggtactcccagaggcctccggactccactctcattccatttctttaaagtatgtattcctagaagtaaaactgctgagttgcaagaaagcacaacttgaacaattttgcatattgacaaacaggtctccaaggcagctggaggaatttacactctcacagccatataatgagagttcccctaaatctgtatctcatcacctcttgataccgtcatttcacattctgccggtctgatgggtgaaaatgttatctcaatgtgctttcccttgacaaatggtcagggtttgagcatcttttcatgtctattcaccatgcataatttcccttttatcaactgcctgttcatagcatttgcatattttctactgagttttcttagtgaatttaatcatttgttgagtgcctgttttacaaactcatttctcacagactgtgtctgtatttcacaactaggcactatgaaagaatataatactgtaattaaatagcttacactagtgccacgtggcctggaattaaaatttagttgaccactgtgatggttgatactgagtgtaaacttgattggattgaaggattgatcctgggtgtgtctgtgagggtgttgccaaaggagatgaacatttgagtcagtggactgggaaaggcagacccacccttaatctgggtgggcaccatctaatcagctgccagcacagctagaataaaagcaggcagaaaaatgtaaaaagagagactggcctagtctcccagcctacatctttctcccatgcaatgcttcctgcccttgaacatcagactccaagttcttcagttttgaaactcggactggctctccttgttcctcagcctgcagatggcctattgtgagaccttgtgattgtgtgagttaatacttaataatctccccttcatatatatatatatacacacacacatatatatatacacatatatatacttaataaactcccctttatatatataatataatatattatatattatatataattatatataatatatttaatatattatatataatttaatatatttaatatattatttttatatattatatataatatatttatatagtatatataattatatataatatatttatatagtatatataaatatattatatatataaagcaatctccctgtttatagctcatttataacaatcctcagaaatggaaatttgtaattgatcaaccttgactaaacaagaagattcccaatggcaataaactataacatctatttccccccagagaaaatgagaaagaaaacaatattttatatatatattattaagtatatatatacttacacacacatacatacacacacacacacacacacacacacacacacatatattccattacttctgtccctctggagaaccctaactaatacaaccatttagcaactgtgtaatactaagcaatttaatctcttgaaaccactgaactaaaatgataataaataataataataacattacatgggtgtaataagaataaaacttttaaaaacttaatatcattcttggctcacaggagtgctcagtaactattactcattatcatcacggttttattattaagatttttaaattgcaaactttcaaaagctgtttctagatattatttgaaatatcttagaactaatagattaaacaatactaatatattaaacagcttagcctttctagaaaatcagaattttataaagctttgaatgtttataactcttgggatgtttttcctggttattttcaggtccttcacatatctaacaatgaaaaattactgaattaacgtaacagttgaagttattcgcagaagtaaccataggtatagctaaacagtaactacttcttagcctgaaagcaaccaaatatgaatacaataacaatgaacctaatgtttctggaaaaatcattaatccaactgacttttaaaagttttgaaaaggccgggtatggtggctcacgcctgtaatcccagcactttgggaggccaaggcggatggatcacttaaggccaggtgttcaagaccagcctggacaacacggtgaaacctcatctccactgaaaatacaaaaattagtcaggcatggtgacacacacctgtaatcccagctactcaagaggctgaggcaggagaatcacttgaacctgggaggtggaggttgcacctcccagggaggtcgagatcacaccactgcactccagcctgaggatcagagcaacactctgtctcaaaaaaaaaaagaaagaaagaaagaaaaaaaaaagttctgaaaagtcaacgtccatacccaaatagatggaaaacttctacacatttttctcatatctcagaaaaatattcagagataatacagtacattaaatacttttatttttctacctagataataaggaaggctgagaaaatcttaatgcatcaccttcatcctctcctatacacactaggctaatacgaatagttttcaatacaggagaaaaaagataattaactcttttcaggtaaactaacccatttcactaaaaagcaatctccctgtttatagctcatttataataatcctcagaaatggaaattcgtaattgatcaaccttgactaagcaaaaagattcccaatggcaataaactataacatctatttccccccagagaaaatgagaaagaaaacaacttttgaaatgtcattacttgaatgctttttaaaaactatgtgatattttaaatggaaaatgttaattatcttttaaagaccttcttctgaatgccatatccttcctattgttgctgttctttcattactggtcccataaatacactaagagtctttttgtaccatggctctggtaggttctggatatataaggatcaataagacagttcctattttcaaggactgttgatgctacgacagaggcagaatagcaggaacagcaataatgctcaccaagcgcctattatgtgatgtcaggttctgtgctagatacctgtaacatgcagttgttgaaaagtaggaatcttgaaattgagatatctgaagtaatagttactgtgctggggtgtggccatgggtatagccatgggctactgtcctaggctatggccatgggaagaggtagctagggtaaggtaaaggcaaagagaattggaagtggggacaaacagcccaggtgtcagatggatgctcaattcgctaagaatgatgttgccagtaatgataaagaaagaaaaagtgagccatgaatgttaaggaataactggaaggtgaggtaatggggagtagaatggcaaatgcttcagaggagctggcaattttgaggaagaggaaaaatggtgtaaatggatgaagaggagcaaaactgacactctctgactctctaggcctctagtcttaaaggacttactctcactggccagaactcagtcacatggccatgtctagaaagtcggaacatttcattctttagctgggcttactgccacctcgaataaaactgaagttcttttattaaagaagtgcccagcgaatatctggtagataaccagcagtttttccataaaaaaataaaaacaaaacctattatgatacctgaaattattttaacaggtataaatgataaacttgggatggcattaaagtgattaaagacactacctggtgagaaacagaggcgaacagagaccaagtttatcgatgcttttgtgtaaagttgcatacacaaaccgcaatcaagtcaaaacagaagacttgaagatgttctcataccatgaaggaagaccaatgaactcagactggtcaatgtactggaggcaacaaggacttccttagaggagtgagtacatccagtacctctttatatcgccatccatgtctcccgcagtgccctgcatattttatacagtgaataaatgtttgctaaagaaacaaatgtgtttacatatggaagtattttcaaccaggccttcaacaccaataactgttgacacttttagaagaaaatcaaagcagcccctgcagcctcagactcctccagctgtcacctatgggatccagcctccaggccaaccgcaggctccaggccagctcctgtagccccagacccctccagctgacacctatgggatccagcctccaggcccaccgcgggctccaggtcagttcctgtagccccagatccctccagctgacacctatgggatccagcctccaggccaaccgcgggctccaggtcagttcctgtagccccaaatccctccagctgacacctatgggatccagcctccaggccaaccgtgggctccaggccagctcctgtagccccagacccctccagctgacacctatgggatccagcctccaggccaaccgcaggctccgggccagttcctatagccccaaacccctccagctgacacctatgggatccagcctccaggcccaacgcaggctccaggccagctcctgtagccccaggattcagactgaaacccaaagactcagcctccgggcccagtccagccccatgtcagccgctacaactctaggttccaggctcactagaatgccaggtcagtcctcacagccctagactccaggccagcacccatggacccacgctccagcaaacccaggacccatgcccactctatagactcagagtccaggcctgcctcagtaaactcagcatccacagccttaggcaccaggctagcacctgtgaacccaggctccagaccaagccccgtggacccaggctcaccccagcaccaggccaatcccaggctctaggctggtccctgtgaccccagactctaatagacccaggatccaagctcattccagcagacccagggtccaagtccaccctggtcaaccctagtgccaggttgccccacagatccaggctctaggattgcccctgtggacccaagatccagacaggtccccacaggcccaagaaccaggtctctttctgcatactcaagctccaggctcaccccagcaccaggctaacccccatggactcaaactcaaggcccatccacatggacccaggcacccagacaatcctagtgccaggctggcccccacagactcaggctcaaggcccactccagggccaggctggccagacttcaggccagcccctacagacacatgctccaggctcgcacccatgagctcagtcaacagactcacccagtggacctcaccaccaggtttcccccatggacccggggtctagtccttcaaacccaagatccagacctgtcccagtgggcccaggctccagacccacccccatggacccaggtcccaggcctgcccacctattgacccaggcacaaggctagcctgcccaagaacttgaggtagccctccttccctcaggaggcggaaagaaggcaaattaccttacaggcatgaaagacaccaaaggaatcatcaacttggcctctgtttacacagcaggatctaccagctgggaatgcatttgaatgagtgttggggatgggtagatcagagatctcaatattcagtaaaaagaatctttctgagaacgttctcctcccaaaagggcagaaggccacaactactgaaacacaaagcctgacttcatttgagagactgactccaccccagaccaatgaatcagaatctacatcttaatcaaatgtctaggtgattcatattgcactaaaggtagaaaagcactggtctaatatacaacaacaacaacaaaaagccatatctgaaatggaattacagacaattattttggatatgaagcctctttggtttaaaaatgcattatcctttaaactgcaggcagcaagaggtaatacatcacatgaaataaaagctgttatgatgctttttggaagatgatcaaaatatcaagatggggtcaggcatggtggctcatgcctgtaatcccagcactttgggaggccgaggtgggttgatcacttgaggtcaagagttctaccaaagttaacaaataactcctttcagcaaaaccctgctcctttttcttaggccagaataaatgccaacatgtttgtttctcctgccatgttaaatatattacaagcttgctagctttcactctgttattgatatcttcaatacatgaagaggaagtgcaagataaacagaaacatttatagtcaagggaaacacaaaggcattaaataaaattaaaagatctggaatggtgagtctgattagtcagggagcagacacctggtgtcttagacaaaacaaccattaaaaaaaaggaggatggaaaatggaatgactcacttttactatatatgtatctcatatgaagtattttcttctgggtaaactagaaaataaaatgcaactattttggagcaatattataatatggaagctgagagataattatccttcagatatctttttctgtcaggctaaataatgtgtttcttcatctttccctaaaatcaggtctcataaaccttcagagtttccatttcatgtataggttgagactaaatttagaaaaatcaggtcccataatgttctaaacagagatggacacacacacaaaaagaaaatgtaaccattgaacaaaattagattatatttagaaacagaattttttttttttgagacagagtctcactctgtcgcccaagctagagtgcagtggtgccatctcggctcactgcaacctccgccacccggattcaagcaattctcctgcctcagcctcccaagaagctgggattacaggtgcccgccaccacgcccggctaattttttgtattcttagtagagacaaggtttcaccatgttggccaggctgttgtcaaactcctcacctcaagtgatctgcccgcctcggcctcccaaagtgctgagattacaggcgtgagccactgcacctggtctaaaaatagaaattttatgtgtgtatatatatcaataaaagtatcacaattactgtccttaaaaagcctaggtttggaagaaaaattataatgggaaacatactgtgacagctcagtaaaagacaactaaggtagttaactgattctcctatttactatctgtcaaaagacattatttgtagtagctgaattgagctgattttcttcatacctcagaaatatttcacccatgggacattacataatattctctaggacttacgcagtgataaatacctgaccaaatttataataaagaaatctttcattcatacatttaaaaaaaatgaaacaaatcaaaatcatgcaggataaagcttaggtattttctgcctaagaattttactgaataaaatcttacaagactaggtttttcctatgtgctcaaatattgaaaatttatcttttgtctccagcatgtctttcaaactgaatttaattggtaaattatttaaactatgtgcataacacaatacttacttgaaaattgatctgagtgaatcatgagcatgtaacatttgagacagagaactacatgcgaattttaagtactaggaataaattgaaatacttcggatatgcccatttcctaagtatacttaggatatacccatttcctaagtatttcaatttattcttaatacttaaaattcacatggcactacgggcttttaaagtattttataaatataaatattttaaaaatattaaaatgttataaatattaagccttactgcatttctgctcccacctcaaatctgtgtatactgcattaagtcatattcctaggagagaaaggacccaccttctgtaacttaaaattaacactagaaatgtttccagtaaaggaaataaaaagaattatctgagtgaaagaattcagtaaagaaccccgtataaatagtactgccctccaaactgtgcattatattgtctatgaacaagaaatgaaatggacatggaccatcaaaagcgggaactgtgtagagcggtgcttttcaaacaaatcacttttttaaaacaaacacaatcactaaaaatgcagattctaactcagtaggtctgaaagtggggcttttctgcacttgtaacaagcttccaggtgatgctgatgcctcctgtccacggaccatactttgagtaggaaggcagtagaacacatacacctttttttttttccgccactctttcgcccaggctggagtgcagtggcacgatctcggctcactgcaagctccacctcttgggttcacaccattctcctgcctcagcctcccaagtagctgggactacaggcacctgccaccacgcccagctaattttttgtatttttagtagagacagggtttcaccgtgctagccaggatggtctcgatctcctgacctcgtgatccatccgcctcaaccttccaaagtactgagattacaggcatgagccaccgcgtctggcctaaaatacatacatgttatctggaggtgcgaaagcccagtgccagaagaccaccagttaggtttatcggcttgctacagtaaaaggagaatgcgtactctaggaaactgggcatttctgcaaaggggagttaaaatgaacttgctatagagattgtgttttctactgggtgatatgggagaaggtaaagaaaacagaagtctgttgtgaattcagtgttgtcaggaaccaaagattactggtagactaaacattttaataatttttatccagggagcaggaggaacaaagaggcgctaaagttgataaaaaagcaattgtcagccaggtgcagtggctcatgcctgtaatcccagcacttttgggaggctgtggcaggaagattgcttgaggccagatgttccagaccatcctggccaatagtgagatttcacctctgttatcttttaattgttaaaaaaaaaaaaaaattgtcagtcactcatgttactgaggagaccatataagaactgagactgacccaagaacaacaaactatgttttacctcttggtctctatagacaatatgacaatgagagaaagggtgggagaaattgaccacttattacatagtttacccctcccgccgtgtatgatgtgaatcctgttatacattataagattgttatacaatcctatgttatacaatgttatactttctgatataaaaaaaaaaaacctttttgtgcacagaatatgaaaaagggactacacaataagcgagagtcttcgaggtataggccagtacattaatatcctttggggaactacctatgttatatgactctcatgaaaaacgcacaagaaaagcagatagagaatacagcaagcagactgctttgcacacggtaaagggcagtgctcagaaatactattaagaaataatattaccatttagaagcttcctttaaatgaaaataactgtggataaatatcccttctaaccaccgcatgaggcaacgtacttagcatatggtatacggtatgagctttagacatggactgagaatcttggcttcacacttaatatttataatatttagaggacaacttagttaacttttctagcttcagacttcttatctataacatggaggcaacactgttaactttgttttaaggagtaaataaaatatgcaaaacatttaatgtattaagtacctcacagttggccctcaacggcatttaaagtgaacatggtaccaaaccagattcaaaatgccagtttaacatttattcatcccacagatatttgttaccatgtgccagacattgtgtttagaaagaaatgtaatattttaaaagtacctggcttcctggagtttacagtctagcataaggacaattaatctgacaatagaaagcacaggatattaccagaacacagagcagagagacctgaagcaaagcagcagtgtgaggcagggaagtctcctcggaggaagaaaacctgaaggaaaagtaagagttctgaaggacttctagttacagctatgtggagaagtcagtaatttgttactatataaaacaactataaaatttggaaaaaattatattaaaaataacatttcagagcactgaaaatagaccaaagcagagaacaaatgaaaaagcattcattcttgaaaatcacctcgaggttgaagtcagtttctggggacctccttgtagaaagcattcattctggaaaatcacctcgaggttgaagtcagtttctggggacatccttgtagaaagcattcattcttgaaaatcacctcgaggttgaagtcagtttctaggggacctccttgtagaaaacattcattcttgaaaatcacctcgaggttgaagtcagtttctaggggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctggggacctccttgtagaaagcattcattcttgaaaatcacctcgaggttgaagtcagtttctagaggacctccttgcctcaggctgcttctaccctacactcagctgccgtggtgaaaactttgacaaacttggggctgtctgcaaaagccagtatctttgctaccagaaggggcagatctgctgcgggatggggggcaaaactccaggtctttatcagctaaagtagcaaatgtggtgggagacaaaaagggaaaaaccttacctttgttccctaacgctatagtccaagttggggcaagtggtaggaggatcccttgagcccaggagttcacggctacagtgagctatgatcatgccactgcactccagcctgggtgacagagcaagattctgtctccaaaaaaaaaaaaaaaaaaaaaaaaaaaagcaaactccataagaaggaatactggaaattgttgatatgtaggtaaatataaaagcctgtatattatatactgtatttttaatttctttacaaatcctaagattggcttaaggtaaaaaccattattcagtggataacatatatagatggacagtacatgacaaaaatagcacaatgcagaatggggagggatgaagctgtatgggaacaaagttaccatacttcactagattaagtaactataaaactttcagattatgctatgttcaagattcatcctgtaatccttaaagcaatgctatccaacagaaatatgagaaccataaatataagtcacatatataatttttaattttctagtaatattttaaaggtttttaaaacatgaaactttaacaacatattttatttaatccaacatatccaaagtattatgacaacatataatcaatacaaaaattatgaatattttacattccctattaagtcattgaaatctgatttgtatttcactttagcacacataaattcagactagccacatttcaagtgcacaacagccacatgtagctagtggctactgcagtgggcagtacagcactagagcaacaacaacaacaacaacagatgacttttaaaaaaatcaacagatgaattaaaacggtacactccaaaaatatttaacgcaaatgtaatagaagaacagaggaagacaaaaaagacatcaaacctatagaaaacaaaaatcaaaatggcagacataaatccaaccatatccaaaattacattaagcatgaatgtaccaaacattcacatcaaaaggaagagaccatcaggctggagttttaaaagcaagcttcagctgggtgcgatggctcatgtctataatttcaacactttgggaggtcaaagtgagaggatcactcgaggccaggagttcaagatcagcctgggcaactaagcgagactctatatctgaaaaaaaaaaaaaaaaggcacagtggcatgcacctatattcctagatacatgggaggcttaagtaggagaactgcttgagcccaggagataaaggctacggtgagctttgattccaccactgcactccagcctgagaaacaaagcgagaccttattgagagagagagagagaaagagagagagagaaagagagagaaaaagagagagagagagagagagaaggagagagggaaaaaggagagggggagagagggagagaaggagagaggaggggaaaggaaaagagaaccaaaaatgcaagactcgaccatattctgtctataggagatatatactagattcaaagatacaaacaagttcaaaagaaaacaaaccagtaatcataagaatgctgcagtgactatattaatatcaaacaaaatacactttaagacacacatattactagagacaaggaggaacatttgataatgaaaagtaacacatttcataatgaaaagctaaatatgtaaaaaggagagagggaagaattttctgagcattaaagatccagaagcaagagaggtgctttcctatttggtactcccgtctccagctgttcatatcacattcccaactcctatcagcacaacccatggcagcatcctataaatctcatcttaccccgaacattcaatgtcttcaaattcctatgcctttgaacatacccttgcactatccataacactgacctcaatatttgcatcagaaactcccactcatccctccagtttcagcttatcaccaaacccttctctgaatacttcaccgaagcttgcaaatacctacaataaagctctcattgctctccaactatcatttgaatttccctccagactttcatcctttttttttccagtttgcagcatcaggttctatcacaaaacatgacacataataggcattcggtaaatgcttgctaaatgaaggataaacgaacaaatgaacaattgaacacatgtaggaaggaccaaggttggtgaaaatgggagttgaagatttttttcacaactcatatcagaggaattaaaatagaatgaccaggaaacatgaaacgcatgaaagaattactttaggcaataataacaataataaccaacatgagaggagcactcactatgtgtcaggtactgtgctaagtatttcacatatatcaattatttcaatcctcataataactccattatgaaggactacttttgagggggtttttagacacaagatctcactgtcttgcccaggctggagtgcagtgtggctcactgcagtctcaatctcctgtgctcaagcgatcctcccaggttcacctcccgaatagctgggactacaagaacacaccaccacatccagctaattattaaattttttgtagagatgtggtctcactctgttgcccaggctggccttgaactccaggcctcaagtcatcctcccacctccaccttcaaaagtgctgggattataggtgtgagcccaccatgcctggccttgaaggtactagtttttagagatggttcaacagcaaaaaaaaaagaaaaagaaaaagaaaaaaaaaaaactcaattagaataaagaaacatttcactaaaagaagatacacaaatagtcaataagcatatagaaacatgttcaacatcatcaatcattatggaaatagaaatcaaaaccacaaagacaggcgacttcaaacacactagaaggctgtagtttaaaaaacagagaatacaggtgttgacaaaaatgagaagaaagatccctcatacttactggtgggaaagtaaaatggtttatcacttaggaaacaacctggtagtcccacaaatcgttaaatactgagtaattatacaatccatataatgagtacaagttttattttagaaagaaggaaaatgttctaaaataggtaatggctaaacaactctgagactatgttaaaaaaaatacacagaactatacaatttaaatgagtgaagtatatgagatgtgaattatatctcaatgaagttctttttttaaaaaactaacttaaaaaatgtttaagcttgaccattataatccagttactcagtgacagaaccagaggctgcctgatcccgtgttcaggattcctacatacatcacaaaatcactaagagaagcatcacaattagctcattttcaaaaaggacttcatctatttctctcaaccaaagcaatacattctaacataagcactttgtgtactgatgtaatatttctcaaaaagttaaacagcatgagaaatttataatattagataaaattacaggctaggcatagaattgcctagtggctcatacctataatcttggcactttgggaggccaaagtaggaggactgtttgaacccaggagtttgggaccagcctgagcaacatagcgtgacccccatctctaaaaaaaaaaaaaaaaaaaaaaaaaaatttaattagccaggcatgctggcaggcacctgttatcccagctacttgggaggctgaggtaggaggactgcttgaccctgggaagtgaggctgccgtgtgccaagatcgcgccactgcactccggcctgtgcaagagagcaagaccctgtctttataaaaaaatctaaaaacaattgtcttatttctaactctgaactactttctatgctttggtgacatctatggtgaaaattgaaaactagcattaacagctagaaagaagcaaaggatttttccacatgaattccatctttcttagctttgcttttatttcacagaaacagaaaataaagaaaacctaatcagttaaattactcctctctggtgtcacatcctaataaataactgttatccttatgtccttcaagaaagaaatgatactagtaggacaatcatgtatgttttctgattactcttatcaataagtacctaaaatattaggcaaactaactcatatatagcacagctatgtagtatgtataactgacaaaacccaagatctctaacacattggaatgtaagtattcatttcctttaagaatagaatccaaacagctgtttctcaccaatatacactgtgagagaactcctgtgtacctccttgccataacgaaaggaagtttaaccccacagtacacaaacctcactgcacacacaagatcctgatgtcagaacaccaatactgaggggcgtacaatgtaaacatacagcaggaacctatggcagaggccgaaccttaatcatttccaccaacctttggaattctgctttggatttcactggaacacaggcttttgacagagaaatcagaatattcgaaaacaagaaatcaccaatatcaggctcttaagtcctattgttgtaaagactgaacaatgaacatagcagcaatcaactcccaaacttagctatgctttattatatgagagcctcccgaactcagctatgctttatgatataagagaggctcccgaacctagctatgccttattatgtgagaggctcccaaacttagctaagctttatgatatttgagaggctcctgaattcagctatgctttatgagataagagagcctcccgaactcagctactctttattatatgagaggctcctgaactcagctatgctttcttatataagacagacccccaaacgtagctatgctttatgatatgagaggctcccgaacttagctacactttattatatgaaaggctcccgaactcagctatactttatgatatgaggctcccaaacttagctatgctttatgatataagagaggctcctgaactcagctacactttatgatataagagaggctcctgaacctagctatgctttatgatataagagaggcaattcggtcacttgttgggtagaacctcctgggacaagcagtcaacagcaagaaagcaattcctgctccctccattttaaaacagaaggctctatttttaccactatccccaagcaaccaaaccagaaccaaatagcatggatcttttggaacgaggaaagctctaaatgccaaagtccaagtgtagaaatatatcttaacattttgctccatccttcaaatgtttcaatgaaatgtttcaatgctgtctgaatagcaacctcaataccaacatctctcatgcagtccaagtggaaatgttccgtttcttctattttccttcagcctgagacaaattgattcttttcaaagagtcatttcaatcatcctcacgggttctcttaaaatagacaaggcaaaaccactggctgttacgtgcctctcacaagttccacctttttcacaagtggacaatgtgcactactactgcgagtggacccccacggtcagacagggaagaggaacccaccatggctggacagggaagacgaacacaccacagtcagacagggaagacgaacccaccacagtcagacagggaagacgaacccaccatggctggacagggaagacgaacacaccagtcagacagggaagacgaacccaccacagtcagacagggaagaggaacccaccatggtcagacagggaagaggaacccaccacggctggacagggaagacgaacccaccactgtcaggggagaggagcccgatcgctgcctctatgctctgccaccacctagtgaataagaacaagaaaatcacatggcaagagcctgcagacgtcaagacacctatgatagacacctaagatgatagggtggcttttaaaacctgattttaagattacaaggttagctaaatatctgaggtagtttaccaggaaaaagaaaaatgtttagaggaagaacttggtcaagagcctttatgagagtgagggtcactatatctcatcatgtaaggggccttaggaacacaccccaaattatcggacagtctagaaaaatactatttactttaggatggaagtatgagttgctcatatataaatgacagaaataaattagcttttgcaaattgggctttataggtatacgtacatcaatatcctactggtacatgtctccatttttcttgatcctatactgtttggaaattttagtgttagcttctcagctagctgattattcattatcaaagcttttttgttcccaacggctcacttactaattatatatcaaaccacaaagctctcgaagtttctgctccctccttagcatcctatctggaccatcagacagcttctggatcagaactggatatacatcatcaacgcacactggactaattcaggataactttcctaagaccaaagaacaaactattatgcaacatcggtttattttgatacttaagataaccagtgctttcatatactcaatgatatggtttggctctgtgtccacacccaaatttcaagctgaattataatccccagtgttgaaggagggcctggtggggcacgactgaatcatggggcacattcccccttgctgttcttgtgacagtacgttctcacgagacctggttgttctcctgccagccatggtgagatgtgcttgcttccgctttgtctttcactatgattgtatgtttcccaaggaagcagaagactgtatggcctacagaatcattagctgatgaaagctcttttctttataaattacccagtctcccatgtgtctttatagcagtgtgagaactaatacactcaacaagtacaaaaactacggcttaaccacagcaacaatatttatttaccaagcatggctgaagatactaaaggagtgtgtcactgtgatgtagaatttctagagattaggaatccttaggatgggtatgctcttcggaaaactgtaccatctctttgcctgttcatggaccactgtcagtctgttgcctgttagaaacctggctgcacgacaggaggtgagtagcgggcaagcaggcattaccacctgagctccacctcctgtcagatcagcggcagcattagattctcatagtagcataaaccctgctatgaactgtgtgtgcgagggatctaggctgcacactccttatgagaatctaataataaatgtaatgtgcttgaatcatcccaaagccatcccctgtcctccagtctgtggaaaaatgatcttccaagaaaccagtccctggtgccaaaaaggttgggactgctggtacatcatatattagctctgtgaccttcttaactatttcagatgataccttttgtgctctcggttgaaaaaccatctccgaagataggagctattttaacacagctatcctaaattccttacttatccatcatggaaaaaaacaaatgtttattattgccaggccctcaagaagtgaatggtctagtaggaaaaatatacctagacagatgtagtcacctgatgggttcttcttgcctgctgcacagatagagctgattcagagacaacagtataaatgacagcagtggagaaagaggttacaaacacagagccagccaagcaaaagaacaggagtttattactcaaatcagcctccccacaagctcggggaccagggcttttcaaggataattcagcaggcagggggacagggaatggggaatgctgactggtttgggatgaaatcataggggtgtagaaaacaggccttgtgtgttgagtcggcctctggggtgggggcacaagactggttgagtcataaaaaaaaaaaaagcaagaaaagaaaagaggagaggggaggggaggggagaaagaacaacaacaacaacaacaagactggttgagtcctgggtcgtgggtctgggtggaatccgtcaatcactagaatgctaaagtctgaaaaacatctcaaaagaccaatcttaggctctacaatagagacgtcatctgtaggagcaattggagaagttacaaatcttgtgatctccggaacaatggctggttatggtctaactatccctacatctcagcagaatttcaggctcttcccatcatcctaatctcatcggctttcattaattttacaaaggcagcttcagtccctgagcaagaagggagttaatttgagggagggactgttttcatccttgctccaaggttaaacgacacactcaattcttcccgtggttagtttggcccacgcccagaaatgggcaaggacagcccgcctgtgagcttagaaggcggagtcagccatgctggacttctctgtcataatcattgcaaagctggtttcatagatgagaatctataataaggtatggtaaaagctaccatagagagatgtacaacatgcagtggtgatgacctctacttgggaatagcttcacaaatgaaatacttagagtggttcttaaagggcaagggttaaaccaggctgacaaggaaaagcatgtacaatggtaaacagtacattcaggggactgtaaatagtatagagtgactgaagcacagagcacaaagagggagacactggggctcaggttagtcagatcagcaggagccaaaaggaggaggagactggaagagaaaaactgagaatgaggtatgcacaatggaggaagataaacaggtgagagcattcacagaacccaaagaaacagaattcaagaactagtgatgagtctgacaagagctatataaaatagacagtatcaaacaacatccaacacccagccctctttctactattaataaaaagactgattgcccagcgtaattagtcataccataaaggagtagatagttgtagattttctcttgagatttcaactgtacacaaatttttcatatattttatttttattttatcttatttatttgttttgagacagagtcttgctctgtctcccaggctgcagtgcagtggcatgatcctggctcactgcaacctccgcctcccaggttcaagcgattctcctgcctcagcctcacaagtagctgggactacaggcatgtgccaccacgcccagctagtttttttgtatttttagtagagacagggtttcaccatgttggccaggctggtcttgaactcatggcctcaaatgatccacctgcctcggcctcccaaagtgctgggattacaggtgtgagccaccttgcccagccccatattttatttttatttatttatttttgaggcacaacctcattctgtcacctgggctggagtgcagtggcatgatcactgctcactgcagactccacctcccaggttcaagcaattctcccgcctcagcctcccaagtagctgggactacagatgtgtgccaccatacctggctaatttttgtattttttttacttctttgtacttttgggtttttccacattgcccaagccggtctcgaactcctgggctcaactgatctgcccgggtcagctttccaatagtgctgggactacaggcgtgagctaccatgcccagcctctcatttttaatagatactattttaaaaagtactgtgaaaaagaaacaaaaatgaaaaagacacatgcctatccttaaggaacttatgtcctaccaaactataaagtaagccataccatttatggatttgtagcaacatgtcatcctgtcaactttattactgaggctatgagatgtattaacattggctttcaaattatttgtattagcaaacataaaattcaagcatagaaattgagtctgatctaaaaatcagcaaattacaattatgaatttgttatattctcactgtatccacgtcctcaaaactctgacattagcaagccattaaacaagaccactaagattacattaattttatactaaagttgtatgctaaaattttcatctttctctgtttcatctttctctgttttcccaaaagaaaaaaaaaggtaaagatcaaaagttatatatttcagatatataatcctaaaaaatgctccattgctaggtgactaattttaagacactgccatcagtttaacaggtcactcgttcatttattcatctaacatttatttacccacatactgtgataggcagtgaggaataagcacagaacagaaacagtgcctgccttcacaaagcttagtctagcaggatagtaacttaagacactgaaacagtatattaagtgccttttacaaatattcttcgcagctataccagctactacttgcatttcaacattttatttcaaagccattatttatttgtttgtttattttttttgaaatggtgtcttgttaggttgcccaggctggtctcaaactcctgggctcaagcagtcctcccgcccgagcctcccaagtaactgggattaccggcacatgccactgtgtctggatccaaaaccatttttttaaaattatttcagtgttaagacaactttaagaaacaatattatgattggtatcggtcattaattgtgctattttatgacttcaatcttttgatgcagtatagtttcctggccatttccaatagaaaattccttgcccctttcaggctactgtagttgagatacaagacttgagatatttttctaagagaaaacaaaacaaacaaagcagccaagagaaacaatatcagccatgtaataaaatacccaatgtactttatttcattatcctaggcaaataaaaaaaaaaccactatgaattatacagtatacaaatatgttttcttcggaaaacactgaaaaacagattcatgtggaaagaaattactttattcctaccactgtctttttcagacacactcaaaattcataaaattcacaaaatctgaagctcataaatcaaaagaaactgttcatacatcatgaacactatactaactttttaaaaagtattcgaggcagctgaacatcatcacagtatcttaagactcatatttccttagattaattcagtgatcactttcaaagcaaagctttttatgaaagctaaaataaaatttctaggtaaccaaggagagtctttcaaatggaaaaaagctgatgatattaaactctaaaaaataaggcccaggcatggtggctcacacctctaaatctcagcactttgggaggccaaggcaggagtatctcttgagcccatgagttcaagaccagcctgggcaacacagcaagaccccatctctatttaaacttttttttttttgagacacagtcttgctctgtggcccaggctggagtgcagtggtgcaatctcggctcactgcaaactctgcccctcagatttaagatatcctcctgcctcagcctaccaagtagctggattacaagcatgtgccaccacacctggctaatttttgtatttttagtagagatagggtttcaccatgttggcgaggctagtcttgaactcctgacctcaggtgatctgcccacctcagcctcccaaagtgctaggatacaggcatgagccaccatgcccagccttaaatttttaaaaataaaaaatagagtatgtaataatcatataaagttctaaaacatccagtagcaatgttcttaaatcccagtaattcaggtgcttttttttttttttgagccagtttcactcttgttgcccagactggagtgcaatggcacgatcttggctcaccacaacctccacctcccaggtccaagcgattcacctgcctcagcctcccgagtagctgggattacaggcatgtgccaccacgcccggctaattttgtatttttagtagagatggggtttctccatgttggtcaggctggtctcgaactcccgacctcaggtgatccgcccatcccagcctcccaaagtgctgggattacaggcgtgggccgccgtgcctggcctcaaatactattttaagattgttcatccataatacattgtagtctgaaagaagaataacctctctaaacagtacctattaccttcatcctctctttttccaatataatggcaaaagacagagttgtgatatttttactgtaatcacagaaacatcaattcaacatatataggattagcatatcacacatttcagcaaatatcaaaatacagatgtttcttcatcctgatgaacaaatttattattaaacttgccaactattttccaaatttataaaagaccataataaaatgtgaggcaaaactgttcaaaccagttaaaatgagtctcgatcagctaaaatgattaacaacgccatcttaaagatgatcccatatctgagcacgtgatacctctgtgatttcagggcacaaatccctctatccatcaaactaaatagaagggttagagaggttaatcgagacagagtgtctgtaacagacttctgcatttcattctccactcaatatacttcaaacatcattgaactatttgttatgttcttatgaatcaatgctcccttcacagtcaagatagaggctagaagccactgtgtgaagtaataaagcttacctttgcaaatcctcatcaagctgatctgatgattaagtctatgtgaggcttcctaaacaactgaagtgtaatcacaactttaattagaagctcaaatggcactgctaaacacctaaataaaacatgagcaagtacaatagccacctgcaacgagcaatgccattttccagcctccatttactataaagagatttttctctattcagctgcacaatcacttgggctacatgatctctggcctagcaatagcagtcaataatttaaaatcatgaaaataaattttcaatctatacttaagttctattatgcactggtggtagtcaaaaatgtcacagactgaataaaaatgaagctcactcatttgctaggctggcaccccattctacccgaactgtccattaagagtcaccattaaaaacaaacaaaactcatatggcaaacttctgataaaccaatttactctatttgtggctgattaagggtgatcctggactacatggcttttttagttcctccctgactaatggaaaattactagaagagtaaggactacacagaactagttgcataaattacagttggccaggtgcagtggttcagcctgttatcccagaaatttgggaggccttggtaggaggactgctttaggccaggagtttgagaccagcctgggcaacatagtaaggccctgtgtcttaaaaaaaaaaaaaatttaattagccagaaatgatggcacatgcctgtagccccaagtactcgggaagttgaggcaagaggattgcttgagcccaggagttaaatcagatggcattagtgatggttgcacataccaagaaaaatatatcccagtttccttctttactccctgttttaaacatatatcctatcttcctagttcatctcctctggtctctccttctatgagatatggataatttattccctatccttgctgccttctaacagtagtataagagaaggtataatcagtggtaagaacatttaactaggaaataacccagaggtccactgacagaaaaactgataaagtgtggtctatgctataccacagaatatcacaaagtggtgaaaattaataactaatgctatgtgcaataacacatacatgctgaaaatgtaatgctgagcatttttaaatttcataagactatattcagcaatgataccatttatagggctcaaaaaacaagaaatatatatccgtgttcaagcacacatacatttgtgacaagcatagaaaacatatacaaagcatgtgaaacgtctcagataccctgattcaaagtcaagggtctcatggaaatttattcaggtttggatgcacacctgacttggcatgtatgctgctctacataggacacacccaacacaaccaacctagtgttgctctaaggccgctaacctttaaaataaataaagccagccagcatatcacccttcattgacctatcttaaattcgaatcacaatgatagctgtaagtggaaattttttgcttttcgttataaaagctttacacataccctggtggccaccgctgctgaggtcagcagcaccacggcagctgtgaaaggttagcagttttgtttttgtgtgttgaggccttggctcaagatcccatctgtgctgacttcagactgaagggaacacatttcctccagcctgaaaactgaaacatatgccgcaataattagagcttccttgagtcagttcagctgaacccaggatgctgagactgataacctgtgagcacactagaagacttcacatacggcacccacctgctagacaaagacagacatgaagacatggccacgaggcctccatatccaaaaagacagaagtcccatcatctatatgtattatgtctatatctgcttgcagactcctgcttctgctaaaaagtacagtgaggagtttgcaagttaaagagacagaactaagtcaacaaaactgcagcatttagaaagcccctgcaagcacttgatctctgcgtcctctttacttgatctctgtgccctctttacgtgatctagacttgtgctctccaatactggccacatttggctagttaatgaaaattcaataaaattgaaaatcaacttcctcggtcacattagccacatttcaagtgatcaataaccacatgtgactactggctgattaccatattggacagagcaagtataaaacctttctttcattacagaaagtgctttgggcagtcctgacttagacactaatccacttttttactcttattatattgactcataataattgtaaacatttatgaggtacagcatgattctttttttagacgggatcttactttgtcactcaggctgaagtgcaatagtgcaatcacggctcactacaacctcaacctcccagactcaagtcatcctcccacctcagcctcccaagtagctgggactacaggtgtgcacgaccacacctggctaatttttatattttttgcagagatggggtttcaacatgttgcccaggctggtctcaaactcctggactcaagtgatctgctcatttcagcctcccaaagttctgggattacagggatgagccaccatgcctggccatacagtatgatatttttacacgtatacacaatgtgtaatgatcaaatcagagtaaagtagcatatccaccacctcaaacatttatcatttatttgtgttggtaacactcaaaatctgcctttctagctactggaaaatatacaatacgttgtggttaatagacactaatccacttttaaaacaaaaccaaaaccgccaccagcatgctgaacatcaaaatcccagagctagccagaaaatgtcaaggattagtcacccagcacaattaatctgagatggtccacaggcttccagggttgaggcttctcttaagtggtgtctttattttatttcattgtttactgtcgcacagcgattaaaagaatggactctgaggccaggtgcagtggttcacgtctgtaatcccagcactttgggaggccgaggcgggcggatcacgaggtcaggagatcgagaccatcctggctaatacgatgaaaccccgtctctactaaaaatacaaaaaaaattagccgggcgtggtggcgggcgcctgtagtcccagctacccgggaggctgaggcaggagaatggcgtgaacccaggaggcagagcttgcagtgagcccagatggcgccactgcactccagcctgggcgacagagcaagactctgtctcaaaaaaaaaaaaaaaagaaagaaagaaagaaaaaagaatggactctagaattagacggtttgagcctgaatcgctgcaacagtctgttaattattcaaactctctcattctcctgtaggttaaatcgctgcaacagtctgttaattattcaaactctctcattctcctgtaggttaaaatgggattttttttttttaaatagagacagcgttttgccatgttgcccaggagcttgaactcccaggctcaagcaatctgcctgcctcagcttcccaaagcgctgggactacaggtgtgagccaccgcgcccagccaaaatggggatactaatagtatctacctcatagatttgtttaaaaattaaatgacacaatgtttgtaaatctattagtaccatgcttggcatagagtaagagctctataattgttagctattaactattattatccttgccaaaaggaaggagaagaaaagcatgaggctgaatttttgaattttgcccattaaaaaatatcggagctctggtaaagatgcactatgagagaaaatcaacacatatgatctgtttcatcttcagccttgtagtttaataatttcctttctcacctttaaaaagcttgtccttgccttttcgctcttcttgtaagtctctcttcagtgcaccgtgtccatagtgctacgtgttaggcactattcaaagcacatgacatgtaccagcttaataaattctcacaacaatcctacaaggtagatactcaatgtgcctatttattttcaagtgaaaaaacggagacacttagaggttaggtaactagtgcaggatcacatagctagtaagtgacagtgtcactggctccaaaagcaggcagtatggatgaagaatctctgctccatcacagccatcgtgcaaaattgcttcgatatgcagcagtcctcccttcaaaacaaacaaacaacacctttcccaagctatcgacctggtaatattattatagtttatttaattagattggcaggacaggcaaggagaagtctcttgggatttggatatgacagcagctctcattgtcctgtcttctgactaaatcccctgggggatgtggatggaataaaactctgctattcagaagggttggcattgccccctgggaggtctggaaatttatgaggatagtttggttttcacaataattggggggtaccatcactctgaaggagacaaaggtgcttatatcccacattatctgtcacaatcacatacaattttcaaatgtccactttagacaatttaggtctagattgtaactgctgattatgtataaggagcaattctcatattgttctagtgtatttaatatagttctaagattgcaaccaccaggtaaaatgaaagaaactggtacttttgtcttcaaaaccttagcaggagttgttcatcatctgagactataaggtcatgctatttgaatcccaaagacaacacagctgtatcagtctccaattagagccgcacattcacagtaaggctgcgccatgaccgctctcctagtgccaaaacatttatataaaacaatgtcctaggcagctgaggctgctataacagaataccacacattgggtggcttatatgcaacaaaaatctatttttcggccagacatggtggctcgtgcccgtaatcccagcactttgggaagcagaggcgggtggatcacctgaggtcaggagttcaagaccagcctggccaacatggtgaaacctcgtctctactacaaatacaaaaattagccaggagtggtggcaagcgcctgtaatcccagctactcaggaggctgaggcaggaaaatcacttgaacctgggaggcagaggttgcagtgagccgagatcacgccactgcactccagcctgggcaacagcaagactccgtctcaaaataaataaataaataaataaataaattatatatatatattcactcttgaggaggctgggaaatccaaaaatcaaaacgtctgcatattcagcgtctgagagctcactgctcattcagtgtaaatgaagaaacctgagggcaggtttcttcatttacagatggtgttgctgtgtgtcctcacttggcagaaggggaagtcagctcccttgggcctcttttatgagggcgctaatcccattcatgaggactctgccttcctgagctaattacctccccgaagcaccacctcttaatattatcaccttaggggttaagatcacacagcatataaattttggaaggacacaaacactctgaccacaacaggtaatagacaccatttgataaataattttccatttatttcttctttatattttcattgggtcattatattgctattttgaaactgtctatataaatagttatatattatctaagactctcccttcaggatagcatttgtgtgtgtgtgcgtgcatgtgcatgtgtgtttcaaaatacatgtttataaaaaggggttttgtgcttaataggggtgatgtcctctgctcggcatctctgggaaagaactggtctacagaataagctgttgctgtttcctatcaatattttactatacaggaaaatcagagctacatgtccttaacaccagctttctggtgagggaattactgataagtaatgagaattactgataaacagagagaaaaatgaaatttatgagttctccatcaagttctggcctctccccatcctaatccctatctcagaagcaagtcttttttttttttttttttttttttgagatggagtctagctctctcacccaggctggaatgtagtggtgctatctcagttcactgcaaactctgcctcccaggttcatgcaattctcctgtctcagcctcctgagtagctggaattacaggtgcctgccaccacacctggctaatttttgtatttttagtagagacagggtttcaccatgttggccaggttggtctcaaactcctgacctcaaatgatctgcccgcttcggtctcccaaagtgttgggattacaggcgtgagccaccgcacccagccaagtctttaaagtataaaaccttaaggttcatatccttcacccactttttgatgggtttttttttcttgtaaatttgtttgagttcattgtagattctggatattagccctttgtcagatgagtaggttgcaaaaattttctcccattctgtaggttgcctgttcattctgatggtggtttcttttgctatgcagaagctctttagttcaattagatcccatttgtcaattttggcttttgttgccattgtttttggtgttttagacatgaagtcttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtgaggtttgtcaaagatgagatagttgtagatatgcagcattatttctgagggctctgttctgttccattggtctatctctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatagcttttttcatgatattgattcttcctacccatgagcatggaatgttcttccatttctttgtatcctcttttatttcattgagcagtggtttatagttctccttgaagaggtccttcacgtcccttgtaagttggattcctaggtattttattctctttgaagcaattgtgaatgggagttcactcatgatttggctctctgtttgtctgttattggtatatatgcttgtgatttttgcatgttgattttgtatcctgagactgctgaagttgcttatcagcttaaggagattttgggctgagatgatcgggttttctagatatacaatcatgtcatctgcaaacagggacaatttgacttcctcttttcctaattgaatgccctttattcccttctcctgcctgactgccctggccagaatttccaacactatattgaataggagtggtgagagagggcatccctctcttttgcccattttcaaaaggaatgcttccagtttttgtccattcagtatgatattggctgtgggtttgtcatagatagctcttattgttttgagatacgtcccatcaatacctaatttattgagagtttttagcatgaagtgttgctgaattttgtcaaaggccttttctgcatctattgagataatcatgtggtttttgtctttggttctgtttatatgctggactacatttattgattttcgtatgttgaaccagccttgcatcccagggatgaagcccacttgatcatggtagataagctttttgatgtattgctggattcagtttgccagtattttattgaggatttttgcatcgatgttcatcaaggatattgggtaaaattctctttttttgttgtgtctctgccaggctttggtatcacgatgatgatggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgagcaatttatccatttcttctagattttctagtttatctgcgtagaggtgtttatagtattctctgatggtagtttgtatttctgtgggatcggtggtgatatcccctttattttttattgcatctatttgattcttctctcttttcttctttattagtcttgctagcagtctatcaattttgttgatcttttcaaaaaaccagctcctggattcattgattttttgaagggttttttgtgtctccatttccttcagttctgctcttctcaaaagaagacatttatgcacccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaagtaggaacacttgtacactgttggtgggactgtaaactagttcaaccattgtggaagtcagtgtggcgattcctcagggatctagaactagaaataccatttgacccagccatcccattactgggtatatacccaaaggattataaatcatgctgctataaagacacacgcacacatatgtttattgtggcactattcacaatagcaaagacttggaacgaagccaaatgtccaacaatgatagactggattaagaaaatgtggcacatatacaccatggaatactatgcagccataaaaaaggatgagttcatgccctttgtagggacatggatgaagctggaaaccatcattctcagcaatctatcccaaggacaaaaaaccaaacaccgcatgttctcgctcataggtgggaattgaacaatgagaacgcatggacacaggaaggggaacatcacacaccagggactgttgtggggttgggggaggggggagggatagcattaggatatatacctaatgctaaatgacgagttaatgggtgcagcacactaacatggcacatgtatacatatgtaacaaacctgcacgttgtgcacacgtaccctaaaacttaaagtataataaaaaaaaaaaaaaaaaacttaaggtacagcagccactatcctgtctcttccccttgtcacctctccctggctgagccaacttgctttgcgttaactacctttctcacacatccccaagagcctacagaaaaggtctatgatcttggcttgttactaccaaatcatctcaaacctctcagcatctttacctactcagttaagtaaggaaactcacaattccttgagtagttcctgtagccctctcccagcctgaatggctcttcctggtgttgccgatgctaatcaatgactgaacacaggactgctgtctctctcatttctctgaactagctggcatatctttactttcttccctcttggcttctaatgaagacaaaactgcattgcctaattatcctttagaaagaaaaccttaacattctttaatacttgatctcttttcaatgccttctatttgtttctgtaattcagctaaaaatagttcagccattgaaaaaaatagattccaataaaacatattgaatgacaactatttaatgtgttaaaaagaatactacctgatttttttttttcagtaaactaaaaagcttcctgaatttgcagcattcttaaattgaagtaagaagtggagagacactttgggcagccgaggcaggcggatcatgaggtcaggagttcaagaccagcctggccaacattgtgaaactccatctctactaaaagtacaaaaaattagctgggtgtggtggccggtgcctgtaatcccagctacttgggaggctgatgcaggagaatggcttgaactcgggaggcggaggttgctgtgagccgagatcgcaccattgcactccagcctcagcaacaagagtgagactccgtctcaaaaaaaaaaaaaaaaagaagtgggaagaaagggagaagagattaatatagtagcagtttttaaatgttggtatgtaccagatcttcctaattacctgataaggaaggttacccataatttataggttgaagaaatcaaggcagagaggttaaacagtttgctcaaggtcatgtatagacacctccaccctcaccctcaaccagtgctaggattacaacccaatttgtctaattctattacatcatgctaccactctacagtaattataattagtgctaacttcataccaagaactgtgctaagtatctcatttagtctttataataaccctatgacgtaggtaccaaatttagcttcattttacaaatgagaaaattgggcacagaaagaaagtcaggttgcccaaagtcacacagtaaatagtccagcttatattcaaatccaggaacctgactccagaacctatgcccttaatcattaggcggcactctcggatagaattaaaatccaccaggcaaaaaatgagtaaatagctaatttttatcagtaaagattactgaggaaatcacaacagcgctattcccaacagaatgatttaacaatagctatgttcatgaggatgcatgatatagtttgaatatacgtccccaccaaatctcacgctgaattgtaatccccagggttggaggtggggcctgcagggaggtgtctgggtcatgggggaggatctctcgtggcccagtgctgtgctcatgataagatacgctcatttcaaagtgtatgatgccccacccccacacactagctcctgcttcctccatgtgacgggccagctccgctttgccttctaccatgattgtaagctcccagaggcctcatcagaaaccaagcagatgccaggtgccacacatgcttcctacacaggctgcagaagtgtgagccaaggaaacctcttatctttataaattgcccagcctcaggtacttctttatagcaacacaacagcagcctaatacaatgcactagcaaatcaaagtgggatttttgtttagtccacaagtgattaaaactccgaaaaaacaaaaccattaaccttacgaattaaatatcttcttttgatgggctaatgtaatattgaatatgaagtgattagaaagtaattccccaaaatttctgtctgtgggtggaaagaggggtggtatataacagcacaacacagaaatgtatccctacatgtgcctggttgaaaattcattttctctttggaatccaggctcctcctacccctagagcagtcagagagacatagctaccaaatgcaaaacagaatgcagtctttagagagagaccaccagggctgagatatcacccactgttatttacaaataaagccagcagtgagagatgggacagacatattagaggaaatcaaaagagtcatttttaaatgttaaagatttttcttggaaaatatgaaaggaaaaactaagaacattatcttggtaagttagcaaagccctgaagcaagcattggacatcccaaatcagccacatgggacacagaggagggtccacatagaaccaaagcctgtctcttctctacaaggttaaggtttgagtttcctagaggaagaaacaagagatttagaatgcatggtgtcatgtaaatcactctcactgtcattatttttaaggcttttacgtatatattttaactgcatactatatgtgtaaaatatatatattcatatacacataaatgcacacacacacacaaatacatatgtaaaaataaatgtacagctgattcaggtaaatcataccaggaaactgaagccagttttggtttttttgctggttttttttttttttttttgagatagagtcttgctctgtcgcccagaccagagtgcagtggcatgctatcggctcacagcaacctctgcctcctgagttcaagtgattctcctgcctcagcctctgagtagctggaattacaggcacacaccaccaggcccagctaatttttgtatttttagtagagacgacgtttcaccatgttggccaggccagtctcgaactcctgacctcaggtgatccacctgcctcggcctcccaaagtcctgggattacaggtgtgagccaccgcgcccggctggagccaggtttttgacatccacattgggtaaatcctggtgagcagaacagcacccatcacaaaatactgccttaatttaaagctattccagctaggtctgtttcatattactgtaatgaagataatagccaaaacatgataataaaactaacaaacccctggaattgttaacacagatacactgtcaacaatttttctacaaaaactgccatgtcagcttaagtgatcttttcttctctgaacagttacagcatttaccttctctaggcttaggacccagagatgcaaagggaaaggcaagtgttgtgggctcaccccccacttctaatataacagcaataataatagataaaatgtatatcgtacttaccacgtcccagactgtttttaaatgctttaactactccattatttttaatcctcacaacaatcccattattagtccatgtactaacaaggaaattgacccagagttgaggtaaatagtcccaggtcataaagctagttcatagaactagatctagaaccctggcctccagcactaaaaattacataaataaataaataatctttgctcacttatttttttaaagaccagtgaactatgctcagcccaggctagactcaaactattgggctcaagtgatcctcctgcctcagcctcccaagtagccaggactacaggcacacaccatcatgcccggctttcaccattttttcactcttttggttcagtttaagatttcatttagagaaaaaaggttttataccatttaaaataaaaacattgagcaccactagtctatatagtttatttatctattgccactcaaactctgatgtcatttttatggtgttctggttgcactgtttaattctgttagttaactttccgtatgttatgccttgaactgcatacatgtacgtagaaactcccacacgtaagtacactagactggaagttcttagagaacttatattctttgtattaggttggtgcaaaaggaactgtgggttttgccattaaaagtaattaatatctcctatgttgcatacagtacaatgcattcacaaataaattttttgagaaataaacttgatttaactgttcaaataaatttttatcctggggtaaatagttttagtttaaactatgctactggtaataataaacaatccttaagaacatcatatgagacagcagttctgcccaacccactcccaatttcttacccatgcggtgtcactaatcaatttataggttggaacaagaaaaaagttttacattacagaactaataaagcatactttccctgcagagggaccactactgtgacttaaaggttctaattaagtttttttctttgaagcttagtattcaaatctgcattcttacttgattagtattcaccaccattatttttatgcagatcacatgaaaaatgaaccctatgtgccagaataacttgcaagaaattactattcatcagcatgaatcaacaagcccacaattagaacagtgtccactgggaaaagtaaaaaaaaaaaaaaaaaacttttactaaggtcatataaaatgaaagtaaagggggaaaataaagaattcatttttgcattgaaaatcatacaaacgttttcagcagaaaattactatgactattattggggctcagaaaatgatatcctgaagtatggtgctttcatatgctgggcacttccgaattttaaaaaaacagaagaccttagaagctgcctcagaaccaaggactctgtaaccttctcctgtatctctccaactcccaaagcacagagaggggctctctctggaatttccttatcagactaaggaaactttttccttaagaaatacaattctcttaaacctcctccccagaaatctcattaaattaccaggaaagattaacctgagaagaaaagaatctataataagtcattgccaagaccagacagactgttcgtctgttcttcagagggcagctttgagacattacccgagagacttcaactgcataatacaacaacctctgttcaccctacagttcctccctcaacttcccataacttgtgggtcccattcagtttccaaagagaaccatttacaaactactgtctgctccttggatccattaaactctcctaaaatcactatcccccaaaattgcctatattcccccatctccctgactgctagaaagagagtgccatttaagctgtggctatctggcctttctgttacagcccaacaggttcttcttacctgctgcccagaaaagccaatacacggagaacagtaggggtgttgcagcagagaaagagtttaattactgcaaggcagctgagcagaaggaggggaggtatctctcaaatccacctcctcgaaagcttggagcccagggtttttaaggataatttggcaagctgagggccagggaatgtatgctactgattggttggagatgaaatcactggagtgttggaactgtcttcacgtgctgagtcagtttctaggtgggggtcacaggacgagttgagtctgttccttggtatgagtcatggtccagatggcatcagtcagtttaccagaatgcaaaggtctgaaaaatatctcaaaaacccatcttagggtttacagtggtgatgttatctcaaatcttgtgacctccagcagtaaccaagctagggaacaatggctggttatctcttcttcactgtgcttattacttagcagaattcaggcccttatcataattctaatcttattgactttcattagttttacaaatgcagtttcagttcccaagcaagaaggggaccagtttcaggaagggactattatcatccttgctttaaagttaaactgtaaactaaactcctttttagttagcttgacctacacccaggaatgagcagatagtcagcttctggggtcagaagcaagataaagtcagctgtgttggatttctctaaccatcataaccttagcaaggtggtttcagttctctgagtctcatatactgtgtggcccctgtgcttctgcacattaatacatttatatgcctcttcccctgttaatcagtctaatgtcaggtcatttcagcactttcaaatttcagagccagagggggaggaaaaattatcttcacacctatactctctaagaccaaaaagcaacagacattctgccacatgctacaagacggataaaccgacaaatattatatggttccacttataagaaacatgaagagaaagtagagtaaaggttcccttgtccccctctgccacagagggagtggcttgcttcttcagcgccctgctgctcaaacctctagggggagcatacagatgggcacgttgtggggctcggaccccatggcagtgtctagaggtgtatgtttacagctcctgaagccccagtgggcatgtgttacaaggtgctcttttaatctagccgtctgtaggcagcttgtgttagtcagctcaattagacccccttccttatcacaaggacaaagggatttctatatcctggggtttcttgctttggtgaactggaagaatcagatcacatgtaggcttggagaataagtgcaaggttttattgagtaaagtagctctcagcagatgggggagccagaagggaaatggttttctcccggagtcgggcgctcggtgacctgggctctcctccaaccgtcccagccaaactccacgtcgttctgctggccgacggcctcccagcgtgctggcatctgttgctgtgctcttctgcctgcgtgctcccctttgtcaggcctctgagcccaaggtaagccatcatatcccccgtgacctgcacgtatacatccagatggcctgaagcaactgaagaactacaaaacaactgaaaatagccagttcctgccttaaccgatgacattgcaccattgtgatttgttccctccccaccctaagtgatcaattgactttgtgacaataccccctccccgcccttgcgataatggactttgtgatattcctccgcccttgagaatgtaatatcctttgtaatatcctccccacacttgagaatgtactttgtaagatccaccccccactagcaaaaattgctcctaactccaccgcctatctctataagaactatagataagttcttatagggataaacctataagataaacctataagaactaatgataatcccaccaccctttgctgactctcttttcagacttagcccgcctgcacccaggtgattaaaaagctttattgctcacacaaagcctgtttggtggtctcttcacatggacacgtgtgacaccctccacgtcctcccgatgtccggccacttgtcttcttccaccaatgtgttcctctcaccctccagctgcttctgtctgtgccttgctagggtcttgggtttttataggcccaggatgggggcgtggtagaccagggtagtcttggaaaatgcaacatttgggcgcaaaggcagaagtgcttgtcctcacctaggtcgatgggggtagcgccctagccagggaccatgccctcctctacccagcacttcccttacccccttcctcatcatttaaagggaccacactcttcccttcccagcactcccgtatcacagtcagtggtggcactggattctcataggaccactaaccctattgtgaactgcacatggcagggatctaagttgcatgctccttatgagaatctaatacctgatgatccaaggtggaatagtttcatctagaaaccatccgcccccctcactctatatccctggaaaaactatcttccgcaaaaccagtccctggtgccaaaaaggttggggaccactgttttcagctaaaaagtctgtcacgacttgagctgtggctcatgcctgtaatcccagaatttcgggaggccgaggcagggggatcacgaggtcaggagatcgagacttctccatcctggctaacacggtgaaaccccgtctctattaaaaatataaaaattagccaggtgtggtcgcacatgcctgtagtcccagctactcgggagggtgaggcagaagaatcacttgaacccaggaggtggaggttgcagtgagctgagattgtgccactgcaccccagcctgggcgacagagcaagactgtctcaaaaaaaaaaaaaaagtctgtcatgacttgatatagcatcaataagaagctaatacataaaccactcgatgaggagtttagaagatgaagttgaactgaaagtacagcaaaaagaaaactgactccatcatgcaagagactgctcctacagcttggggttggaagtaaataaaataattaaaggcacagtgacttcacagcacgcaataaacatgtattaagcacctacttcctaaagcccactgcagtcaatgataattcagtcaagctgaaatcatcatcatccaaggttcgtttgtaaataatttaacagtttggagagaatatgtgaagaacaacagttttatttccaagaattcatgaccttatctagagaaagtttatgaatggacagagaagatagtcttatatttggcatgatttcctacgcaggtgaaagattcaactgcccaaaaatatctgatctttggcttgttctaatatagcaaatgcccactaataaaaacctttcaagataaatcttcaaaaaagtattaaaatggaaatgttaacaagaaaggtagtgcccactaaaattatagcataggttagggaagagaaattgccgtggagcagggcaaaaaatcattagctggaaagataaccaacccagtttggagggattaatgcagtaattgatgaactttacctttttctttgtctgggtgctgaagtatgactatttttataagacagatctttctaggcagtccagttactatatgtcaacacatagccttgtaaaagtataatatcctataaagaaataaactctaaactcctcaaatagctattcttctctaatgtttacactgtatatttttatctgataggtaagggtcaacactgtttgcatcattaactggcaaggaataatcgaaattactaattacatttagcatgtctcatattgatgaaacaacagatgtttaaggaagaagcttctttaatatctactaacattatattatgtttcattgtattacacaaaactaccaataaggctaaagcagttgtaccacttttatttaccttacaacaaagaataaatagcttgacaagatccttttaaaaaaaaaataaagtgccattactaattctgtaaaccagtaaaagttaccaaaagaattttaataaaaagatctcaagacccccactgtattttgtaaaatattaaaggcagtaaaatgtaacaaaataaaatagaaaaggtgaccttcaaatccatgaaagaaataagcaaaaaaacaagatgaccttaaaatgaaagttctaatgtcatttcattattttattgtaagtcacagagcccccaggtctatattaaaggcaatatttataagacttaaaatactaaaaaaagaaaaaacagaaaaagactaaaaaccatctacaataattcagaggtatttgaaaataatacaaagcaattaaaaacagtaaaatagaagagatgattaagtctaaaagcagctcagaaaggcctacagctgagctactgctcagggagagggaagctgagctcaaagccccaaacatcaagtgcaatgtgaggaacagaacacactcgaaagctgggggactgaatctgagtcagaagcccctgaaccaagagcgccaagagcagaagatggatgtgccagctcaaaagggagagagcaaattcacctttcctctgcctttttggtctactcatgccctcaatagactgatgagggtgatctttaccagtttgcacattcaagtgctcatctcttcccggaccactctcacagatacaaccaaaagtaatattataccagctatctagacatcccttagcccagttaaccatcacaagtaaggaatggtgacatggaataccggagacagaatagcatgacactgtgaaggccctttgatgataagccacagatcaaagaatactagggcaaagatttttgcataggaaaatgacataatctctctactacatatttaacctgattaaaatggatttttgcacagacaactaaggaagaggccttgttaggatcttgtttagaataaatagataaatatatatattatagttggataggactttaaatattgcctgatcccattccttcatttatcagactcagaaagtataatctcctcggggtcagctggaaaattagtgacaaaggctacaatgtttgcctttttttttaatttatttttttgagacagagtctcattctgtcacccaggctggagtgcagtggcatgatctcagctcactgcaacttccacctcctgcgttcaagggattctcctgcctcagcctcctgagcagctgggactaccagagcccaccacgcccagctaatttttgtatttttagtagagacggggtttcgccacgttagccaggctggtctcgaactcctgacctcaagtgatccacccgcctgagcctcccaaagtgctgggattacaggcgtgagccactgcacctggtttacaatgttttcaaacaatgaactcataagtactcttatatttattatgatttttttttaagatagctctatctcccagaatttctacaaccacctctttaatgaactgaagtctttctttctttctggccacaaatatttactgaacccctactatgtgccaggcactgttctagaggataataacaaaattaattctctggttagatctaaaattcaaaagaagaaaaaaaacaataaacaaacacatacatcacacagtggtaagtgttaggaaggaaaatggagtgagatgacccggcgcagtggctcaggcatataattccaatcactttgggaggccaaggcaggcggatcatgaggtcaggagttcgagaccagtctgaccaacatggtgaaaccctgtctcttctaaaaatacaaaaattagccgggcatggtggcgcatgcctataatcccagctactcaggaggctgaggcaggagaatcacttgaacccgggaaacgaaggttgcagtgagccgagatcgcgccactgcactccagcctgggcaatagagtgagactccaactcaaaaaaaaaaaaagaaaaagaaaagaaaaatagagtcagaaggaaaacaagtgcagaacagaaggtattataagtacacagagagcagccacagactaccatctcataagatggtctgcatgaaccaggagcagtggcttgtgcctgtaatcccacctcctagaggggatgagatggtgggatcacttgagtccaggagttcaagacaagcctgggaagcataacaagaccctacctctaaaaaaatgttttaaagtagtcagatgtggagacgcacacctgcagccccagctacccaggagcctgaggcaggaggattgcttgaggccaggagtttaaaactaagctgggcaatatattttatctcaaaaaaataaaaaaaaagatagcctgcactataagaaatccagtagaagagtggtccccaaagactagacaataaatgagaaaatagggagcaggtaagcagcctgtttaaaagagggagggagaagaaaatgaggttgaagtctaagtttcagaacaagtagaatcttatagaccactgtagaaactttgccacagaagtttcccccagaaacagtgcaaaccaggagacaatggaacatctttaaagtgatgaaagacagaacaaaaagtcaagccagaattctatatctagcagaaaaatcattaaaaataaaggcaaaacaaaaattccagacaaatgcaagaagaattgggtaccagcagacctaaagctagaaatttttaaggaagttcttcaggttaaagagaaaggataccagctggaaacagatgaatacaaagaaatgaagagtgctagaaatgttgtaacaatgtaccgtggggtttataacacgtacaagtaaaatgcatgataaaatagcacagaaaataggaggggagaatagaagtaaactattgtaaggttcttacattatatattaaatttatattattttacagtagattatgatgagttagagatagatgttttaaaccaaaagcaacaacaaacaaacaagtatagctaacaagtcaacagaagagataaaatggaatattaataaatactcaaaggaagacagaaaaagagaggacaaaaacaacaaaaataaattaaaaaaataaataaataagtaaacttactaaaacatggcaagaaaaatgcctaccaagcaacatatttaagctggtctgtgttagtgcatctgttgggaataaagctgaaaaccaacatctttactaattgatataaatgtctgcctgaagttttcacagatgatttactgtaatatggtcattctacattgctttcctttccatctgtcataaaatagctgtgtatgattttcaaaattaaaaaattaactttaattagccaactagtttactgataatatcttctcactcaaataagtttttgaactactagacatcgccaaataaaaatagcagttgaggatttgtaaaaagaaaattaagtcaaatagttatttgcaaaatcgttttatcatctttggttcatggaaccattatgtttatcttatatatgctacagcttttttatcaacatgcaaaaagttgtcacatcaacatacccacttgcaaaaatgtaattatactttatataatttcttatatactttacatagcgataatagtaatcaagtactaactatgatagaattcatattggcggagataaatggagcaaaataatattgcttactttgtaaaaataaataattatcttattgatgttgccatttatcctacttgattctatttaatcggcaaaaaccccaggctcaatgtaaaactggtcacagcaagactaggtcagatctctttccaaagtgccagtccagacttctgagtgaccatgggcaaagcacatgcggtgagtggtagaggaaccccaaaactttttcaacacacaccagaaaccgcaaagttacccccacccacatatggttccattcagaaacgaccacagctctcctggtaccggagatacaacaccaacctagataacaaagaccacagagtacatccatctcctcagtttggtctgtaactggagtatcttctacatctccacagcacagatccttggaacgccactgtaacataagctcagcactcaccattctcttacatgcctaaggctttctacagtaagccacagccactctctgcctgagagtgttcactggctgggagcttgctgagacaggccagaaaccagagctggacaagagtgaatgaataaatactcccgcttctttgccctcaggtaagataactatgaggtagattccatgtagcttcacaaaagtacccaatgggattgagcttcagttgccaatagttgcggcctgttcattagcataccctgtagtggcttcattctgtcttacttactcagctctttacaggtgcttcctgggatcatctccctaataaactacttgcactcaaatccttgattactttaatgccatccttcagaatgatgccatttcgtccaagaacaagggatgcctttagttttgttcagttctactttcgggcctttcaggagtgctttaaagttttcttcctgtaagttttgtacatttttaaagtttaattgctgagtattttatctttttttcttgctattgtaaatggggttttctcttcgattatatctctttttttttaagactagtcaagcgcagtagtaacaagtggagaaagactagaacaaggagtttaatctataactgactgaaaagtcaattgagataactcagttggacctttggaccagccttccttataccttctaactcattattgtttacatttatgaaggcttttgatttttccatgttaattttatcatacctattaccctattgagttattttactgagttgggattttttaacgactttattgagaaatcatttacatgccataaaattcactgattttaaatgtactattcaatgggttgaagtatatttagagagctgtacagccatcaccacaatgtaattttagaacagtttcatcaccccaaaaagaaacctttaggcccattaggagttactccctatccctaccccatctcgacctcccagccctacacagccactaatctactttctgtctatatagatttgcctgttgtggatattttacataacgaatcatatgacatgcggtcttttatgtccggcttctttcacttagcataatgttttctgaggttcattgagtaaggttttatcattgatttactagggtttttttaagtaaaatgtcatatgagctgcagatagaaatcattttccaattacaatgcctccaactgtttcctcctgtcaagtgcttttgttaatactgccagtacaatggtcccaacctttgtgggaatattcttagtgtcttcctaataaagtaaagtgctgattatttgatactttaactctgagaggaaaatcatatgtttctatatatgtcaccaccatattacattaactagaagccattatttgttcatctacaacaggataaaataatgtctgccctctctactttacagaaatcctaaaaagaaaatatatataaaatattttataaacaataaaactctatgtaaatttgagagcctatttactataccataaaaataattttagaaaccactgaactcctttgaaagtgtgtgtttttaactactaccaaggagagagaagttagtagacaagaagcaaggcgactagatcattcagccatccaggtatgtaaacaaagaaggaaagaagctagctacagaaagcaaatgtcatattggaacacactgagttttctaagttcctctgacatatttctggtcacagaactatcaccaaacttaaagacctaaaggacttctaatattaaacattaaaatagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaataaaaaaaaataaatgtgagcatacatacatttaagaaagattaagcaggccaggtgtcgtggctcatgcctgtattcgcaacactttgggaggccaaggtgggaggatcacttgagcccaggagttcaagactagcctgggcaacacagggagactccatctctacaaaaattttaaaaatcagccaggcatgcctatagtcccagctgctcaggaagctgaggtgggaggatggcttgagcccaggaggttgaggctgcgatgagccatgactgtgtcactgcactccagcgtaggtgatacagtgagatcttgtctcaagagaaaaaaaaagtaaagcagaagaagaatttagaatttagaggtatgcttaaaaggttaaaagattcttaaatccttaacttattacagaggaattccaaatacagacatgaaaatgggggatatctacatgactgaaagtaactgaaaatatctgcttatctactcaatgaaatgttcaaatataaaaaaattttagacctcttgacaatgtaggaattgacagccagtaccattattagtgcttatttgttaaagtaagggggaaggaaggtagttcagttagctcttgtaaacaccctcggattgatttgttcaatcctggaaaaaattggtctatgcaatagtaattttcacatttttagagttcctttaacctactgtgtaaagtatgcagtgggaaggaagtcaaactagttacttaatacttatctttaagttgaattcaaattagtctcagagttaactaaccagtgtaagagttagggtgtttttcagttgcaaataacaaaaaaacagatttgcattaaaaagaaaagaaaacccagatagtgggcaggtttcagagttggttagaaataataatgacaacagtaacaacagcaaatactatctgtcaggtactgctctctccattttgtgtgtattaatctatttaatccttgccacaactttctgagagttgttatcctcattttacagataaggaaattatctaaaggtacagagagcatctattacatttgcccagcatgccacagttagtgagtagcagagctggcattcaaacccgtgcaatctagaccagagcccatgctcttaactgctgattcaaacccgtgcaatctagaccacagcccatgctcttaactgctgattcaaacccgcgcaatctagaccacagcccatgctcttaactgctgattcaaacccatgcaatctacaccacagcccatgctcttaaccgccgatgctctgctgcctcgtgatggcttctcaggctgtgactcctttctctccagttccctctgctctgccctcttccagagctagcttgcagctcagtctggctccccgtcaggaatattatagatgccaatgggtcctggaactaccctgtactcatataaaaggggagagcacaagcattccttcctaccaaacaaaagctctgagtctcactttaataggacagatcaggtattgttcccaccacagaaccaaccaccgtagacagggaataaggttgcccagagttatctatgccaatgggaacccaccacaggtacagtaataagggaagtctaccccaccaaacctgcaaaactgccatgtaatgagctggattggaaagaatgttgagtagaagccacactgtccactgcaaccagtgatactcttgggtgatacaactctaagaaagggaatcaagatataaccttatggtataacttactaaaattcatcaaatgtaagatgctatggattgtaagacatgccattattaaagataccattaaaaacagtatagcactgccaagtatcatcttaagaggccttcaaatgtaggacgcatcctaatttcagttatgtcaaaaatgtaggaggaaacgtccatcttacaataaaacaaaaatatgaagtgccatcagctggagttgtaaaaatccataactgctttcccacatatatctacataagtctaggctatgactctatacacaggctgagaaatgaaacagcaatcaaccctgctgtgttcccagaacttaagatgaaagatattaactaaaagagtcgtcagaggcctcactcctcaacccctcaatcaaacaccatgtcagacaagcaatatccaccatatgccaggcacagtgtctgggtcctacaagggaaaatgtcttaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaatggtaactcctgcctcaaggatatgactggcaagtactaaataatcatacaagaaacggaatgaagtaatgctgttaaatggatatcaataaaatacaggggctcagaaaaaggaaagattaatatagactaactggaacagagacagttccagcatcaagataacatcagagctgcctgggcatctgtaagaaatgaggatctatttaagagaggaaggcaagaagcaagagtaaataacatggaggtatttcagatcacagtagtagaaatcaagtacttgagttgaactagagcgaaggccgtatgtggcagagtggactaaaaagctagaaatatagtttggagccagcacatttggtaggcaagaagagacactgaacattcttgggcagagaaatgacattatcagagaggttggagaagaatccctaacgagttgtttgcagacactgggcttacggggcttgtgggacatctagggagttttcactgaaactgcccagaagccacccagatataagtatggaatccacagaaagatctaagctaagagtttttatctgggggtcatcaggactagatgataactgaagttatgaaataaatgacattttcttaggaggatctgacatgccagaaaaacaaaggagcccagagaaattacctgaggaacgtcaacattagtggaatgagcagaagagaaggagcttatgtagaaaaagcagcagaaactacacaacaagaggaaggaaaaccaggaacgtgggaaaagagtatgtaagaaaagagagaagttaatactgaccagtttcacagcaagatagaataagaactgaaacataacccctgagatttagattattgatgagctggctgaaagcagtacacatggactagcaaggatggggtagtccacacagggaggtcagaaaaggatgcttagaaaagattgcttttgagctaagaagttaaccagataaacaggaaaaatcaccaaatgtaagggaagaaaaatagtatctacaaagaataggctggatccaatacaaaaatatgtatcttaatcaaaaaaaagaaaaaaacaataaacgcacacataggatttttacattcaacaagcataactaatttgttacctcacacaaattgatcttttgctttaattacaatgctaactttttaagaaaaagaacccaattaaaaatccagcaaatacacagctcagcaaaatttgatgaaaaggtatgcaaataagccacaccttttgtatgacctcttgctaaaaggagcaactttaggccaggtgaggtggctcacacctgtagtcccagcactttgggaggccaaggtgggtggatggcttgaagccaggagttcgagaccagcctggccaacatggtgaaaccctatctctactaaaaatacaaaaatcagccaggcatgctggtgtgcgcctgcagtcccagctactcgggggaggctgaggcagcagaatcgcttgaacccaggaggcagaagttgcagtgagctgagatgccaccaatgcactccagcctgggcaacacagtgagatcccatctcaaaaaacaaataaataaataaaaggagcaactttacatatatctgctatacaaattactctccatttctgcaacaatctgtttaactctaggcaacaagttcaatctcaaatttcattttgactcaattcttttcttaaaaaggattccatattttataatagaaagagccatgaaaaaactctaacttttatttattttaggaattgggaaaatcattccattcctaaaatccgacatatctgactatactctggaaaaaagtatatagtctggcaactcaatagacatgtattttttaaaaatctcactgaataattgcagataagacaaacaagagtaatctaacaattatgccaaacttagattggactacatgtgtgaaagtactacctctctagcactttctccaaggaaactatcagaaccatttattttccactgcataatagcagaactatcagttatgtgacatcctataaaaagacaaacacaatttctaattatatccattctttcattttaattactctagagagtgattacatatttaacttggctatctttaaaaaattaagttgctttaatgaaagtattttagatagctacaccaccatacatcaattagaaagttaatcattccacttgttctcacaaaaagattttaaaggaggtggagaggtggtgtttggtgctttataaaagttaattagagggcacccagaaagagagatcatccaggaaataaagtttatcaaaaatccaaaatatgtaatctgcacagtgtcaagaaacagcaggagattctctttaatgagtttactcatgttcactttaaaagaaaatcttcagttcacgatgtgaggttgagttttaaatatactggaagacttctctgtgtaacagactgtaagactccactcgctcgcttggtcttgactgcctaactgatggcagactattatctaaagcatattcctactctaaaggcagccttctattttacagtgatcttgctgtatacttcacagtcacactcatcattacaaaacattccgaaagctttttttaataagttttcagtgtttgaattatcatgatcactccctcaaattaattactaatatgataagaaataatcaaggttaagttgatacttaatttttggccaaagcaggttcaatggatctatcctagatcaatagataagcttaagaatgcatttctggaagtcctagccagagcaatcaggcaagaggaagaaataaaaggcatccaaacaggaaaagaagtcaaactctctctctttgcagacaatatgattctatacctataaaaccctaaagactctgccaaaagactcctggaactgataaatgacttcagtaaagtttcaggatacaaaattggtatacaaaaatcagcatttctatacccctataacattcaagctgagggtcaaattaagatcacaatctcacttacaatagacacacacaccaatatctaggaatacatctaatcaaagaggtaaaagatctctacaaggaaaactacaaaacactgctgaaagaaatcagagatgtcacaaacaagtggaaaaacattccatgctcatgaattagaagaatcaatatcactaaaatggccacactcgcggtggctcacgcctgtaatcccagcactttgggaggccaaggtgggaggatcacttgaggtcaggagtttgagaccagcctggacaacatggtaaaaccccatctctactaaaaatacaaaaattagccaggcatgctggcacgcgcctgtaatcccagctactcaagaggttgaggcgggagaattgcttgaattcaggaggcagagatggcagtaagccaagatcgtgccactgtactccagcctgggtgacacagcaaggctggctccgtctcgaaaaaataaataaaataaaatagccatactgcccaaagcaatctacagattcaacgctatgcctatcaaactaccaacatcatttttcacagaattagaaaaaattattctaaaatatagaactcaaaaagagcccaaaggattgcccaagcgattctaagcaaaaggaacaaagccagaggcatcacattacccaacttcaaagtatactataaggccaaacagtaaccaaaacagcatagaactggtacaaaaccaaacacatagaccaatggagtacagagaacccagaaataaagctgcacacccacaggcatctgatctttaacaaagtcaccaaaaataagcaatggggaaaggaccctctagtcaataaatggtgctgggataggctacctatatgcagaagaatacaactggacctctacctttcatcatgtacagaaattaagtcaagatggataagatttaaatataagaccacattctacaagaatcctagaagaaaaccattcttctaaaggattggtttaggaaacaccattctggacatcagctttagaaaagaatgtgtgactaagtcctcaaaagcaattgcaacaaaaacaaaaattgacaagtggaacctaattaaaataaagagcatctgcacagcaaaagaaattatcaacagagtaaacagacaacatatagaatgggagaaaatattcacaaactgtgaatttgtctatttgtcatccgacaaaggtctaatatccaaaatctataatgaacttaattcaacaagcaaaaaacaaatgaccccaatacaaaatgggcaaatatatgaatagacacttctcaaatgaagacacacaagcggcagacaaacatgaaaaaatgttccacatcactaatcatcagagaaatgcaaatcaaaaccacaatgagataccatctcacacctgtcagaatggcttttattaaaaagtcaaaacagaacagatgctggcgaggctgcagagaaaagggaacgtttatccactgttagtgggaatgtaacctagttcggccactgtggaaagcagtttggagatttctcaaagaacttgaaacagagctaccatttgacccagcaatgccattagtaggtatctatccaaaagaaaagaaattgttctaccaaagagacacatgtacgtatatgtttgttgcagcactactcacaatagcaaaaaacacggaactaacctaggtgtacatcaatagtggtttagataaagaaaacatggggtgtgtgtggaatagtattctgctccccatggaatacttagccataaaaaaagaacaaaatcatgtcctttgcggcaacatggaaacagctggaggctattctcctaagcaaattaatgcaaaacaataaaaccaaataacatgtagttcacacttataagtgggagctaatcactggtactgctggacataaagacggcaacaatagacactggtgactattaaaggagaagaggaaaggaggaggcaaggattgaaaaattattgggtactatgctcactacctgggtgacaggatcatccctatttcaaatctcagcattacacaatatacccatgccacaaacttgcacatgtattccttgaatctaaaataaaagttgaaattatttttttttaaagaatgtgtttgtgattatctgaaattattgcaaaatgtatatacatttttttccaaagaggtttcacggatttcataagttaactgttttattctatgaagagaccatggaataaacaaaacaaagcagcaaaatgttaagtgaaaactttatattcagactctgaagcttctttggtaagggtagtgtgttacgcaaagaggtattctgagtaactgtaatactagataaggaacagtcaggacaaagccactgcttttctctaagttaggaaaacatcaggaactcctgagaattccaaaatagcttgaatgaggaagggggaataagggaagagtaatagcgttgagactctaaatgatagaagaattccaaggagaagatacaagaattccaagaattccaaggagaagatacaagaattccaagaattccaaggagaagatacaagaattccaagaattccaaggagaagatacaaggaaactggacaaaacacgctaaatgaagctacattaattagaatgtcccacgtggcatttgaatttccctctattagagtttttgctacatttccctgaaggtttatcgagggcagacactgaccttaatagtctttgtatcacgggttccagcacagtacttctcacatagttgttactcaacatttcctgggtcagtaatgaaaacatgggttggaaataggtggcaagtttttttaaaattattaaaccagaagctttcagtgggtagtagttacatattcaaatttccttcacccacttgagagagaaaatataaaggctatgaaatgtgtcgggagaaaaactatgaaccattctttcttatttgaaaaaaaaaaaaactatacaacaatagaagaaagttgaaaaagaacctaatcttccttcatggaaacatggacttaaacaaaaaaagaacctaattttcctaaagtgaactaaaagttacaaatttcaatctccaataattgaaggcaagaactttgttcttatagactatctcaggcagcagtttaaaaggggggcctacaatgttttcccctttgattttaaaataattttacacttacataaaagtcacaataatagcacagaggattcccatctaccccttcactcagcttcccttaacattgacatcaccacagtaatacatagaaagtatctaggttcctgcctccctagtctcctccgatctgtcataattcctaagtctttccttgtctttgacacttgatacttttgaagagtaatgatcagttatttaggcaggtgtcttgcctaaatcatgttctttttctgttccacaaggtaaagatgtatttagatgtcctgcttcgttagtctcctccaatctgtgacccaacatgctcccgcccccaagggcaggtttacttctattacttctattttccccaggtgtaaagggttttcaccagagccccaaaggtaatggtcattgttttgtcctttctctgctttcattcagtagaagggaaaaggacgatagggaataagggtcctgccagagtttctttcttttttttttttttttttgagacagagttttcactctcgcccagactgaagtgcagtgacacaatctcggctcactgcaacctccacctcccgggttcaagcgattctcctgcctcagcttcccaagtagctgggattacaggcacccgccaccacacccagctaattttttgtatttattagagacaaggtttcaccacgttggtcaggctggtctcgaactcctgacctcgggtgatccactcacctcagcctcccacagtgctgggatttcagagtttcttactgtatctgcagcagctgctcttctcctagagacaaagaatgctttctcaggaatctcacctgtctttttgggagcacctggtagagtttttggagaaaaagcctacaggtgggtatgaactcccctcatccacagttcccagggtcttcacactttcttgccagcccacatgcagcatccatcaatttggttaactattctagctgaatgcttaccagtgtccagctgtgggtgccccaggtaagcaagtgctgatgtctttccctacatctgtctcttcttagacgtcaagctagccgattgccctataacctcagcaatctgatgggttaaaaaacaaaagtcatgaacttgtcattgtccagatgtttctgtgtttagtcttgcttttaagattagaagccatgctttttctgtacacaattttgtttttattaatgcgtgaatttgtttgctaaaagataacgctatgaaacaaatttaaagtttattgaaaaatcaacttaaaagcagcattccaaaatattctaatataatttttaatcttaaaacttagagttttgactgttgatcactgtcattttttccagctgttgttatatcaagaaaactctcattatttccataacaataaaattcaaaactgaaatgcaataatgcatgtggacataaattatactgagaattcaacctaataaaaaacacataacagctgacaatgatttcttaaaagcatttgcttaaagtttgtcagaatgctgggagaataccaattacgtattcatagtcctcataattttgttttacaaaatattttctcaaatctcttgggagattactatagggttaaaagctgttttaagatcaaagatcaaatagaggggggaaaaaccctgtaattctctactgcagctcattgatctttcccatctgctatgcaaaaaaggagatgcatgttaagtttgaaaaaagaaaatctttttaactaggaatgacagcatactgattctggcaaacgttcagagggaatttttatatatgagatccaactcccttttgccaaaatataaatgatgttaacaataggaaaacaaaatctagtcagtagtctcttatttatatatttcttcctgcaaatatatcgtatgatcagatttctaatataaaacacacatagtaaaataaattttcaaccatcaagagcacaggcttaggggtgaatgataagagacaagtggagtaagacactgaaaaacgaagtcaactcaggaccagaggaactactttcctggtactcttccctcccttgtatcctccagggattgattccaggacaccaaccccctccctggcccccagcacggataccaaaatccatggatgctcaagtcccttctataaaatggcatagtatttgcatataaactatgcatatcctcttgtatactttatatcatccctagaatacgtataacagtggtccccaaccgttttagcaccagggaccagtttcgtggaagacaacttttccacagatgctggggcggggggcggagtggggatggttttgggatgaaaccatcagatcatccaatcatccgatcatcaggcattactttgattctcatactgtgagatctagtgtgcaacctagatccctcacatgcacagttcacaatagggttcacgctcccgtgagaatctaatgccgctgctgatctgacaggagacagggctcaggcaataatgctcgttcacccgccactcactccctactgtgcggcctggttcctgacaggccatgggagtggtaccggtcctcggcccgggctctggggacccctgactatgctatgtaaatagttgttatgctgtattggttttatttgtactatttttattgccacattgttattttcgggggggggggttcccaattttttatttttatttttttaagagacaaggtcttgctatgttgcccaggctggccccaaactcctgggctcaagcaatcctcccatttgagcctccctaggaaatgagactacaggcaaacaccaccacacccagtccaaatattttgaatccaagcctggctgcatccacagatgtgaaaaccatggattcaaaggattcactgtatagtccaacaattcaagtttccgtggactttatgtaaaagcctagaagccttctcatgtatcttcaccttggaaacaataaaaaatacttcccaggaggccaatgacatggcccattttttagaacagaagcagcacattttatctcctgagacaaacgctcataggcacaccaacaattatcacctttggtaaccctcaaagtattttagcatggggcctgtttctttccttagtgtgcctttagcttctctcctctcacagtcactgaattctacacttaaaatgggtgagactgactcttaagaaaaaaaagacagttgtatattctcacactagaagcacaataaatgtgctagaagtactaagtactctggtaggcgggggtgggcggattacttgagcccaggagttgaagaccagcccgtgcaacgtggcgagaccacatctctactaaaaaaacagaaaaattagctgggagtggtggcgtgcccctatagtcccagctaccagggaggatgggatgggaggatcacttaagcttgggaggtcaaggctgcagtgagccatgatcgcaccactgcactccagcctgggtaacagagtgagaccttgtctcaaaaaaaagtgttttagttctttataagtttgatgatatttctatgatcagaagtatgtcataggaacttaactcttgtttatatccattagcctgtggtaaaatcggtttcgttagaagtcattttgcttgaagtttacaacaatctattgatgatgttgagtgaggacttactctacatgagaaataaaaagaagaaaataatcccatcacctagaaagacaaccactattaaaccaatatacacaaaaaatatatagatagagaaaattttatttttcaagacctcagatgccattttggaatctatttttaccacttaatgtgattatttgccccatgtcactaaatatcattaaaaattaacattagcaaaagatacctcccacaaattgagtacttaccgtttgccaagcacgacattagcactttgcagaagttatttcatcctcacaaacagcctgtgaggaagatatcgtcacacccactacactgatatgcaaactacctatcaatatctaatgatattttggatcacaaactaaataatcatgacagtatatttttttaattatgaagtcaaatttataaaagtattttcaggcagaaactagtgatgtaggaactctctctccaaatctagaagtatatatctatgaaaaaaaatatttgggggcataaaaactacgttaaaataaatgtagaaacatgttgaagatcttcgatgtgactaaaaaggaaagcctcattttttactatgatataggagtagcaaagggtaattaaaacaaccagcagcagcactgtgagctttcacagaaagatacaagttcacaaaatccctttcctaatgaccaagctccatggattggggctttcgcatctgtgaccatctttctgaatgtcctggcataccccgtcttttgtattttcctaagaggaagaaatccctctgtgaatggaacaataacctcagtgccatgtgtgtaagactatatatgcctactgcttggttgaaggccactgggaattacacacacctgttagtggggagcaacatggtcctccaatctggttacattacgtagaagtaaattataggtgacccttaatctctgttttgtgcgtccccacttaccctgccgttcgtaagtacacgcacattccagacacatgaagaggagctttttatccaagactttgaaagaaccgactaggagtttacaggaagatctctaatgagtaatagtggtaggtaaaattcacgctgagccagttctttcttggtcgtcatttgtgtacgtttccttactaaagtaccaaaatgtctttgtttcaaggtcatttcacctatggagtaaatgcataatttgtaactacgctgcaaaatttgtggttacactgactccaagttatcttatttcatactgaaaagaaccctgaaatgaaagtaccaccattcactatattgaggaggcaaatttaaaaccaggaagctgatattacctgttactgccaggtcactccttttcggattatcactggagctttcaaatcttcaagagatcagaaagcattccagtggctcaacaaaggcactgaaacaaggacaaaaaatgcctcactgacattttaggggctaatgcctatatttctttctttctttgttttttcccccttgagatagagtctcactctgtcgtccagcctggagtgcagtggcgccatctcagctcaccacaacctccacctcctgggttcaaacggttctcctgcctctgcctcccaagtagccgagaccacaggcacatgccagcatgtccagctaatttttatgtttttagtagagatgaggtttcaccatgctggccaggctggtctgcaactcctggcctcaagtgatcctcccgcctcgggcccccagggtgctgggactacaggcgtgaacttacgcgccccaccttctttctctttactatctttgatgttcatgtatctattcattcagtcaacaagcagaaaatgcctatcatgtgcaaggcactatggaaggcactgaagaatcacacataatagagacacactctcaaggcttttataacttagctgaggaacccaatttattcaccaccatgaactatatcatataataagtgctacaatgtgtaagcgctgtgggagcaccatggaggtgttacttgagtcataccatgaagtaccttttcttcagggaaggaaggaatgatgtgataatccattagaggtatggcacaggcacaaaaacaataaacccttatggaaaagtcttcactaaaagactattgaggccaggcatggtggctcacgcctgtaatcccagcactttgggaggccgaggcaggctgaggtcacgagttcaagaccagcctggccaacccggtgaaaccccgcctctactaaaaatacaaaaatcagctgggcgtggtgacgcacacctgtaatcccagctactcgggaggctgaggcaggaaattgcttgaacctgggaggcagaggtcgcaatgagccaagatcccaccactgcactccaggctgggctataagagcgaaaccccttctcaaaaaaaaataaaataataaaaaaagactactgaaaagagaaaacaaagtaaaagtagttacacagaaaataagaaaatgaaagaatctaatgataaagaaatatactgatgtgaaattggagaccagttggaggttaagtttaaaaatatatatatattttgaacacagtattgaaataggccagaggtttatgaataagtgaagcagacccattaacgcaaacactggtactgcttcctcaaagcttttgtgaaatgaaggaaggcaaaaagggaatggatagatgatcttgggagccagactctggtaagaatctgtgccctgggaaggacggttagttcttccacactgtgcactccacctcagggcatcttatctcccttccagaattcttgcctagcaacttcccttacagtgcaccaggctcccaacttcagattttatgctctactgtatttaaattcttcttatttaaatttaaaaatgtatggtagctcttcctattttggattttgtatattccttccagttgtttttgttttgttttactctcttatgtatttgcattaagtaacattttggttcacatatatacatgcctaagaaattttcctcaacctcctcttaccaatcagtaacactggtttcaccaaggagtaagattctaatgtgttaaaccctatttaatatctttcagtttgatcctcaaactgtacatttctccatctgcaagtacagcgttacattcaccaacttacctaatggaatttgatacatggttggacattactataaattagctgaatctcaatttatttaggaagctctacaatgtaactcctcaaaaggcaacagtctcctatagaatcaatatacatgtaacaccattaagaagcagcctctcagaaaagcgattcagcaattgagattaatgtaatgaaagttattcaggtagataacaatctaattttaaaacacttgaaagaaataagtcctaactcctttcccatacaaatagagatgctagccagtctggggcaagggagggttgggctggtgtagtggcagggaagatgggcacaggaacctaacaccaattttttcacttgtacatttcctaaaagaattttgaaaaaccttgtgctcttctgacattttaggttgacatgttaatttaatgatggcatggatatagtttccagtatggtatatacgtatcttaaatattattgttgcaaccctgcagctgtagatttcactcttttacttaatgaaatatgtccaccaaacaatctaattgttaagcctgttctgtcaaatcaataaatcaaataaaacttactttctgtcaaaaaattcatatttcatttcaaataaaagtgctaatctgccttccctataaaccctccctcaccacccatcaccaccacagacagacaacaatcaacttgattctaaaagaaagaaataaggtatggagtcctgccatgggtttgttacctggaggaaacatctatgattttgaccaaagcagtcatcactttgctatcttcaaattcacacccagaacctaagaattttttttttttttttggagacagagtctcgttctgtcacccaggctagagtgcaggtgcttgatctccgctcactgaaacctccgcctcccaggttcaagcaattttctgcctcagcctcccaagtagttgggattacaggcatgtgccaccacgcctggctaatttttgtatttttggtagagacggggtttcaccatgttggccagactggtctcaaactcctgaccttgtgatccacccgcctcggcctcccaaagtgctgggattacaggcatgagccatcgcgcccagccccagaacctaagaattcttaaatggtccctttagtgggtgaaccagaggatttacactccctgaagcaatcaaatattgtaagatttgtgctgggtcagaagcatgactgactgcctttgtcaagtgggaggaaagcaatttgtgaatggagaggtaggaaggaagactcactctgccacaggtgctctcaggcaaccatattagaaattatcaaatgcagacattgagcatctaaataccattaaaactatttttgcatgcaaaattcctgaaaagtctccatgaatcccgaagtgtatatatacacccactttaaagacaactaatctaaaaaacagctccagagtgcttaactcaacattggaagccaggcacacaaaacgcaaaagctgtcagtcataatgttctaagaatagaagcagaataaagataacaaggcaatgtggtaaaagctttaggatacgcaaatttgacataggggtgcagagcttggattctggaatcagaaagtctggggtttggattccacctgtactacttactagccatgtgactttaaataaatttctttatctccttggggctttgttccctcctctttaagacaggagcactattgatgttgatgatggcagtgatgatgttttaagtatctgtacttcactgaattgttgtgaggattaaatgaaataacacaaggcacttagcacaaaacgtagcatgtagtaaacattcaataaatgctaacacaacattaggagggagagttttacttaataaaatatgtccaccaaacaatctaattgctaagcctgtccttactgtcaaattaataaatcaaataaaaccctctcctgagtgtaaatcactgcccatttttgccagcagtttagactatgagtgaaaagaaggtttttaggaacaccaagccaactcaggcaaaatggagacatattttcaactacaggcctgtcctatgtccctaaaattgccttccatgaatgtaaccccaatcagagtatagtttaaggtagaacataagaatttgtccttcttactattgacccaagggataaacagcactagtaaaattctgcttttttatagatactctcaaatctgtatctgaatttctaaatgcatttaagatgcccggggtctaaaaacatacaacacagttaacaacaaagaaaacgaacttaggagggctgagttagaaaacccctacagctgttaagacagtcttttgcaaaccaagagattaggaatttaatttgtacaagtatggaggggacttccagccacttgtctgagagagcttagtacagataagaaattaatgtgcctgaatgacttagacttaattcttataaacactctcacttctgaaatgggaccggagctttgcctttgagtggacatccaaaaaggaaaaaaaaaacaaaaaaaaaacctgggaataagagaattaacttaaaaactcataaaaagcaaggcattactgtacatctgataagactgaaaaccatatgaatgcataactaatgaatttcccacacaccaagttcatgcaaaatcacacagttaattccatttcatacttttaaaccttcactagaattggttgtttttttaatctttactttcccatctactaaggtaagtcagaagaccctggatgtaaacatatcaattgcctctaaaataaagaccaagtattgaaatagtgaagaggatactgcattgtctcctagtgcttttgaggaagcagagcccaaaatcatggctcattttactactggccaaactgtgaagcagaatatatcactacatgtagcaaataacaagtaagcagagaatcaaagacatcacaatgatatatccataaaaaaagtattatcatatttgtcctaaagacaactctagaaataattctatttatctagtaagaaaaggcatgaccatttactatatataaaaacataatctttcaaagaatgtcaaaaatgaaaccactatattatccaataaattctgtgaccggggagagaaaacctactaatctctaataaatggaacctccacatcagagatattagaggtgctgtttttctaaacccatttaatgtagctctttgagcttgcaacaggatctccatgacaggtttcatttctaaaattcaattaaaacttatctacgatttaaataggtaccatatggggatgaattttaggaacctatgtaacttgaggcatctgatgacactgttaaaaggagttgtctattactgcaggaacacggtaatttagaaatggcatcctaggccgggcgctgtggctcacgcctgtaatcccagcactttgggaggctgaggtgggcagatcacaaggtcgggagatcgacaccatcctggctaacatgatgaaaccccgtctctactaaagatacaaaaaattagccagtcatgctagcacatgcctgtaatcccagctagtcaggaggctgaggcaggagaatcgcttgaacccgggaggcgaaggttgcagtgagccgagatcgtgccactgcactccagcctcggtgacagagccagactccgtctccaaaaaaaaaaaaaaaaaatggcatcctatctaatttaatcacaccataacttagagcaagttttatattttaaactatatagctttcaagtagcaatctcaaatcctataaatgaagactgcattaaaatgttaaatgtattgttataacatttccttcggaaaccagatttaattataggatcatctataatgtcttgcctttatcagaggaattggggaggtaattaagtaagtagagtgtatcactttacatttctggtcccaataactttcggaacactgtgtaacaaaatgtgctatgagaaaagagtacttgtaaaattattaccgtaatacaaataatcaacttcttcaagacagaaaaattcttggctataaaattcagaggaaaattccaaacttatgacaagatgaaaatactgaaatatatttgacatttgaaaacaaaatttccagaagtttctctcacaaatacacgagacagaaactgactgattcagaggccacgcacctgaagttgtctcaccagtcttaaaagattatctcaatacaagaaatgattgtctttccaatatttctttttcagtcttatagtctacagaagtatccacataaggagagctagcaggacacacacaccataaatcacagtaggcaggtcagctctatgcttagtcagttcttcattctacaccttctcccagttagaagcagccccatctcctctggggaattaattgccatgtaatcatcacttggattactgagctctactgtttcacttccagctttttaagagaattgctttcctcccacttttttcaaatagaagaggtgaggagatcaaaatacaacaagcactaatatacccttccccagattcaacatttgttaacaactttccacgtctgcttcctctctacatatgtgtatctgtacgttcttttgctcatccatttgaaaataagttgcatacattttaactcatccctaagacctttggcatatgattcctattaagaataacataatcaaattagccaggcgtggtggcgcatgcctgtaatgccaactactcgggaggctgaggcaggagaattgcttgaacccggaaggcagaggcggcattgagccaagatcgcgccattgcactccagctagggaaacagagcgagactccgtctcaaaaaaaaataataacataatctcttacatgatcacaatacatgatgctgaagccactattctggagaccacgctttgagaaccaacgcacagagactaagataaaactgctgttcaataaatgctcttctcctcatcctctactcttccctttccaaaagtcaactgtcattatcctatgaaaacagaactttgaatatgttatacaatcaatttgttggcagggaatacccatccccaacatatctactgagagactaaataaacaaatggtcaaaggccagatcgtaggtaactacgacccacgacctgcagctacaagcccaggcaaccaacctattatctacaataaccagtctaggaagtcagactggttactgtctagcaactagcccaggaagcccaacaatgcccttaagaatttgtacaaagccacactatctgtgatcatgcctggggaacacagcaagatctcatctcttttttttaaaaaaaaaaaaaaaaaaaaaaaaggacaaaatggccaggaaatgattagtaactgtcagcttccctaatttttgctcctgcttccaatgtaggaccaaccagagaaagccaaaaatgtacccttaactaatcacacaggttgctatgcttttagttggctcacctacagcttcccacaggaacagcctacaaacagggcatacctgaaaccttcccttttttccactctaaagtttaccctgctgggcacagtggctcacacttgtaatcccaacactttgggaagacaaggcaggaagatcacttgagcccaggacttcaagatgagcctgggaaacatagtgagacccagtgtctacaaaaaataaaaataaattagctggacatggtagcacatgcctgtagttccagctactcaggggggactgagatgggagagtcacttgagcctgggaggtcgagactgcaatgagccatgatcacgcccctgcactccacgtggtcaacagagcaagagcctatctccagaaaaaaaataaaataaacaaaagttttcccattcctctgtcttccttgaatctccaccaaattgaatagatggtggtggattcccttactatataaagaaagctctgaataagtagcctttgattgtactcatttgggtagacctcatttatttccacaaccagaataaaatcaattagttatttttgtgatgtttttgctctttaacttagaattccttcttctgagacagtgtgatatggggcaggagggacctgctttggagccaggaagacctgggtttggaaatctgacttctccagcgattaccttatgcaagttctataatctctttgaacgtgagacctgtgtttggaaatctgacttctccagcgattacctgatgcaagttctagaatctctttgaacgcccatttcctcactgatgttctccatgaagggaacaataagcacccactgcttagggctgccctaagaagagaaaataaacacaaaaggacaccgtgcctgacacagagaagtgtcaatgaagtcaggtgctctgactgggctatgttcttcagctttgaaacctttaatcctgtgagtatgaacctgctgacgttaggtgtggaaaggttttttttgtttgtttttaagtaatgttattgggagtatagagccaagtccctcactttagaaactaaaagatgagtgttgcagcttcggcataccgttttgactactgtgacagaaaatgacccaaactagttcatgtaaaatctcatcaacaggccgggcatggtggctcacacctattatcccagcactttgggaggccgaggtgggcagatcacctgaggtcgggagttcgagaccagcctgaccaacatggagcaaccccatctctgctaaaaatacaaaattagccgggcgtggcggcacatgcctgtaatcccagctactcaggaggctgaggcaggagaatggcttgaacgcctccgggaggcggaggttgaggtgagccgacatcgcaccattgcactccagcctgggcaacaaaagcgaaactctatctcaaaaaaaaaaaactcatcaacagaactatagggacatcccagactcccaaagactgagtttcaactgataaataactcaataaatcaggctgctctctcaggaaatgcttgatttgatcacctccgttgttcttctctcaacctgcttcttttgcttactcagctgcacacggccctgaaaaatgcccaccccaagatggcagtgatctataatttcataaagatttgggttacacaggtgtatgcatttgtcggaattcatcgaatggtatacttaagacataggcattccactgcacttaatggatctagtctcatttctgtctccctcactaaactgtgacatctcaaggacaaaaaggaatcatattcgacactgaatcctccacgctggcacaatgcctagcatgtaactgaatctcagtaaatgcgtgattattaaacaaaggaagcaaactgaagaatttgagaaagtctacttattgggatttattctgaaagatgtactacaagttcacattttaattaatgattacattccagtgaattaatataaacgtatttaaattttaatcattatgaagtgaactatatttataagcaaacaattagtgacttaattaaggtgccaactgttcagtgtacatgactctaccaccacctagtgtaaataaatgcatattaccacatttggaaattccctaaagacaaagaatctcccaatggtgggtcacaaactaacatacttcaaccacaaacattcagcaggtgcctgccggtcctggaaattatgccaggctccagaaggacagacacagctcttgtctgtgttgatcactgctgtctcctcagggtttaggagaatggcaaagcactttgctggccttcaataaatatctgttagctgactgacaagattctgggattaaaaggtgactaagttatcttcgggaaagacattcagccattcaaaaccaacagcattttataaacaatgaaatattattctgcactaaaaataaatgagctatcaagctctgaaaagacacggaggaaacttaagtgaatattactaagcgaaagaagccaatgtgaaaaggctacacactatacgattccaactgtatgacatttaggaaaaggcaaaactatagagacagtaaaaggatcagtgatgaccaggagctggggagggaagggatgaatatgtagggcacaggggattcagggggcagggaaattactctatgatatgatgatggtggatacatgtcattacacatatgtcaaaacccataggatttacaacaccaagggtgaacgctaatgtaaactattcactttgggtgataatgtcatgagtagaaggtgatcggttgcaacaaacgtgccattctggcggggggtgtccattgtaggggaggctgtgcatgtgtagaggaagagggtctatgcgaactctctgtgctacgcactcaattttgctatgtagttaaaactactctaaaaagtagttttttttagtcaataaaatttttttactttaactttagatatcaaataagcaaaacccaaatctaacaagtacatcaaaaatatactgtttttttaaatgcctacataaatgctcaataaatgttatttcctcacctccgtagcacaaccgcaactgcttaccccaagtagctgacatgaagtggctgtaaagaagccactgtttcttcatctgtgaaattaagacagcaggactaaatctctcacttcctattctaatttaacattcttttaaattttaaaagaatagatcactaaacctaaacttttctaaaatatagaaaaaggaaggaaactgtcaaatacttacagcatcacacagtgacaccaaaacctgacaacgaacacattaaaaattactgtcaaatctcacttgcgggccaggggcggtggctcacacctgtaattctagcactttgggaggccaagatgggtggatgacttgaggctaggagttcgagaccagcttggccaacatggcagaaccttgtctctcctaaaaatacaaaaattatgggtggtgttgtgcacctgtactaccagctactggggaggctgaggcacgagaatcgtttgaactcgtttgggaggtggaagttgcagtggacagagttcgcacctccagcctgggccacaaaccaagactccgtttcaaaaaagaaacggaaaaaaaagactcatttataaatattggtgcaaaaactttaaaagtaatagcaatgagaactcataaatgcactaaatgaaggataggctataggcacaactgtttactccagtgattccaggagagttcactattaggaactctactcatacaagcaaccatataagtaggtcaaaaaagaaaagttatatgaccatctaagtagatgccaaatagacatgatgaaatttttaaaccgttcctgattttaacgcttagcaaaatagcaatagatgactatttccttaacataatggaaaaatacatttcatatcagtctataactttctaatgttttactggaaacattactgaaacactaaaacaatgacacacacaagcatttctgttgaagtctgggaggaataaagaaagcccaccattgggcttctagattaatattcatctagaagtaccatactagccaatgcaagggaaaaaaaatcttatgtgagttttatttatttaccacacatttttacagtgcttactatatgtcagatactgttctgaacactttacaaatactaaatcatttaattcatataatcgtcataataataaggcagtactattattatctcattttacagagggagagagcaaggcacagagaacataagtagcttgcgcaaagtcacatagctagcaagttagtagaaacaggcttaacacacaagcagtcatagttccagagccggtgcttctcaccactatgctatatgaaacacgatatcggactgaaggaggcggaagtatccatatatgcagatgatatgacacatttgcaaaattcaagggagaaaaaagttgaaacattgttataagtgagaatttagtacagtggtggattacaaaatcacataaaactacgatgcttctatatgtaaacaataaaaacttagaaaatatactataaaaagatgctatttacactactgacaaaaaaggtaaaataactagaaataaaaataagtagatagttcctatttgaataaaaaattacaaccctgctggtttatcagtgaacataaactccaaatttaccaaaagcgaggtattcaaaaggtatgaactgacttaaaatgctcctcaggcacctaagtaaaagccacagggttgaaagcaaaccagccttaaaaaggcccaccgtttcgccacctacctggatcaggtgtatgcaatacacttgagctttgtcagctaacccaattatgcccaatcttttaggccaacccttaacaaatttaataccttctattaccagcccaagagcacggtcatgatacagaaacacttttctgcaaactgttagtaaatctctactacaccttacaacagtccacattttaactactaataaagcactgaagttgggtgaggatctgatggaacaagtggatcttctagtcggctcctattccactttaaggcctaaggttggcagttaatgcccagtcaaatcagattaggtaatacgtgaagaaattgttcacaatgcaaaaaagagaaatcctgaataaacattcagagaagtgtcccctaaaaagtaaggatcattcaactatgaaatgagttaacatgggaaaccaagattctctgtaggaaatagtttaatgggataggtgtgcatccataaagaaactgctatgcattgaggtggggaaaaatgctttaaccgtcaccattagcaccataatcagtcagtcagtcaagcaaccaggcaaccattacttatggagttgctactatgggcacaactctgcagcagtcaaaataaaatgtgaggtatgattccatcaagagaaatatttattatatgcttggagaaacaaacatgaagagaatacaaagcaatacatgaaaagaaatacataaggcaaactaataatgggagaatttctctctgagttcccatatatattacaggaataaaaatctaaggagcaatcaatcagaatagaattttatttcttccaacttttagaagctgaaaagatttggaggactataaaatgtacacaggcaaataatccacggcagtagtaataactgatgagggattattaaaaacacactaaagcctcaaacgtcagcaatgtttatcatcctatttcattaaaacatattcactaattaatttcagtaaccagagttaatttaacaagtcactgtgctaggcttttactgaatgagtcaaaaggaaacacataaaaatactcaaagatttcttatataaagcaacaggactggatgcaagctctaagggcagctgtttaacaatgaaaaaactgggactgaaatcaagtttgtgactgaaaataggcacattgagctctgtagtcacctctatttatagtactgtaataaaagccacatattgggttaaatcaatgtcctcccatcccttagataacccactctacaatacaacaaatttataactgaagatgtagggtgataattcacattaattcagcaaatatttactgagttatgatgctgtgctcagtgcctgaaatgctaaatttaataagacatagacccagcattttttgtttgtttttttaaataaagacacagtcaagtccaagtccctgatctgaaagagctcatgttatagagaatttctcactttgtagggagagaaaaagtattcctttaaaaataaagttccttgaaacagtcctgttttccaatcattaactacctaaccaggaagatagagaattggaaaaccaccacatttgcttataagaactgaatggaatatgaattggaaataaaaatgaaatatctctaaaaccgtcatgctatactggattgaatgtacatcaagaaattgtatttccagtcctacattgagaaattttatttacacaaaatctattacacaaagcaagatataaccagctaatatttcattgagctattaccaaatgttaagaggtttcctagaaagaaatgagttctattaaaagctttagggacactgagcctccaaatgctatagaaaagccagatactatagaaaagccagatactgccttgaggcaaaaatgctagaaagtgatagaatgcgttctttacaatttgcagctaggttattacccatgataaattgataaccattcattaactttgagagcaatagacaactggcaggctatttcatgcctcaaagaatttatggcaaaaatgacaggtgactttgaattctgaaaaggattcttggaaattattactttcatgcattcctttaaataaacttggaggcagatataggtatttgctgctgatatgaattaaaggtcatgattttctacatcaatgataaaagaattaatgtttatcggttgcatcagtctgtcaatcaacaacagatacgtgaatcaggcacttaaagtatatcctgatagctgatatccactctgagtcatagcagggaaaaactatgcaaaaatacatcaataacctatattaaaacagtacaattaagagtaggaattatgtttgcaggttctttgctggccacctccttggtacctaccacaatgttggtaatcccaaaggaatttgtctctggcccaattttcttctcattctccctgtttctaagctgatatatatctaagccttcagctatcacctatctctaccttctccaggaatatctctctcttgagttgctccgattgtcaaccctggcttcacattagcattacctcagtcgattttaagacataccaaactgtgtccctgtgtcatataaattaaatcagtatctctacgaataggaccaaggcatgaatttgttgtttagtttccctaataggcacacaaggtcgagacccactgcttttctagatccatcactccagccatctcctggactggtcagctccacctgaatatctcacaggcacctcaaatttcccatgtaacatacctactcatccaccaacaccaagctaaagcattttctcctctgccctaactgaccccaggagcattaggcagtccttccacctagcttccacagtattctgtctatgcctctgttgaagcatttagcaccatttattataacttatattttccccataagactgtttctttgtcctgctttgttttaatatgcgaagaacccacaaatgagtgggaccagaaggtgagtgatagccaaaatccaaagagaaatcaaatatctataatcaggtctaaggagtcattgcaaggttggaaaactggagacatggctaaggtatcattaagcaggcagacacaagatcaaagttatgaaggaggacacaaggggatgggaatggtgtacccagggcttagctttattaaattccacctagtacaccgaatggaccagactaatccaaatctggctctaggttaaagaaaatggtcctgtaaagtctacttccccaaagaatatcgaatttaagttctcctttgtgctttcacttctacagccttatatggagccttccatctcttgagtagactttttttccttttcttgtatagacttttaaaacagcatcttaattcatgtccatactgatcatctctggccacttcaggctaacactgaccacagagttatatttcagaagaataaatctttcgagaggtgaatgttcaagggtaagaatagagaaaaaataaaaacataaaataaaataataaatcttctccctcatcactcctctattggaaactctcaggtgactcttagaaaataaggtccatgaggtcaggagttccagaccagcctggccaacatggtgaaaccccgtctctattaaaaatacaaaaaattagccagccatgatggcaggcacctgtaatcccagctaatcgggaggctgaggcaggagaatcacttgcacctgggatgcggagggtgcagtgagctgagatcgtgccactgcactccagcctgagcaacagagcgagactctgcctcaaaaaaaaaaaaaaaagaaaagaaaagaaaagaaaagaaaagaaaaagaaaaagaaaagaaggtccaaattctctaccatggcctatacagcctttctcaacttggctgtaaccaatacctccaaccattctcccacataatcaatactacattcacaatcaatattctccatctgttcacaacttagtgcttttatacaagctgtgcgtacagcagaagtacccaatccactgcctacctactatccaaaatttacagatcctgcagaaatagctcaaatgctacctcttcagtaaggctatttataactacaccagaataaatggacatcctcattcactactgattctttccaaaagtttttctggaggccctactatgtgacagtcactagcataaactttcctatagtattttgttcaaacttgagttatgacagttatgatgttatatttaaaacgtatgtgattttatcacctgcatctgtctgttcatttcctgaagataacaagcattattttctggtccaactttcctgtttttctgacttgggtccaagaggggctcaggactccatgttgtgcctaataaagacttccctgatggcaggtcacagctgtgggcacccgagggtcaggctacaaggacagatattaaaataatgactgagcccacatgtagaatataaatagtgagccaagaaagtgaagaaaggtcaaaaggcaaagtattcaggtcttccatctcagatgagaaaaggagagttaaaagtgagaaacaagacaagcagagttggaaaaactgaagactaattctgaagtgatatcatcaacatagctcatctgtgcatgacttgatatactttgctggaacaaggccataaccttcaagtagaaaagtcattcttttttttttttttttttttttttttgagacagagtctcgctctgttgcccaggctggagtgcagtggtgcgatctcggctcactgcaacctccgcctcccaggttcacaccattctcctgcctcagtctcccaagtagctgggactacaggcgcccaccaccgcgcctggctgattttttttttttttttttttttttttgtatttttagtagagacggggtttcattatgttagccaggatggtctggatctcctgacctcgtgatccgcccgcctcagcctcccaaagtgctgggattacaggcgtgagccaccgcgcccggccggaaaagtcattctaaatacagtacattatatccatctttgtaactattctgcagcctaacctagtgccaggaacatgtgatgtgaaaatgtgctgaattaacacttttgcaagtaatgattataacatacacgcatatattctatgtgtattcatctgacccagtaggcaaaacaaagctactggaaatactgaactgtagaataggatgttgatatggttcagctctgtgtccccacccaaatctcatatccaattgtaatccccgtgtgttgaaggaggggcctgatgggggggtgactgaatcatgggggcagacttccccgtgctgttctccttacagagttctcgcaagatattgttgtttgaaaatgtgtagcacgtcccccttcactctctcctgctctgctgttctcgtgatagttctcgcgagatcttgttatttgaaagtgtgtgacacgtcccccttcactctctcctgctctgctgttctcgtgatagagtcctcaagagatcttgttatttgaaagtggctcctgctctgctgttctcatgatagagttctcgcgagatcttatttaaaagtgtgtagcacgtccccattcactctctcctgctctgctgttctcctgacagagttctcgcgagatcttgttacttgagagtttgtggcacgtcccccttcactctcttgttctgctattctcgcaataagagttctcgtgagatcttgttatttgaaagtgcgtggcacgtcccccttcactctctcctgctctgtcatggtaagatttcccttctccttcgcttccagtttcctgagacctcccagccatgcttcctgtacagcctgcggaactgtgagtcaattaaactgcttttcttcataaattacccagtctcaggtagttttttacagcagtgtgagaacagactaatacaggtatcttatctgaaaccagtgacttgaaactactaactcatggcatacagtaaatatcaaaagactaatttattctaccacctataagtcacatacagtattaaagcctggaaccaaaatgtaaaacaatcaggagctttggaaataaactgtcacgtgaactgaagattcttctgtcatttggctgcagaggaaaccattccgccacccaaaaaaaaaaaaaaaaaaaaagccacaaagaaagaagcagggatgaaaaaacacaagataacacacttaggctcttgaagtcattccactttctagtttcattcccttcccaaatcacaagacacacccctacgcttgatttctgtgagataccctgaatccttttaatatattcttctttgcttcagctaacactggtttctatttcctgcaaacaaacaaatttcataccaaccataagtaccacagtgctttacctcgactgcctttattatatccaagaacttcattgtcaaaaacatctattccttttacaactctgatttcacttcttactcctcttctcaattaccaatttattcaaatatctactgagcacctgctctagcacttagtaacagaaagatgaatatgtcatggtctctgcactcaagcacagtctagtccagttttttcaagctgtggatcttgatcaatttgtaaaatcaatttacttgtcctgagaggaactttttaatatttgaaatataagaaaattaaaatactgcatcacaagaaattaaatattattttctacagcttttgtttcagttacatgtgtgtttttactgaatagcaatatagtatgtatatctcactgtgggtcatgaacaaaggatttgaaaaataccagtaggcccctatttcctaataatgtgaacaaatgccaaggaagaagtcagtcaaaagctgtgccttagaaaatcctttagtgttttaataaaaaataatttcaattggtgttttcctagtttatgttgatttcataagtacttgaaaacagttgttggtttgcctcaagtagattaaacattccgtcttgtttatagttttaattagctaaacaaatccttttctctttgccttgaacattacaaagaaacttcaattcagcatgtcagaattattataaactcctaattagctaagtacaaatttagtacatttttaccacacttacaatgaatgctgtctgggctaaataaaccccaatcatcataagagtatctatcagctacaaggctacaagccatgacaagttagcctgaagaaaagaccatgaggcagaagacagctgtgctcaaatattattaaaggcataaaatgactctaaattgtttaaggtaacttctgaaaaatgtaagttaaagagaatgtagcaatacatcaaataagcgttgggcatcttgtaggatttcttgtattaataatctgattttgtttcaaggaaaattaattcaagcatgtttattctctagtttaaaggctgtccatctttatcagatagtggaaattatctgaaattagtggaaattagtgggaaaaaaagtggaaattagtcaacaagaatatttcctaaatacctagtacatgtagctccaggtattatgcagaacactacatatttctggaaaagtcataaaatacttccaaattatatacatgttattatgttaaaatccatagtaaaaacttagaacaattttagtgccaaaaataatcacatcataaacatgtttctatagaaaaatagaaatcatataaagcacagcaatctatttccatgtgttttcaaaaacatatacttgctacttatctatttgttttgctagagagaattaggtaactaaaggctaagaaaaaatatgtaaaaaaaaaattaaaattgagggggctgaggcaggagaatggcatgaacccgggaggctgagcttgcagtgagccaagattgcgccactgcactccagcctgggcaacagaactggactctgtctcaaaaaaaaaaaaaaaaaaattaaaattgagaaaatgtattcgcaaactttgttttctcagacacaggaaaagtaccactattagctggttttcacagagccacacacttttggcatacctgtgttcacgtattcattctcatttattctaaattaattgattgtctgcctaattctagagacataaagatgaaggtactcacagtttagaaaaggaacaaacgtataaaccaaatgtaatttaatttgcaaagtgcaacacagagtagagtacctaatccaggctagtgtggtagggagggcaaggaaggcttccacaaaagaggtgaaatctaaaacaaaggataggaggcatccaggtgaaggtttggtttctgaacacttttacgtgtgtggaggtgtggaaagcctagcattgtgagtacgggcatggcaagaagaattcgcctgctgggtacagtgcatcctcccgcggggcctgctgggtacagtgcatcctcccgcggggcctgctgggtacagtgcatcctcccgcggggcctgctgggtacagtgcatcctctcgcggggcctgctgggtatagtgaattctcccgtggatgctgcaggaccccatgcctagaggtctggagaactgtgctccacagtgatcagcggtacccccatccttggacctgcctctcccacgactccatgggggcctggcctcaagtcataggcccccgactgtgccactgtgtccactggtaattgtacacctgagcaatggaagggtcacacagaccccaccacccacaaaactgcatgtcagatcaccccatctctgggcgcatcccttgaccccgaggctcggagggcagaagaatcaccatcaggccatctggtatagctgaaacaaactcagcctggagctgagagaagggtcagaactggagggctacacaaacacactaaggattttggattttatgttgtaagaaatcaggattcagagaaatcttagatagctcactctatgagctaacaaaaaacagattagtaaataagaaatgagaattaagaaacattttaggtcgaaatgagatacatactatacaatttgctggtaaacaaagcaacaaaatacattttaattgagtagaaaaaaagaaagaaaaaaatggtaggggacagcaaaatcacatctaagaggctgtggcagggatgacatccaggtgagaaactgggggcctgaactgtgtagtaggcatggaaaggagaatgcaagaaaaacttggtgatataggaaggaaaatgaaatgaacttgctgaatgactgcaatgagattgagaaaaggaaaaagtcaaggagtggttcaagatgaggcagggagggacacataggcatgctaacaatctgaagccctgaaccgagaacagtagctaggagggtaggaggggaacaagaatgaataccaggtgacgaatcaggagactaagatagaaatttaggcaagaggttatggtatgatggtttcaactaggatgatgatagcagagatacagggatatatgtatatttgagaaacattctactgctgaaatcaacaggattgcagttattaggctaacaggtcagggagagggagagaggatgtcacaaggacaaaacagtggggtactagttactgaaataaggaaggtaggagagaagcaaatttaagaatgaagattgagaatactgttttaaacatgtggaatttccagctcctctgagatatctaagttgaaatatcaactagacagttaaatacaagagtgtggggccaggcacggtggctcacgcctgtaatcccaacactttgggaggccgaggcgggcggatcacgaggtcaggagatggagaccatcgtggctaacacggtgaaaccccatctctactaaaaatacaaaaaaaaaaaaaaaaaaaaaaacattagctgggtgttgtggcgggcgcctgtagtcccagctactcgggaagctgaggcaggagaatggcgtgaacccaggaggcggagtttgcagtgagccgagatcgcaccactgcactccagcctgggagacggcgagaccccgtctcaaaaaaaaaaaaaaaaaaaaaagagtgtggaattaaaagaaaggtctgtttagactgaaatataatttcaagaataacaattatataagtaattgcaactctgtaagacaacagaggaggcatatggacggaaaagatggcccagaaacaggtctaaaatctacactttagatgccaggcgaggatgagcctgcaaaggaagctggagtctctgtttattaacaaaggttttgagaaatttggttatgaagaagagatggtacagtagccttaagaagtgtaaggcaaacggagagggtgctctttgttttctttttgaggaaagacaatatagcatgtttaagagctgatgggaatgtgtcagtagagagagaaaaaggtttaaagatacacaagaaaaggcctggtgcagtggctcactcctgtagacccagcactttgggaggccgaggtgggcaaatcacttgagctcaggagttcaagaccaacctaggcaccatggcaaaaccccatctctactaaaaatttaaaaacttagccaggagtggtggcatgtgcctatgatcccagctactcgggaggctgaggtgggaggctcacttcagcccaggaggcggaggttgcagtgagccatgactgctccactgcactccagcctgggtgacagagacagaccctgtctcaaaaaaaggtatacaagaaagacagaaaatattcaatagcataagtttccaagaaggccaaaatacacgggatccaggacccatgtgaagggtttagcccctcctctccacgatggtgtctaggtaaactgtttgtgtgtctgtaggacagtggttgaggaaacactcttggagccacacagcatcctctaaattctcagttttctggctcactgtgttaagattagtctggacttatcaataaattgttagccactaaagtacaactggttctgtgtagtctttttttcccccatggatctgttaatgtttatttattagtactagcatcttcctttgttctctgtgttaaagcaaagaaagaagagggttttgtcatataatctgattttagcttgacttgggaaacttgagattgtcatttaatatatcttcttgctttaagaaataaattccttgtgtttacaattaattgatcacaaccagctatggatttctttgttccttcgccactcccactgctttacttgacaagaaaaaaagaaacaaagaaattccttgaaaatgaggaatacaaactgcagggataaaatataaatcaaacaaaagcatctcagctaaacctctttttttgttttccagatgctactatccttcaagatggtaattaataaaagagagaaaaatgcctaaacaccaactgatgttttcttgtcaaatctgtttcatcagacccaagggatatggcaggagatggtattctacaaaataattcggattctctttctaaagacttgaattgtttcaggaaaaataaacgaattcacaaatcagtaataatgcacttgtaggactaactatgagctgccatcactctgtaaatgaataaaacatagcggcatctacttctaaaactagtgccaaatacaccactaataactcctcgatgatgcagggaatcagtgctggtaattaacataaattaatgaaggaagttgaaaagttcagaagaagtattaaaagaacacctatcggggcggggcacggtggctcatgcctgtaatcccaacactttgggaggctgaggcaggaattgcttgtgcccaggagtaccagaccagcaccagcctggggaatatagtgagaccatatgtctacaaaaaaattaaaaatcatctggattattaaaaaataaataaataaaaaacagatgctggtaaggctgtggagaaaagagaacacttaaacacttgttttttgtttttcatttttttgaaacagagtctcactttgttgcccaagctggagtgcagtggcacaatctcagctcactgcaaccttgcctcctgggttcaagcaattctcgtgcgcctgcctactgagtagctgggattacaggcaagcaccacaacacctggctaatttttgtatttttagtagagatggggttttgccactttagccaggttggtctcaaactcctggcctcgtgtgatccacctgccttggcctcccaaagtgctgggattagaggcgtgagccactgctcctggccacttatacactgttggtgggaatgtaaattagttcaaccattgtggaaaacagtgtggtgattcctcaaagacctaaaaacagaactatcatttgaccagcaatcccattacttggtatatgcccaagagaatataaatcattctaacctaaagacacatgcacatgtatatttactgcagcactattcacaatagcaaaagctgaaatgcccatcaatggtagaatgcataaagaaaatgtacctatacaccatggaatactatgcatgcggccataaaaagaacaaaatcatgtcctcagcaggaacatggatggagctggaggccatcatccttagcaaactaacacaggaaaagaaaaccaaatactgcaggttcttgcttaaagggggagctaaatgatgagaacacatggacacataaagagggacaacagacactggggcctccttgagggtggaggttggaaggagggagaggatcaggaaatataactgttggatactagacttaatatgtggatgacaaaataatctatacaacaaacccacatcacatgagtttacctatataaaaaacctgcacacgtatccctgaacctaaaataaaaattttaaaactaaaaatgagctgggcatggtggcacatgcctatagccccagctactcaggaggctgatgggggaggatcacttgagcccgggaaatcaaggctccagtgagccatgatcatgccactgcactccagcctgggcaacagagtgaggccctgtctcaaaaagaataataatttttaaaattttttttttaaaaatgctgggcgcagtggctcacgcctgtaatcccagcactttgggaggccaaggcaggtggatcacttgaggtcaggagttcaaaatcagtctggccatcatggcaaaacctcatctctactaaaaagacaaaaaaattagccgggaatgggggcgtgtgcctgtaatcgcagctacttaggaggctgaggtaggagaatcacttgagcccaggaggtggaggttggagtgggctgagatcacatcactgcactccagccttggcgacagagtgagactccatctcaaaaaaaataaataaataaaatttaaaaataaaatacacttaccaataaaacaatggcaagttgctgtgactctattacttaggacaggagagacacatcatttgacagaattagatttcacatactttaggatgctacctgttttgcttgaactacccaacataaatataagggaaataataaaaatataagagcagaaataaatgaaatggaggctagaaaaacaatacaaaagatcaatgaaacaaagagctggttttttaaaaaacacaaaattgacaaacctttagctagacaaaaagagggaagactcgaataaagaaaatcagagatggaaaaggagctattacaatggaaatactaaggatcgtaatattatgaacaactataggtcaaccaactcaataacataaaaaaagagataaattcctaacacatacaatccaagataaaagtctcccatcaaagcaaagcccaggacctgacagcttcactgctgaactctaaaaagcaattaaagaactagtactaattcttctcaaactattccaaaaaatggaagaggagggaatacttccaaactcattcaaaaaagccagcattattctgacagcaaaaccagacagacacaataaaagaagaaaattacagacaaatatccctgattaacatagaggcaaaaatcctcaacaaaatatttgtaaaccaaattcagcagcacatcaaaaagagcactcaccagtacttgcagaggccaaggtgggcagatcgcttgagcccaggagttcacgaccagcctgggcaacatggcgaaaccccgtttctactaaaattacaaaaattaggcgggcgtggtggcacatgcctgtagtcccaactactcagaaggctgggttgggaggatcacttaagcccaggaggtggaagttgcagtgagccatgatctcaccactgcactccagcctgggcaacagaacaagactctgtcttaaaaaaaaaaaaaaaagataattcaccatgatggagtgggattcatcccagggacgcaaagatggtttaacataagtaaatcagtaaacatgatacatcacattaacagaatgaaaaacaaaaaatatatgatcatttctatagatgcagaaaaaggcatttgacaaaattcaatatgcctttttaaaaacatttacagttcagacatggtagctcacatctgtaatcccagaactctgggaggttgaggcgggcaaatcgcttgggctcaggagttcaagaccagcctgggcaacatggtgaaaccccatctccacaaaatatacaaaaattagccaggtatggtggcacatgcctgtaatcccagctacttgacaggctgaggcaggagaatcacttgaacccaggaggcagaggttgcagtgggccaagatcacaccactgcactccagcctgggtgacagagtgagactctgtctccaaaaaaaggaaaaaaaattaataacaataataataacaaataaaaattaacagggctgggtgtggtggctcatgtctgtaattcaacattttgggaggctgaggtggaagggttgcttggggtcaggagtttaagaccagactagacaacaaagcaagacattaccactggaaaaactttaaaaattagccgggcatggtggtacatgcctggagtcctaggtacttaggaggctaaggcaggaggatcacctaagccaaggagttggaggctacagtgaactatgatcataccactgtactccagcctggccaacaagactgtgccttcagtcattaagcctctgtacatggtagccttttcacgctaaacccaggctactgcctacccactggcccattcagtacctccacattccatcactagagcaaaagagaacttctggatccccagcatgacaagcacatgccatgaagaactcagagttgccatatgtggccagtctccttggccactcactggagaggcctctctgctgttagccacctgctttccacaatcactctcatctatctgacacacctcccaaacagaggaggtctcaccaacgacttcttcaatcttggtcttcttccattccacaattccccttggccgaaaaaggcccaaacttattataaatcttactacctagcagtcaaggcatggtgttaatatgtcaacaaaagctaaagggattttttaaatggctgaaaccaggctgagaaggcaaagtacaacataagcctggaacattttgttggactggaacattttgtcattccagagagtaagaaagtgttcctaaaaattatggaggtagatcaaatacagaagccagcttgaaggggctcccatgagtcaaatcagtgacaatttcagcatcaaaataaataagaacaataatggaacaaataggaaccaatggaacaaataggaacccatgagtccatactaataataaatagatacataaataaatagaggagaaggtaaggctcctccttagaagaaaataaagacataaatgtggagggaaccataaataatgattcaggtaagaaccaatcaataatagatgttaactctatggaggaaaaaaaactgacgaggaatagacatttgcatggtctcaaagtgtctccccacagactggctcattagttacaaggggaaaaacagtaactactcacccaaggctgtatcttaaccaagtgattaaaacttcaccaactaggagcagatggacattgtgtgcttcctggtgtgatatcctcagaacaacacagtatcacacatacactacataaatactgtcttatgtaatactctggctggggttgaaaaattcaagtctaatcatgagaaaacatcagacaaatctaattcggtttttttattctataaaataactgacttgcattcttcaaaaatattaatatcataaaagatgagaaaaggctgaggaactactccagattaatggagactaaagagacatgacaactacatgtattaatatataatccagctggacacagtggctcatgcctgtaatcccagcactttgggaggtcgaggcgggaggatcacctgaggtcaggagttcgagactagcctggtcatcatggcaaaaccctgtctctgctaaaaatacaaaaaataattagctgggtgtagtggcacacacgtgtaatcccagctactcaggaggccgaggcaggagaatcgcttgaacgtggaaggcggaggttgcagtgcccaagatcacaccactgcattccagcctaggagacagagcaagaatctgtctaaaaataaaaaaaaattaaaaaaaaaaatatatatatatataatatatacacatacatacactatatatacacactatatatatacacacacactatacattgtgtatatatacacacactatatatatacacactatatatatagtgtatgtatgtgtatatatacagtgcatatgtgtgtatatatatagtgcatatgtatgtgcatatatatatacatacacacaaaaaaaatcctacactggatcttggactaaaggaaaaaaatgcaacaaaggacattattgcaacatcgacaaaattggaaaaatgaactagagatcaaaagtactgtgtgaatgttaagtattttggatttgactaagtgtagaatggttatataagagaatatccttgttcttaggaaatgtacactaaagtggtaaggaaagagacattaggtatgcagcctaccctcaaatagttaagaaaaataaataatatttatgtatgtgtgttgtgtgtggggggtggtgtgtatagagaggaaataaataaatatgataaagccaatagagcaaatgttaaaatttgtttacttagataaaaggcatgtaagggttgtctgtactattcttccaacttttctgtaattttaaaattattccaaaataaagctttttaaaagcagtttgaccaattttaaaagatgttttaatttttttaatttttatttatttttttagagatggggtcttgctgtcccccaggctgaagtgcggctgtatgatcatggctcactgcagcctccaactcctgggctcaagtgatcctcctgcctaagcctcctaagtagcagggactacaggcacatgccactactcccagttaattctgtttttttgtagagacagggtcttgccatgttgcccagcctggtctcaaaatcctggcctcaactgattccccatccttggcctcccaaagtgctgggattacaggtgtgagccaccatgcctggccccatattttaaaataagactgcattaacctgtcatctttaatttcaaccatataagcaaggtaacaaaataaactttccagtgaagaagatctaaaaattaatgtgatataaagcatagataaacattttatgagaggattaaaacttcaactagcacagcaattatgcactggcgctctgcttactgttccactcggatttcattttgggctcatcagggatcccctgagtaagattaaaacactttatatcttatctataaatagatcattacatttgcatagaaagaagtttgataaaaatgtagaaagactacttcttaagttaactaggctaaaaactatgcaggtaccaaatttggctcctaatctcagtggcttttaaaagctaattagcaggaagcacaacccaaatatagaaagtgaagacaatcagtccaatcttggggaacaaaaacctaaagtaggtgttacttgtgatgtattatgctctgaataagtccattaaaagcatgtaagcattcaaccaaaatatttgattttaatttttcaatgattccagatgttctttaagttgaaaaaaaacaaaaaaaaggaaaaatgaaaaccaaaggttaaataggcaacactccagcacaagccacaaggggcctcagaaaaacacacacaccacactcctacaaatccacccgcctagcacccatacagaacgtgccataggtaattatgatcatcagaggcttttgatcttgtggaagaagaaaaaaaagaaaacagaaaagtgacaggcagccctttttgcaatttaatgagtggaatatgcttctacaatagctggaagcaccttttactatgttgttttttgttgtcattgtttttcgctatacctgctagattagaattttattttgtttttaaatttttaatcaaagcaatatataccatatggttaaaatggcaaataggctgggcatagtggctcatgactgtagccccagcactttgggaggccaagacgggcagatcagttgggcacaggagtttgagaccagcctaggcaacagagtgagaccctgtccctacaaaaaacagaaaaacttagctgggcatgctggcatgcgcctgtagtcccagctactggggaggctgataggggaggatcgcttaatctcgggaggtcaaggctaccccgagccatgatcacactactgcactccagcctgggtgacagagcaagatcctgtctccaaaaaaaagtcaaacagaaaaaacaaaaagcttccttctcctgctccccaaggcaatcatatctaactatttcatttcagggagtctcccgcagttactctcaaatttcttttttttttttttttttttttgagacagagtctcactctgtcactgaagctggactgcagtggagcaatctcagctcactgcaacctgtgcctcccgggttcaagtgattctcctgctcagcctcccaagtagctgggattacaggcacatgccaccacacccagctgatttttgtatttttagtagagactgggtttcaccatgttggccaggctagtcttgaactcctgacctcaggtgatccacctgcctcggcctcccaaagtgctgggattacaggcatgagtcactgcacccggcctaatgaatctttttcattccctcatttggtaggtatcttaatgttttagtttatctttttacatggcttaggttctggcaatacgagaaactattaagttaactggttctacatcttggagataaatagcacttcagcagtttgagttcagaatatatttagagtaaacctgatttattatgttattattcattttatgttatatattttgaaattcaaaaaaaatgccttgattccttattacttttgctaagtattctgctcatctcagagaagaaagtgtttttggactagctctgtaaattaccactctaggcttgtttcagaaccatttttctaaaaacattattttataaggtcagttgcttctagctaggaatattactgattttctaataggccttgttgggtttcaaaaacactttttaatgtgctaaaattgccccccaccaccatagcagacagacaactacccagctatgcactggtgatctaaaagccatttatgacatattgttattattatgacttactgttattacagtataagagaagaggcggaacacatatgcctcaatcccttcagagtttgttttttggggcgagggggtaccactcctccatgacttaagttttaaagaggtatgctctgcccctcaggggaaagcctgcaggtgtacttgtccagcattcccatgagaccaaatgaggtttgtctttgttgccaaattttgcagcagccgattgttgccatctacccaagccacttttcaaatgctccatcactaataaagctgaaattgtaattttcaaaagataacaaaaaaatctgctaggccatttaaattcaccatacataatacctaccaaaagttattaacaatttatttttaatctaatcctataacatgcttactaatagttaacatctaaataaattaattggaacaggattcaaaatgttctaattctacatcggagtgttttcagcttttacctaaactttgaagtctgtagtcttatccctcacagataagacaggcattcagttttaaacagttcttatagaaatttagaagtgggccgggcgcggtggctcatgcctttaatgcaagcactttgcggggccaaggcgggtggatcatgagatcaggagatcgagaccatcctggctaacacggtgaaatcctgtctctaccaaaaatacaaaaaattagctgggcgtggtggcacgtgcctatagtcccagctactcaggaggctgaggcaggagaatcgcttgaacccgggaggcagaagttgcagtgggccaagattgagccactgcactccaacctggacaacagggcaagactcccctctcaaaaaaaaaaaaaaaaaaaaaagaaatgcaggagtaatgaggtttcactacttgtttttaaactgacactaaacaattattaacatcaaataaattctatgtatagaaatacaaaatataaggattgagtttttaatctctactatatataaaataggactctaacaattactgcagaggtcagcaactccaaggtttatggaaggaaaaggggagacaggagacagagggcgtggtattgtctgcaggtcattctctggctttctttccagtatctccctttctccttccctcccactttccaagaagttgctactgtatgaggaaattctgtcaagtagcaggaaggggaaggctttgagccttgtagctaggactggtaagaactaagaaaattggtcctatctgtgctatcagattaaggagggtgtcgcctctggtacttttggcaaagatggtcaaatccccaactacaacctcacagtgatttgtggcgcattaaaaagtttgtacttggtcgggcgcggtggctcacatctgtaatcccagcactttgagatgctgaggtaggtggatcacctgtggccaggagttcgtgaccaccctgaccaacatggcaaaaccccatccctatcaaacccctgtcgactaaaacacaaaaaattagccaggcatggtggcaggcgcctgtaatcccagctacttgggagactgagggagaactgcttgaacccggaagaggaggttgcagtgagccgagagcccaccactgcattccagcctgggcaacacagcgagagactgtctcagaaaaaaaaaaaaaaaaaagtttgtactttttggccggcagccatggctcacacctgtaatcacagcactttgggaggctgaggtaggtggatcatttgaggtcgggaattcgagaccagcctggccaacatggtgaaacaccacctctactaaaaatacaaaaaaaaatagccgggcatgatggcgcgtgcctgtagtcccagctactcgggaaactgaggcaagaggatcgcttgaaccagggaggcagaggttgcattgagtcgagatcacaccactgcactccagcctgagcgacagagcaagactctgtctcattgtattgcccagagtggagaccagtggcacaatctcggctcactgcaacctccacctcctaggctcaagcaatcctcccgcctcagcctcccgagtagctgagactacaggcatgcaccaacacaccaggctaatttttcatatttttggtagagacagggtttcaccattagctcaggctgatctcaaactcctgagctcaagcaattcacccaccctggccaccaaaagtgctagtattacaggcgtgagccaccacgtccagccaagtttttactttgaagcaatagctaaaatagattttattcacactcaaagcaaaggttataagctatctagattttgttattctatgacaggtaatatagaaatacagttcagaaagataatgacagtatatgatcctaaagctatttttctttcactttaccaacaaattgtaatgttcattctaatgaatatggacattttattctataattacacatcaaagtatacagtgtactctatattttaaaaatatctaggtaattctaatggagtacttcctacgaactcctctaaacattgcaaacgtaccatcatcgtcactgttttacagttaaggaaactgagatgcagaggttaaattacttgcccaatgtcacaaagttagtaagtctcagattcaggatttaaactggctccacgggccagtccaatccacgcctctatgcctctcgggctttaataggcatgcacatcacctggagatcttgttaaaatgtagattctgagttaagttggtctaagactgggcctgagattttacatttccaaaatcatttagttacactgatgctgctggtccacagactgtattttaagtaacaagactgtaaaccactttgccctgctacccaactaagcatcaagaaaggggtgatatttaactcagatcctaacaatctaagcaaagaggcaattatatctgcaattcaaatacagaaccaaggggctgctttcaacctatatgaagactttcaatttacaataaaattcaagacccaactaaaaagaacttgatttgttcaatgtccttatttttctagtctaaggacaaaagcctatttcttcctgtccccatacaaacacagagaagaaaacaactttttcttttttgcagacaagcttttccagttggcatttgactaaaaattacatgtaaaaacaaatacatcaagtaagacacaaaactcttgactattcaattatcaaatacgtcacaaaaacctgtaaaagacagcttgtctctggaacactctagctcagcaactttttaaaggagggattagagaaagaaattgttccaactagtcatgcttctctattgaaaacaacatgattcagacctgacatttaaagacatctctgatgtgaattgaaaccaattttcttctttcaatctagaccaaaattaaaatgtttaattcctattaaacttaaacctcatttctctttctcaaattcaagctatttctaaaaactttcttgcacactcccttttaaggactattcagagttttctttgtgtatgcatcctattttcccaccttataagatacttagataaatataatcaatgaatttgttaggttttaaaattaacatttagtcttactgatacctaattactataatagctttctccaacgggtaccatgatgtcagaaaaaaacacacatacatactaaaatcatctcttaacacgactatattctaacactgtttttgaaaacctagagaaactacctgagacaagtttagaagggaaatatcatttatagcacacctacctgaaagtaggtgcaggctttgcaattaggcagacctgggtttacattcacctttagtgactgtgtgacctacgggcagatttatctaaacttactatgtcatagttctttgttttacatgtagtaaattcaattacatagttacagcaatagatattatagaaccatttttataaaagggaaaattaaagctcatggaatttacacaacttattgaatcacctagtaactggaaaaatcagaatttgagtccagctctatcagactccaatgcccagggcttctcctgtgagccatatacggcctgtggagttactgactgcttaactgaggtaacaagtatttcccacactctcagaatgaatctgtaatttaaagaagcctataactctactgcagcacaaaagccacctgcgtctacactactggtactaagacaaccaactattaaatatcaactagctaggaaataaacataaaagtcagtctcagctaacccaagaaatattaatacatatgtagataagggcaaagatgactgagagaatttgcttctaaggtcctcccagtcttcatactaacaaacatctgttgaggacctactgagaacatatgtggctaggtacccagttacattttacctaacattatgacacgatcaagactaaagaccaaaacaatttaaaaaaattaactaacctaacctaaaccacaataagagtttctacaactgatgctttaaatgataggagatttcactgcatctttggacagtcacctaaaagtagaagtaaatactaaggatactctgtgtaacagagtcaggaggtgagaaagcactggtctatgcacacataagtgctcatatatgcacacctgtcctctgtcctggagctggtacataagtgctcatatatgcacacctgtcctctgtcctggagctggtacataagtgctcatatatgcacacctgtcctctgtcctggagctggtacataggtgctcatatatgcacacctgtcctctgtcctggagctggtacataagtgctcatatatgcacacctgtcctctgtcctggagctggtacataagtgctcatatatgcacacctgtcctctgtcctggagctggtacgtaagtgctcatatatgtacatctgtcctccgtcctggagctggtacgtaagtgctcatatatgcacacctgtcctccgtcctggagctggtacgtaagtgctcatatatgcacacctgtcctccatctggagctggtacgtaagtgctcatatatgtacacctgtcctccgtcctggagctggtacataagtgctcatatatgcacacctgtcctccgtcctggagctggtacataagtgctcatatatgcacacctgtcctccgtcctggagctggtacataagtgctcgtatatgtacacctgtcctccgtcctggagctggtacataagtgctcatatatgcacacctgtcctctgtcctggagctgatacataagtgctcatatatgtacacctgtcctctgtcctggagctgatacataagtgctcatatatgcacacctgtcctctgtcctggagctggtacataagtgctcatatatgtacacctgtcctctgtcctggagctggtacacaagtgctcatatatgtaaacctgtcctctgtcccggagctagtgcattaagtgctcatatagttacacctgtcctctgtcctggagctggtacaagatcatggttcatactccaggaatgagggctagaagacctggttccagatccagctctgtcactcacagctgtgtgacctgggtcaagtaacctctttaagcctcagtcactttaactgccaaatgagtataaaaatagcacttaatttacgaggttgttcatttaatacacttttgttgagattacatcttgccactggcatcctgctaggcattgtggattaggtgttaaaatgcacgtgatgtgtttggcatgtgtcaaaaagcgggatttttttttttttttttttttttgagacagggtcttgctctgccacccacgctggagtgcagtggcgcaatctcagctcattgcaacctctgcctcctagactcaagtgatcctcccacctcagcctcccaagtagctggaactacaggtgtgtgccaccacactcagctagtttttaaaatttttgtagagccaaggtctcaatatattgcccaggctggtcgtgaactcctgggctcaagcaatcctcccacctcagcctcccaaaatgctaggattacaggcttgagtcacggcacccagcccagagcagggatttttgtctgttgtggttctctgctgtatcttcagtaccaacaacagtggctggcacgtaaagtctcacattaaatatctgctgtatcttcagtaccaacaacagtggcatgtaaagtctcacattaaatatcgcaacaaatactgaaaaaattgtttagcatcaggtgggtcagaaactactcccccgacccttgtttggattcagcctgtgtatttttaggtatcactaaaagaagttcaaggatctttttttaatttctttttagtttttataacagcttcatagagctataatttgcaaacaataaaagtaacccacttaaagtgtacaatgcaaccattttacattcacagagttgtgtctgccttgttttaaagacagggtctcacaccatgttgaccatcctggcctcaagtgatcctcctgccttggcctcccaaagcgttgggattacaggagtgagccaacacacccaggctctttcattttaaaaagagaagtcgggctcctgagactccatgtgtgagtttctgtcacacgtatttaaagtacttttaattgaacattttctgtaacaaaacactaaaacatacaaagaagtaaagcataatgcactctcatgtactcatcaaccaatttccataattatcaacttttttttactatattaaaatgtttcaaataccttagaaggttagattaacaaacacctctctattcagacacatctagttcctattccgagagaaaggggaaaagatataactacattatctgacacaacggtggctcttacgtctgctcccttacaaaatgtcactgtacagcaaaaataatttttaccagcaatgagtatccatagaaaacatagtaatcaatcccccattcccttccactatgctattttgggtccttctgacaaaatgaaagtaaatctcaatgcaattatccaagttaccttttttcaaaagatcttttttttttcttttttgagacagagtcttgctctgtcacccaggctgaatggagtacagtggtgcaatctcggctcactgcaacctcagcctcccaggttcaagcgattctcctgcctcagcctctcaagcagctgggattacaggcgtgtgccaccacacccagctaattttttgtatttttagtagagacagggtatcacaatattggccaggctgatctcaaactcctggcctcaagtgatccgtccaccttggcttcccaaagtgctgggattacagccactgtgcccatccaaaagatctctttagatctcaagttctataataactaacagagaaagagcaatacacatagactatagatgtaattaatctgttccaaataccttcaatatgccatcttccttctgcagatctgtaatggttgatttcacatgtaaacatgactgggccacaagatgcccagatatgtggttaaacattattttttggtgtgtctatgagggtttttctggaaaaaaaaatagcatttgaattggtgaactgaggaaagcagattgcccttttaaatgttagtagatatcatccaacctgtgagggcccaattagaacaaaagaatggagaaagggtgaattctctctctctctctctgattacttgagctgagacatcagtcttctcttgctcttggactgagacctaaaccatcaatcctcctggttctcaggccattggactccactttcctgggtctctaacttgcagagaacggatcatgggacttctcaggctccatatatatatatatacacatacatatatacatacatacatacacatattcatatatgatcatatatataattatatatataaactcatatatgagtatatatgatcatatatgattatatatatatgaactgatatgagtatatatatgatcatatatgattatgtgtatccatagaagatatatatatatagagagagagagatcgatcgatcgatcaatactctactggtttctctggagaaccttaatacaggggttcaaaaaaattccataacttctggctgggtgtaatggctcacacttgcaatcccagcactttgggaggccaaagcaggaggatcactcgagtcctggagttcaagaccagcctgggcaacataatgagaccctttctctactaaaaataaacaaaattagccaggaatggtggtgtacacctgtagtcccagctactgggaaggctaaggtaggagggtcatttaagcccaggaggtcaagcctgcagtgagccatgatcatgccactgtacaccagcctgggcaacagagcgagaccctgtctcagaagcaaaaaaaaattccgtaacttctaacatcaaagtgatcctcagtttgccatgagaggtaaaatggtgggtcagcccagggcatataatctttacactaatggttatcacctaagggcaacatgcagaaagccacagcagtgctccttagtgataggatcctcaatgttatagatacatcctcaatgttacagatggtggtacttcttacccccatataaattgatttatcatgtgtctacatctatcacatacataagcatcatgtggcacaaagtggtattaccccagattttttttttccacagttacaatggttgacgaaagccactctgtcgcctttcctggcctacgtcagggccaagttcaaaccctctccctaactgcagattagcagtcatggtgggctctccacagctctcactcagaggtgccagtacacctccctgcacatacagcgggataaacagctaggcaatctcagtcaagtgctttcttctaaagaagggccagcccctgaactaaaagacatataattttggccaataaaactaaggtaacaagttccatatgttttataaacataagatacgataaaaaacacaaagtgctccagtttcagatacagggaaatcaaggccatatacttctcagtaggggaaacgtccaacaagatcctgggaaaccagcagttggggatagaaagaggcaaacactgctccacagacaagggcagaccaaggagcctctgattccccagagtctacagttatatgcagatctctcaaggggatgaaactagttaacccaaatttcaggtttcttctgacttagaccatatgtccttacagcaccaggttgagctcattgcccctctcttgaacctaaacaaagcccagctgcagacttagaaaggatttactgttcataacaacaaaactaattttctactgtacccagacgatctcctctaaaaatgttcctttttaagtgaccaagttaaaggtaaaggatgacttccccctcgatgatatgtatatttcaattgatgtgcctgaacattaagagttaagctgttgataagtccttgaaatcaggcattctcataaaacattcacattaattcaagcaaaacattaaagagcattacataatgagtcatactaaaatggcaatgaaaagaacaaccattaagacacccagagtatcagtttagctccagttatcatttatagcatgaaaacatgtcttgagactaacatcaaaacacttacctcagcccccagaagtatcctgttcttccccttaaatacacaacatttaccaaaagcactgttttacgcaaatacaaaaggctaatctaaaaatgaaactaaaaaaacttatttggaagaatattcactaagctatctctattgcagatgtaaagccttaaaggaccatttaagggaaagggaaggctgtataattatgtaataatgttctctgatacaattgtggctctcacataagctttcttaaaagagaagagctatgaacaattaagatggcatagcacaggaaaaaaaaatgaccagcaatgagcattcacattctttctcctctctcatcctctctgctttttgggacctttccaataaaaggagagcaaatctaaatacaatccaagtcattttgtggttaattccaaataatgttccatattttaataaatctaccattgctttttcacaattgtaacagatgccactcccaactccttagatgtgaaacctaaaaacatatcacttcaaccaaaatacctaaactattgtactagttacacctaaaaacacatcacttcaaccaaaatacctaaaccattgcactagttacacctaaaaacacatcacttcaaccaaaatacctaaaccattgtactagttacacctaaaaacacatcacttcaaccaaaatacctaaaccattgcactagttacacctaaaaacacatcacttcaaccaaaatacctaaaccattgcactagttacacctaaaaacacatcacttcaaccaaaatacctaaaccactgcactagttacacctaaaaacacatcacttcaaccaaaatacctaaaccactgcactagttacacctaaaaacacatcacttcaaccaaaatacctaaaccactgcactagttacacctgaaaacacatcacttcaaccaaaatacctaaaccactgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctaaaaacacatcacttcaaccaaaatacctaaaccattgcactagttacacctaaaaacacatcacttcaaccaaaatacctaaaccattgcactagttacacctgaaaacacatcacttcaaccaaaatacctaaaccattgtactagttacacctgaaaacacatcacttcaaccaaaatacctaaactactgcactagttacacctgaaaacacatcacttcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatgacttcaaccaaaatacctaaactattgcactagttacacctgaaaagacatcacctcaaccaaaatacctaaactattgcactagttacacctgaaaacacatcacttcaaccaaaatacctaaactactgcactagttacacctgaaaacatatcacttcaaccaaaatacctaaactattgcactagttacacactaccagagttttatagataaaatcctgtctgtacatttttccaatttccaagataaatatcattttattatgaactcacagcatcacagaatgtataattactgttgacatgtgaaaagtttccaacaggaatgaaaagcttcattaataataaagatctagccagatgcggcggctcacacttataattccaacactttgggaggctgatgcaagaggatcacttgaggccaggtgttcaagcccagcctgggcaatacagtgagacccccccccacatctctacaaaaaaaattttttttaaatagctgggggtggtggttcgtgcctgtagtcccagctatttgggctgaggtggaaagattgcttgagcccaggagtccaaagctgtagtgggctaggatcacaccactgcagtccagcctgggcaacagagcaacactctgtctcaaaataataataaaaataataataaagatcatgggctctgagtgcagacagaattagctacataatttgagcaagatataacttctctgaacttcacttttcttatctgtaaaacaggaataatataaagagagacctcagaagattttgcaagactaaatgagataatgcacactaaagcccatggactcattcctgacagaaagcaagtattccttaagtgttgaccatcatcctcctctatactgagtaaaatgtatcattactgcttacttatcagtcacatataatatcccaggctttacgctggatgctgaacactttatcatagattatctcatttgttcttttaactaatcttataaggttgtttttattattgttgttaaccccattttaccaatgggaaaactaaggtttagctagtcagtttgcaggttcatgaaattagtaaacggcatcatcagaacctggaccagaatctatctgacaacaaagctccttaacagatatgacataagtattaacaggttcaaattcctctagaatgggtaataatagaagattccatacccaagtataggtgatattcatctaataactacctgaacttctgaccttttaggccaaaagtgaaaaattgaaaccccactccaattcttgaattgatatttaatctctaaaatatttatttcagggataagtgtgaagattataatacctcacatttatataatgctctggattaagtcatttgctcttcactaaaatcctatgacacagataggaattataaccccatttcattcattctgtagatgaagaaaatgaaaatcaaagagattaagtgatttgcccaaggtcacaaatctagcaaatggaagcagcgctcaaacctaagacttacttctccaagtacagtcctatttttcagtataccatgtagacaaacagatgaataatactaattaaaaagtgatcttcaaaaaaagtaatctcaccacccccaaaaaaactaattcactcatcatactcattctcattgatgatcaaagcaatggtatagttctccaatatacaacatttaaagaaaggagataagacttagaggagcataacactgttcaaaaaggtaggcccatggacatataaggaaagcaaaagatccactggtctccaagacaacaaaataaataaaattacccacctatactaatagaaaatatggtctagaactatactgaagaattttgtttaaataagaacagtcagaatgggtagacattgacggtacaagacacaatacctgcatccaagagcttccagaggaggtaaaaaaagtatttaataattactggttcaaatagttgaaatatggttgggcatggtagctcacgcctgtaatcccagcactctgggaggccaagcgagtggatcacttgaagccaggagtttgaaaccagcctggccaatatagccaaaccccatctctacttaaaatacaaaaattagccaggcatggtggtgcgcacctgtaatcccagctactcgtcccagctactcaggaggctaaggcaagagaatcacttgaacccaggaggtggaggttgcagtgagccgagattgcaccactgcactccagcctgggcaacagagcaagactctgtctggaaaaaaaaaaagttaaaatacaaggtggtaaatgtgataaaagatacaatgttctgagtacctgaaagagtgagcaccaccctaaacaaccaggagacaatcaaagaatgtgttcatctatagaaagaaaatgtaaaaaaacagaagtctcaaaatacaagaaaaatagttacaagcaatttcaccctactgcagaaaaccatgcccagtgtctaacttaggctccactcagatcttttttttttttttttgagatggagtttcactcttgttgcccaggctggagtgcaatgacgcgacctcagctcaccacaacctctgcctcctgggttcaagtgattctcctgcttcagcctccccagtagctgggattacaggcatgcaccaccaagcccggctaattttgtatttttagtagagacagggttcctccatgtttgtcaggctggtctcgaactcccaacctcaggtgatctgcatgcctcagcctcccaaagtgctgggattacaggtgtgagccaccacgcctggccctcccttttagcatttcctatgcatggtggccacatgaatcatgtgacctcgtaataaactgatcttccacaagtgcctcattcattaaatcctgctcattaaaagttgggctccaaactacaattaaatccatgtatttgatctgtgaccgaaaaattattatattaaaggtagttattacacaggtaatttcattaaaaagaagtctgggcattttaaaatagacttctagaatcatctgccagcttgacttgtacatcttgactgaaactaacagaagaaaggtattactatagatctctgatacagaaaggtcaagttcaagaaattcagtcaaaaagcaaaaacagaagaaagtgaagggtgctcagaaaaagtccaagctaagcacagaaaaaaataacagagatttaggctgggcgtggtggctcatgcctgtaatcccactttgggaggccgaggcgggcagatcacctgaggtctggagttcaagaccagccctgacaacctggtgaaaccctgtctccactaaaaatacaaaattagccaggtgtggtggtgcatgcctatagtctcaggtactggggaatctgaggcaggagaatagcttgaacccaggaggcagaggttgcagtgtgccgagatcgcaccactgcactccagcttgggtgacacagtgagactccgtctcaaaagaaaaaataaaaatagagattttaagcaggctgttatttacaactgctgcaaatattcatataaaactactatggatttagccctagtgtcctcaaactttagtgccaataagaccaataaagtagacagaagacagattgcaaaaggaatgcgtctccatcctgtaggtaaacaggtatcaaaattttatgagtaccagcgtcacccagggagcttggcaagaatgtagattctgtgccttaaaacactagatattctccggagaggcactgagagccagatttttaacaagtcctctctctctctctccacctcccactccccagtcattctgagggaggtgaatggtaggtcacttctgaagaagcaatgcaggccgggcgcggtggttcacacctgtaatcccagcactgtgggaggccgaggcgggcggatcacgaggtcaagagattgagatcatcctggctaacatggtgacaccccgtctctactaaaaatacaaaaaattagccgggcgtggtggcgggcgcctgtagtcccagctactcaggaggctgaggcaggagaatggcgtgaacccgggaggcggaggctgaggttgcagtgagccgagatcatgccactgcactccagcctgggcgacagagcgagactccatctcaaaaaaaataataaaagaaaaagaagcaatgcaatatttcaggtactatcctagtacttttgtgtgtgttgtctcatttactcctcatgaagatcacgaggtagctatttccctattttatgaatgagaaaacagaagcccagggtttaagaggcagaaggttaaacaactaaggagaaagaaaaaggacagaaaggaaatttgctctattcgacagcgatttcaaagtattctaaataaagaagctgacattctaaaacatcattaaaaacaaaagtatcaatagatcagaaagcttcaatatcttgtgtcattcagagagagagagagatgtggaaggccaatattgaaagttataaataactgtttaaatatttaaaatgcaactcagctgtttgtagtaggctgtacgtaagccaaggtagaggctgaaagtacactgtatgaagttatttatgcttaaaatttgcattatttgagcttgaagtctttattttttttgagacagagtctcgctctgtcacccagtggagtgacaaaatcacagctcatagcagcctcaaccccccaggctcaagtgatcctcctgcctcagcctcccaactacctgggactagaagtacgaccaccgcaccttgctaattttttcctttttttttttttttttttttgtcaggacagggtcccgctgtgttgcctaagctggtctggagcttctgggctcaagtgatctcaccttgacctcccaaagtgctggcagtataggcgtgagccactgtgcctgacttaagtcattttcatagatgaattaaataaccacctataaacattcgctgtgacatactatttctggtgactacacagaattatagatttgatactaataattcagccagtgaccctaatcttactagcttccataatcagtagtaccaactaagagtggtaataataatcaagagaaggagtcagtttcaaaaaatactcagaaaatgtctcagatgttatctgcagacagagtgctctgataatcctgcaaatttcagtcactgagacatttattgaacatccttgtgtacttagcaatgaactagggtcttgggattcacagaaaaataagacaaggtctccgtcctcaagaaggctaagaccacagggcaaataactaataaaacctaataaccaaattaagacctaaattatataataatacctaaattccaccgaccaatcgctgagggctggactcaatggctcacacctatactcccagcactttgggaggccaaggggagaggactgcttgagcccaggagatcagtctgggcaacacagtgagactctgtttctacaaacaattaaaaaattagccaggtatagtggcaggcacctgtgttcccagctattctggaggctgaggtgggaggatcgtttgagtctgggaagtcaaggctgcagtgagccatgatcatgccactgcaccccagcctgggcaacagagtgagaccctgtctcaaattaaataaataaatggtcttttaaaaagatcaatcaatgagaactaagtagagcaaggaaagaacacgtattaagtatgagtacctgttatacacaaaatacttccacatgttttatctcttttaattctgaggataatctgaagaggcagggttcaagattaagaaaacaaagttcagagctgttaagtagtttgccccaactcacataactcataaagaggataagacaagggaaagcaccaaagtgagagtaagtatgaccggttcacaaggcactgagaccagtcagactaaaacacaggatacactgggaaataaagctggccagagttgggccagattagaaaggaccactagttatgcttgatgaaataagaatctgtcagccgggcgcggtggatcacgcctgtaatcccagcactctgggaggccgaggcaggcatattacctaaggtcaggagttcaagaccagcctggccaacatggcaaaactccgtctgtactaaaaatacaaaaaaattagctaagcatggtagcggacaccggtaattccagctagcggggaggctgaagcaggagaatcgcttgaacccaggaggtggaggtggcagtgagccgagatcgcaccattgcactccagcctcggcaacaagagcgaaacttcgtctcaaataaaaaaaaaaaaaaaagagagagaaataagaatcagtcattaaaggcatatttaaggaagactactaatatggcaacacttcatagaacagattgcagtagggaggatctgcaaacagatataatcaactaagacacagctctagagaggagctgcccctggctgataccatcggtcctctagagaggagctgcaggaactgaccgatactatcaggtaggcaggtgttgctccaagctggccaggccctcacagggaggcactggtgtccttctgttgaacatacacaatttcacagaacatggacctcagacaaggccactctgtgaccgtgatggatcaaaacgaaaacaagaccactctgtaatcatgtctgaacgcaactctgttcaactaccgatgtgctccctggctggacggcaggaactaaagctagagcctgttctaggatggtggcagtaggaatagaagaaagaaagcaatataagtgacatttccaagtaagaataaaaaaaactgttagtaggcaattcaagagaaaaagttgagactcatacatcgcttgagtggatagcatccaactgaaatattataaatctaatctataatatttaaaatctatatttttatttaatctagttaaattagtccatgtttttcagactgaataaaagatgatgacagaaaaatatttagtaggtaattagagattaaaaaataatgatgcctgcgtcccacctccaaaggctctgattcgatcagtactgagtgtagcctaggcatcaggatttttccaagctccccaggtgattccagtgtgcagctaaagctaagaaccggtatctcagagaacgccgatggctcctgactaggaggaaaaaggacaaacgatggatagggtagaaagggacccaagaaagtactggggcaaaaaggtaagcgagaaacaaaaaatggctgaaagactagacagacgattcccagacacagcaagagtcatttaaatgatgaaagagtcactatttaacaaacgatagaaaccaggcaagaaggttaacacaggtttagatgactaggaaacatgaccaacaagtaaggccactactctgcattagcaaaatcttcagctaggagactttcaatctatgatcctctgaggatgcctggataacaactacatgtaccactacaaatagatgttaactgtgtacagcctgtttctaaatatagaggtggattcctccagcccttttccttcctagtgttcccacactgccacctcgtgggtcagcactgcaaggagccggtttgaactggaagggatttctaactggccctgtaaattcacaaggcaggtacatggtaaagcctcaattcaagggtttaatccttatgttttcctctgtttaattacagtggaagacagccttaaggtacattgtttcttttgtgggtgataagaattttctaaagttgattatggtgatattagtatgtacttaatgccaccgaagggtacacttaaataaataaaagggtaaagttaatgttactttatatcactttaaataggcaaatggtatggtatatgagttatatctcaataaagctgttacaaaaaaaggaggaggtggccaggcacattggtctgtagtcctagctactgggggggaggagaggggggctgaggtaggaggatcacttgaggccaggagtttgaggccagcctggacaacatagtgagaccttgtctctctgaaaaaataaataaataaaaagaaagaggagtaggaggaggcagctgtagcaaatacataaatggtttctaaaactgcagaaaacttaaaaaggatgtcagaaatcactcaataccttcatttcaaaaaggcaaaactgagactcagattaacttacttaccctacttacccaggcagtaaaaactaggccaaaaaggggcactattaacccatttatggaggtcttctatggtctcccaatcctgagaagctttttctcttaagcttgatcctcagcaatgctatcttttgctgcctaacttactactgggagatcacactcacaccaatgacttcacagagcagtagtatcaccactattccaatagttcaaaacccagcactcacccttcaccacagagcactactgtcaccactattccaatagttccagctcaaaacccagcactcacccttcaccacagagcagtactgtcaccactattccaatagttccagctcaaaacccagcactcacccttcaccacagagcagtactgtcaccactattccaatagttctagctcaaaacccagcactcacccttcactgcttccttgccctttaatcggtcaacaacgtgggtgaactcctcaacatgtttggttccaggccctctaccagtcccctagctcaggccttcatcacttcacatctagaataacgcacattttctcctaactggaatcctcatctccagtctttccacttctctccctcatcacaaaattcacccaaatcaggactcctacacaaatcttccatgtgcacctcatactgcagcccaaaaatctctatgggctcctcaagagttgtacctagaaaataaagttcaaaatctcttaacctcagcaaggccttctgtatcacagacgctatcccaacttataatctatcatctatacaaacagcacttcgctgcagtcataatggtctactaaacaatgtatgcacatttcccaattagttattcctccatagttgttatctctaccacttatttcactggtatcatgactttttttttattcctttcccaaaggttctcaactctggctatgcattagcattacctgtgaagctttaaacaattatgggacccttaaggatgttgctcagacatctggatatttttaaattccacaggtaaatgtgtaaaataccaatgattcatagattttaagtaagtctttttgtaagatgcttaagttttcaccactaaaactgagcatccaatattagagtcaaaaactcaaaaattaaactgcccagagaaactgttacctactacccaaggtttcttgatcattggtacaacataaatctttccaattaacatctactttctaacaagacgtaaacacagcagctaaaaaatgctaacaaggattaaatttttatatactcaaattcatttgtgagaaacatctatcataaccatgccaattaaaaattcaacataattcctgtttgtcctacctatgacaattatttaaatgtaaacagaacatgctaatgtcaatgtccagtttaaaactgaacatgcagaattatttatagatattataagcagttggactaatcccagctgtggcaattttaccttagcccttggatataaaggcacagagaagcagggagtcagtgaagatggaaaagaaagataggagctgtcaacccagactgctctataataatctggggagtattaaaaatgtctatgctctgccgggcgcggtggctcacgcctgtaatcccagcactttgggaggccaaggcgggtggatcacgaggtcaggagatcgagaccatcctggctaacacggtgaaaccccatctctactaaaaatacaaaaaattagccaggcgtggtggcgggcgcctgtagtcccagctactcgggaggctgaggcaggagaatggcatgaacccgggaggcggagcttgctgtgagccgagatcatgccactgcactccagcctgggtgacagagcaagactccgtctcaaaaaaaaaaaaaaaaaaaaaaaaggtctatgctccagccacactccagacaaattaaatgagaatctctgagggcaggacccatgcaccagcatttcttaaatctccccgagtgctttcaatgtgtagccaatgtcgagaaccaacgagttacaagggaatttctcaaaggaaatctaaagatgagagctgttcaaagacaaacacaaagagggaaaaagtcccaagaactagttagttacttcagaagtaagttgctttctcttatcagtttatgaacaatttttacatattacaaatatacactttttggccatgcgagtgactcacacctgtaatcccagcactttgggaggccaaggcagggggatcacttgagctcaggagatcaagaccagcctgagtaaatggcaaaaccccatctctaccaaaaataccaaataaaaaaaaaaaattagccaggggtggtggcacgcatctgtggtcccagctactcagagggcggaggtaggcggcttaggtggcagaattgcttgaacctgggaggcgaaggctgcagtgagctcagatcatgccactgtactccagcctgggtgacagtgagacttcacctcaaaaaataataataataataataatattcctttttatgttgaaatattttcgtcagtttcttgattttttgttgttgttgttgttattgttttgatatggagtctcactctgtcgccaggctggagtgcagtggcatgatctcaactccccgtaacctctgcctcccgggttcaagcgattctcctgcctcagcctcccaagtggttgggattacaggcgcacaccaccacgcccggctaattttgtatttttagtagagatgggatttcaccatgttggccaggatggtctctatctcttgacctcgtgatctgcccgtctcagcctcccaaggtgctgggattacaggcgtgagccaccacgcctggccagtttcttgatttttttcattataagatggttcattaacataaggatgtttttaacttttatatattcaaatctgcccagtctatcaatctatcttatccccttgtggttgctcttatttatttttgctgcaaatgctataagaacaacaaaaagaggacttgcttacattataattctcaacccaagtaatgaattttaaaaatcagtattggccagatgcggtagctcatgcctgtagtcccagcactttgggaggccgatgcaggtgaattgcttgagcccaggagttcaagaccaggctgggcaacatggtgaaaccccatctctacaaaaaatataaaaattagccgggcatggtggtgcatgcctgtggtcccagctactcaaggctgaggtaggaggatgacttcagccaggaggttgaggctgcagtgagccaggagcacaccactgcactccagcctgggtgacagagtgagactctgtctcaaacaaacaaacaaaaagatcaatattagcctactgttataaatgcttttaaatgtttaaaactaaacatgaataggccgtgtataaaacagtaaactggcaacaagtaaactttaaaaaggaaacattcttgattgtactatatttaaacaactagtaatggctctgtccattttcacttttcaaatagtagaatgagatataaaacacaaggttatcccacaagtggcctttattttttctatactaacaagtaattattatgtcaaaaactaggggaaaaactcatttacacagaatcttcttgtagtaataaactgtaaggagatcaacaagcacaattttccctccagatcataccaactccaagtaaaactactagtttcaaacataggtttcgactcttattgtgaaaaacatggtcatcatcaataagccactataccatgtaaatttcattagtgagttttatatagatatttatgacaaaatttaacttgtttgcccttttttggtctaattcaaaataagagttaatggcaaatgtcagaggctaagaacagtttggaaagggggttcatgaaggagaccactcagagacagtgttttagtggctaaaaaataagttgcctttctgaaaaatatttgtatgctttttactccattgtccaccagagggagcatcacatctgattaagagataatggggaactcccagatagaaatggaaaatcatctgaaacttgatctacgaggtgctacagatggtagcatatacagttaaatgtaaaatcaaatcagagaacccccaaaagaatctcaaagtgagtgggaggacagcctcctagggagatctcatctctaaaaaaaaattttcttttaattagctgggtatgatgttgcacgcctgtggtctcagctgctcagaaaattctggaggctgaggagggaggatcacttgagcccaggaattcaaggctgcagtgacctatgatcaaaccactgcattacagcctgggtaacacagggagaccccagtctctagaggaaaaaaaaaaagaaaaggaaaaaacaagaaaaatgagcaaaagataaatacagacaaatcacaaaaagatataaatatggcctttaaacacatgaaaagatgtttaacttcacccataatgcaatttaaatgcaaattaaaactatactaagatcccacttctcacccataagcttagcaaaaattcaaaagttcaggctgcaaagctaagggaaacaagtactcacatacatcattagtgggaatgcaaaatggtacaaccccacataggtatttacaccttgacccagaaatcccattttgaggaatctaccctgaagatacaccagcaacaatataaaaatacacacatgcaaggttattcattagagcaatatgcacaattgcaaaatactggaaattgcctaaatatccacacataggaaattagaaagtacagtggatacataaaattgagcattatggagctataacgaataaggaagatctccatgaactgatagtagagtgatttccagtagacacaaagataatgaagcaagtgcaaaactaagaatggaaaataagaacacacatataggccgggcacagtggctcacgcctgtaatcccagcactttgggaggccgaggcgggtggatcacgaggtcaggagatcgagaccatcctggctaatggtgaaaccctgtctctactaaaaatacaaaaaattagccaggcgtgatggcgggtgcctgtagtcccagctactcgggaggctgaggcaggagaatagtgtgaacctgggagacggagctggcagtgagccgagatcgcaccactgcactttagcctgggcaacagagcaagactccgtctcaaaaaaaaaaaaaaaaaagaacacacatatatacttgcttatcttaaaaagaaaaaatataagatgaaccagacgctacggtctgaatgcttataccccccaggctggagtccagtggcacgatcatggctcactgcagccttgacctcctaggctcaagtgatcctcccacctcagcctcccaagtaactgtgattacaagggtgcacaccatcccacccagataattttttgtttttttttttaacaagatgaagtttccctatgttgcccaaggtggttgtgagctcctggcctcaaatgatcctcccacctcgtcctaacaaagcactgggattacaggtgtaagccaccacttgattaagccagactttagagagacatgaaaaaaatgtaaagcaatgcaattctcattaaattttcgttgttttaaaaaatacacacgggcctatagtcccagctattcgggggactgaggcaggacaatcgcttgaacccaggaggcagaggttgcagtgagccgagattgtaccactgcactccagcctgggcaacaaagcgagactctatctcaaaaaaagaaaatatagtttgattccttaaaaaattgttacaacataataaatttacatatatgtaacaattttttaagtaaccaaaccatcaaatatacacacacacacacacacacacacatatatatatttttgttattgttgttttgttgttgttgggtattttttggaggcagggtctcactgtgtcacccaggctggagtgcagtggcgcagtctcagctcactgcagcctccacctcccaggtgcaagcgattctcctgcctcagcctccaaagtagcttgattacaggcatgcaccaccacatctggctaatttttgtatttttagtagagacggggtttcgctacgttggccaggctggtctcaaactcctgggctcatgtgatctgcccacctcggcctcccaaagtgctggaattacaggtgtgagccaccacgccctgccttaaatttatgtttaaataggtattttcaaaacttagttttaatttttatgcaataaatataaatagataaaacccacataaacaaaacatcatcagcactctcaataacgttttttaaatccctatcaaatccattttgataatttgtaaaaggataaaggggtcctgagactaaaaggtctgagaaccactggtctataacaccagctgccttaaatgccagagtatgttaagagcaggggctggggctggggactgtatcgcttctgttgcctgataatgctggattctgcactaccatcaccacagacactgggccctgctgctgctgctgctccttgggaaactggttgttgctggagagtgattctctcaaccattcttctttgtgatactggcttttattcaaagtcctcagagagcatcttagattgaccgaacttaggtcactgcccgcaccctagctgcaagggaggttgagaaggtatttagcctttttggctttttcgatagaaggcagacttggtctacatcccaccaatagtcttccaatgaggaaatcggcaaacataaacagtcaaaaccacaagcattagcccattgctctaattctttctgggaaggtcagaggcaaccttgtggggaatatcacagctctatcaaagattctcagtggatcttagagatggtggtattacacacagggaagacaaatccaagtacaggaaaaaaattgatattccaactgactcctccatgacaaaaagttctaccataataacccgacacaaggtggctggctggtcctgaagatgtgttgccatttggggaatcaggaccagttactactggcagcaaactgggcactctgtaccagcagaagccacatggctatcatgaggggaagtctgtattgttgagttccaggcaccagcctctatccccgtccccatggttgctctgttcttgagccttttgagcaagcaccaggctgtctgaagaacaacttactgctatccacaaagcaggtcatcctgtctgattaagaacgccctctgctgtggcattcacatggaccaaatgttttcaccagggctcagccataaagccctttcccaaacctcgttacagaagaaaaggaagcagtagaagaaacaggaattatgactcccacttaaaaagaaaaatgtagtcacatccataaagtcctttcccaaaccacattattatcaattcttccaccttatttcaaatcctagacccattagccactgcccaggaagttgcaaatcctacttcaagccatcgttcaaggttctgctctttgaaatgattttgctagttgcttgaccttcagggcctccaaggaagagtctgtaacactgcagcaattcacttacgcctggtgctaaccatattttacaaaatcagccgtaaacccagtaacgtctttttacattattttcacagaggtaagtgcttccttgtctccactagcctcttctactctactgacccttaaaccttgggttattttagccaatgtgagaattctgcctttgctgaaactattcatgccaatgtctaacattcttagtaacttcattatttagataattcaactaacctcagcctttgggtttcctgaccaaaaatcttttcttactccctaccttggccacattctgccacaccccgtacctgttgtatcaagacacacactacttctaagcatgtacatatcaagtcaacccattatctgaccactcaccatttctctgaccacatgaggacctctaatccattgattcggccacatttcactggccatcaccttccttacgacctcattccctacctgagaaaccatgatccacaattacaccctcccttgcctacaacttcaacttcccgtcccctctctccgtccatcatgctaacctagcaatcctaggtaaatccagttctcatagccaagcagctggcaattgggagagaaaggaaacatgacccaactaactgttcccactttaaataaacaaacacaagttttaagtagaccctcagcacttttcaacaatcctacatttcacgaggcaatttatgcttctctcctagaagactatttccaatctctcctaaggctgagtcacttagcaaccacttccctagcggtccttaaacttttcaatcaccactgctgttgccttttctggcacctcttcttcttaccctcatatatgaagatgttcccttccatctccaccccaggttcagtccttggccaagagacattccatcatctcaccaaacacagtgagttattaccctttattgcctggtcacatttactcacactgcaactcaaatgcagctgcctttttttttttctttttttttgagacagggtctcactctgtcacccaggctggagtgcagtggcgtgatcaccactcactgcaacctccacctcctgggctcaattgattctcccacctcagccttctgagtagctgggactacaggcatgcacccaggtaattatttgtatttttagtagagacagggttttgccatgtcgcacaggctcatcttgaacttatgggctcaagcgatccacctgcctcgacctcccaaagtgctgggactacaggcatgagccaccatgcccagcctgctttatcttctataactcatctaatctgtctcctgaatatgcgccattttttctataattaatctaatattcctcatgaatatctactctaataaatatccaggaaatttaaaacttgtcaaacaatatctcaatctcttccagttaatactcagactttgtttaactccttacccgggctggtttaaatggctgctttcgggtagatttccctccaaggtcttatcggacatcctagaagaaatagtggcaagaagaccttggatctgtgttgtttctctggatcctcactggtctctgctgcaaggaggtaatcaggtcctatggctgaactggtcccatctcatcttttaggatgtcatgctggctctcatccctggagtctgtgatcctgacattcagtctatagtcacacagtcttttgtcatgacgccagctgttccaccaggccaataagctcctccacctccttcacagtggtatgagagcatttcagaatcccctggtaccacaaactcaactatctagccacttccttctaccactgctgtgctataggcccgtgttggcctatcactaacctgcataacatctcctctcaagattccacataaggagcagagcaaaaggccttctactgctgaccgtcccctcaacccatttaacatccccaccctaaccctagaactttagccagccaagaaagatcagaacacatatttctcacaatctgttttccctacctctgtccccccgctgcccacaatccaccaggactgaaagggatgacacgtctacttccaagtcatcctccttcctcctgggaggcactaagcctcattctcagccttaatgccagatgagctattctctttaccctacagaagaaactatcattagagtttgccagaagtaactcttgatatggaagctgcaggcaacttggaacttgagaaaaccaaagacaaacatacagcgacttcaagttccccaaaatattaatccttgaatgattaacatctcccatgtggtaggccctggggatataaaaaagattagacttagagcactacactagggagtgagaaggtttacaaatacaatcataacaatggaattttatgtgctgcactcaccaaagcaaacgggaaatacacataactcatacccaattgtcaaccaacctgttctacctccatcaaattaaaaatgcatgcaacggcagaaggacaatataagtgatttcaggccggggacagcggctcacgcctgtaatcccagcacttaaggaggctgaggcgggtagatcacctgaggtcaggagtttgagaccagcctgactaacatggtgaaaccccatctctactaaaaatacaaaaattagccaggcgtggtctgtaatccaagctattaaggaggctgaggcaggagaatcgcttgcacctgggaggcggaggttgtggtgagccaagatcacaccattgcactccagcctgggcaacaagagcaaaactccatcttaaaaaaaaaaaaaaaaaaaaaaaagtgatttcaggttataatttcattgccatttactctttctacaacttacatacttcattttcttttccaggcacaacacggaaaaaccagaagccattccttaatgagaggaaaaaggtaagataagccatgaagcaggttcacctttctccattaacaaaaacaagtatacagaactaaagctactaatcaaaacagctctagagcaaaggaaatcatgtaaaacttggtaaccattgtttctggagcctaaggaagtagagatgtgcatcccttaaggacatcatgaggtgatttcattgttgtaggaacatcatggtgtatcctcacacaaacccagactgtacatacagcctgctacacacctaggctagcaggtattgtctgtactgcctactgctctgaggctataaacctgcaccgcgtgttactgtactgaatactgtaggtaactgtaaaacaatggtaagtatttgtgtatctaaatgtacctaaacacagaaaaagtacagttaaaaaatgatataatcatacagggccactgtcatgtatctggtctttcgctgaccaaaatgtcgttatgcagtgcatgactgtaattatcatcaatatctgtttttttaattctattttgatttttcctttcccatgtaactgttaattgctacaaactaacattttcattccatacttaattcagatggaaggcagcagaaggacaggggcagttaggaggaaaattctgccagacattcatactaaaactaagggcttactatgtgttagacactggggctacaaaaactgaaagatgcactattcttaaagacttcacaatggacagtgaataaagagaaacaaattttacttacaagatgacaagtaatacagaaacttatccctcaaggacaggcattcaacagtggcagaaaactgcatcaaacaatgcgctaacatttccctaacactattttcaggttgcagtgattcccaaccaggctctttggaacactataaccactaaaatgggagtgttcaaacagagcaactactaccacaacacaagtgaactgtgtatcctggcaatccaaagtaagtgcaaatattttgtgtctgtgtaaaatactagtaagtatttgtcagtcattatgaagaatctgtttagcttgttttgtttagatgcttagcatttacttatatccctttttctatgtttatgtttgctgatttccccactggataactatcggtgggaagtagagtgagcctgccttctatcttaaaagccaaaaaggctaaataccgtctcaacctccctcgcgctaggggtgcaggcagtgacctaagtttagccaatccaagacactcactgaggactttgaataaaagccagtatcacaaagaagaatggttgagagaatcactctccagcaacagtgagtttcccaaggagcagcagcagcagcagcaccagggtccagtgtctatggtgttcgtggtacctactgcagaatccaatattatcaggcgacagaagtgatatacaccccagatcccagccccagctacttttgcagtgcaatcctaacttggttcagccgatgcccagtcaagtcttggcagactttaaagcaacactgagaactcccccaaaactctttcattaaattccttttttgcttaaatccccagttactgcaaacaggaaaaatgaatgagactaatgaaatagtatggtaaatcaacaagcatcccacccacaaagggtttgtgtagcttattttggaaatgcacaattccgtgtgtcacaagactcaacttcagctctaatgattcaattgccaatttgtcaccatttattcattccaaaacttttctgttccaagaactatcttgaaaggaacgaattgttttcaaccacacagtttacaaaaacttcaagatgctgctctctcccgaacagatgttttcgctgttatcattacttcagaaagcaacagacaaaattattatttggtagctctaaaatgcaaagtcatattcctgaattatgaatcaaatgagaacaaagtaagaacaatggtcaaattacagatacgagttttgcacttaccgtcccacctccacccacctaaatctcagactggcaggtctgaaaagcggccatgcacaaaatcatcgcactcatctcaaaatagaactcttcttcctcgcacacagaagctcaataatatttgttgactgaatgcagttcctattattcatgtatgttacacatttccataaattgctttcacatagcactttacaccggcacagcgcgtccaggcttccaaaacaccttcacgtgaatccctgcatctagaatggtggttaagagttagacatgcctgcacagccattaaatggcacagcacacgggggacccgtgtctgatgctcccacagcacattaattgcccctctatttcagcccttctggtacactgtaattctctctctcacttgatcagctctttgaggaggtcccgttcctcttcgtatccccaggccacacacaacccagaccacagaggtgcaccgtagacatcaagattcttccacctgctgcaagcctgatgctttaccggcggggcctctgcaggggagcctgatttatactcatcccagctcccacccagccccacgcccgccacgtgtgatttccacagccgcaccaaggaagactgtccagcacacagacttttcgtctcccagcaaaattatccccggcacaacgcttccccctcaagtctgcccaatggctttcccatttccaccgcagcccaggttggggggcagtggctgagcctgggccccctcccagccccgctgcggcaacctaggggggtgtccgggcggggcctgtcagcagcgacccgcccccgggcacacgcgcgtcaggggcagcaccgccaagctgcctgtgcagccccatccagcaggagtcccgcggctgccggccgcccgacgcccccccctccccagcaccccacacagctcgcgactcaggtaggcgagggcgctccttacgcacccgagaaggcagcggtcgcagacgacgccacgactccccttgcacaccgtgtacgccaagggatccgagcggaagagtagctctccggggcgcagcggggtcacggcgcgcagcccgtttcccctcttggcggttgcgaacttttccaccttcagcggctccatcctcccgcagctccggcacctcagacggctacccgcgtccagcagcgggcgtctcacgggctgccgggacccgcgcgcctgcgccctgcgcgcacacgtacgcccgaggggcggggcgggcgcgg

SEQ ID NO: 2233 - DNA, 81907 bp, Homo sapiens
ccgaggattgtgagtggaccgttgaggagagcgaccgaccatccggctggtgtccggactcgtactctatggttgtccgcgctctgcgcttcctctctagccgccagtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccgggtgaggtgtagcccggtccccttacctcctccgcctctcaggtcgcctgttttcctctcctttctcagctactgtgggtctcctattgctgcgcgtcgcgccaatttctccctccctaggggactagcgccagaagtcgttcctcacccggctcctggaggagcctgcggcttccacggtctccgttcctttctgttgtgtggcccacagcccgctctccccaccctcgtggatggttttcatttcccccccacacctggtcccccccatcactaccactttggttgtcaagaaccgcgtggtgtctcccttccattcctctctctgggccaatattttccttaattttttcagtttgtgtgtttaaaagacttaaagttaagattaaaaatgaagatgtaaaagcttacaattcctttctaagcttaaaaagattaagactttaggatgcttactgtattccttatgtaaacttagtcaaacacatcgtactgtggaatgcgatttaaaagacccaattttgaagactaaaaataggatgctgtaatggaaattttggcagtctttttttttttacctattgggcaatgttagaagacacggttctttgagagtgttttccgtgtttcaggatcaaacttagagcttttacccattatccttaccaccaaggcaagaaacggcagccaatcaactccgtgtcttagaatacgtacaatcctttctgcttactctactgagagtgtaattgagtttggcatttaaatgcacgaggaaaaggttcctaaggaatgtatcacccagcaaatagtctgaagattatactcatctgatgaagctcaagcggataaagaattgacaactaaatatgaccttttgtgtattataaatttgttaggacatcatagaaaatatctcatcaactgttgtgcaaactgtggggactcactcattggtcttaatttgcttaaattcttttttcgtacagttttctcactgacaattttctagaggtgactttgcatcctctgaacctctctccattactgagctgcctccccctctccccttaaaaaacattttcatagattcagaaatacacttttttccccctccaggacctggagtcctaaatatttttaaatcagataaaatagaattatgtcttcatggttcactcatagaaatgtgtcgttgaatttctgactttttaaaaaaaacactgtggtggctgggtatggtagttcatgcctgtaatcccagcactttgggaggccaaggtgggaggatcacttgctgccgggagttcgaagccagactgggcaacatagactctgtctccttaaaaaaaaagaaagaaagaaaaagagaaaaagaaaaataaacacattgtggttaaaaacaaaacagttattttaaaatgcactgtcttatttcataatgtttgtggaccaaagttagcctactgagtcctagaaaaactgatgtcattttttattttgcttttgagtgttattattttctcttggttttgggaaagagaattacattataatattccctttttacagtgttgatggttcacttgtttgtaattgaaggtacttgaataataagagatttttgtacatcttattttttttctgaggtcccaggtgctgagaatgttgatttcaccttaaagatgaactttatgatcaggatttagacatactttattagaaaaacttgattagtgtgcagtatttcccatcttttttcttaagaagtgtggttttctatcctatgctgtttttgcctttttgaagtaattttgagatggagtctactctgtcgcctaggctggtgccatctcggttcactgcaacctccgcttttcgggttcaagcagtttctcctgcttcagcctcccgagtagctgggattacaggctcctgctactatgtccagctaatttttgtatttttagtagagacggagtttcgccatgttggccagggtggtcttgacctcaggtgatcctccgacctccacctctcaaagtgctgggattacaggcgtgagccaccacgcctttaaaatactttttttcttgctttttacatttaaatatatttatttatttgtgaaggcggagttttgctatgttgcccaggctggtctcaaattcctggcctcatgcaatcctcccacctcagcctcccaaaacactggtattacaggcatgagccaccacacccagcctcttttggcttttaaatgacaactgtaattgggaaatgccaagtgatagtccttgcttgctgttagaattaaggctgtaggtctgtagcagcagtcttcaatagaaatacaatgcaagccatataagtaatttaaaattttctagtagtggtattaagaaagtaaaaagaaacaggtaaaattttagtagtatattttatttaatcttatatatgttattttaacatgaaatcaatttttaaaatgagatattttacattatttgatactaaatctataaaatctggtattttatacttacagcacatctcagtttggagaagccacatttcaagtgctcaacagtcacatgtagctaaatgttaccttactgagcagcacaaatgataggatggtcacatgatttttaagctgtcttcctacactgagagtctgattctgtggggtaaattaaaaactcctcttcctgaagtactgcggtatttaatttgagaagtttctatgcaggaagagagttctaagtctcttccttttagtgtttttgttttgttttgtttgttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagcaaaatttagaaaggaagagagtaggttttatggctgtagaatgctgggagcctgagtaaagtaaaagattaacttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaacttccctaaatactactttagctgctgtgtgttatatctacattaatagctaaattagcctgaaggcctaattaatattcagtgtaatttaatacaggaaacatgccctcttctcaacctttatagtatgaagaaattttaaattacctggtcagtgaacaaactccctctgtcaaatatagtcatgatagacctggcacaatgtagggactatggggagtgttagaggatcaaagacagaattggggaaggggtatagttactggatgttacttgttctgtgagagatgtgtggatgttctataagaaaataataatgttttttgtttgtatttaaaactagatagctgtttattggcacccttttagttggataagagaaaatacattgcttggtttctacaagtgagtcttagcaaatttattgtagttattttaggaagagtaattgatagtgcagtaatcttcagtttttaaaaagccctgataaggtttaactgggctttaaaagcattatatgcttaatgagaaattctaacttaatatatgtatgtcttgatactgttatgtaacctttccagtttagggccttcaagattcacatgaatacaggctttcctttatgtaggaatcattctcatgggggaaattatatatcctctcagggaataattttgttttttaagcatttgaaataattgtttgtaatattcgttaaagaacacatcattagcagaattctgaagtcttataatagcttgagatttcttaaattgtttttatcctttttgagacagtcttgctctgtcgcccagggtggagtgcagtggtacgagatctcagctcactgcaacctccacctcctgggttcaagtgattctcctgcctcagcctcccaagtagctgagattacaggcgtgtgccaccacacccagctaattttttgtatttttagtagagacagggtttcactatgttggccaggctggtttcaaactcctgacctcaagtgatccgcccacctcagcctcccaaagtgctgggattaaaggcgtgagccactgtgccaggccaaatggtttttatcttagttttgagatcctgctctttaacattttggagatggaaactttttgccattataccctccacccttccgtctcttaggacttcctgtttttcatcatcattagccacgtggaaaggaaagacagtgtgtgcctatgaaaatactgacaaatcaagatgatttttccttttagattaagaaaaattctgaaacagtaaatggtaaattttgtcatatttatttacttattttagagatgaggtctcactatgttgcccagattagccttgaactcctgggctcaagtgatcctcctgctgtagcctcctgagctggggctataggcatgtgccacactgtctggttagtcacccttcattgacatttgggcatttgatatttaaattgacagtatctaggcaattatagaaattaacattattttgcaattggcatatgtattaaattttcttatgagaataattgccctgtttttttctggagagccactacctgattaaataatcacatattttttctaccttagctgcattttgaaaactcagtgaattaggtgactgtggttttctaatttgaatgaaggtaaagtaacctttaaaaatggtttttggccagtcacagccatgcctgggactcacgcctgtagtcctagctactctggaggctgaggtgggaggatcacctaagcacaggaggtcaaggctgcagtgaagcatgactgcaccactgtgctctgcactccagcctgggtgacagagtaagaccctgtctcaaaaatacatacataaatgaattaaatacttttttatattatagattttgaaataagttattaaaaaatttgggaactttataagatcaaatgctgctgtccttgagtatttgatagtatactgcttatattttgattttttgtatgcattgtccttgttcattatttttctcttctgcagcttttattcccagtatacaactaaatcttaaaaataatttttagatgaactgaaaaacattgcctaagatttttcaataaggatttttgtgaaaatgtgtgtggtttgttatttagagatgagatctcactgttttgcccaggctagtcctgaactcctgggctcaagtgatcctcctgccttgacttcccaaaatactgggattatagacgtgagccaccactcccagccaaatgtatgttttatttattgaataataaatagtggagttatttatttatgtgtgtgatatgtggtttttttaattattaattttttagaaaaatagaagcagggtttcgccatgttgcctagggtggtcttgaactcctgagctcgagcagagtgcctacttcagcctctcaaagtgctgggattacaggtgtgagtcactgcaccaggcctgagttatttgtttttacctcatgaaacaacaactaacattttagatttttttttccacttgtgaagcatgaaaaagtttacttaaattggatcttacaaggattcatgtaaccaacaggatttcctccctcagcgtcaactcacatgaaaagaggggtggacgtttgtgcaaattatactggttatgatattgtgaaatgtagtttcctggaaaagtcattattgatacccatttttggcatcttaattcaaattcagccatcaggctttattttaaatgatttacacagcaatctctagattcttcttgctacaagtattttaaaaattttgttgtggagttcttcggcatgccagttagagttatacctgtagcattggataagcactgtaaagagccaaaattagaggtaatacccttgctcttccctactttaatcatgtaatataggtcttgtgacttggaagaagattgtcttattaccattacatttgaacttttgttttaaaattaatctgttagatcatatattcaccaaagctcatcttttcactagccagagaaagctgtatttcaaaataacctaaagtaaaatagtatttaattcaagaagttagtttttattatatcaggtggcctcttggttggttatagtttcgtgcattctgatgcctgcgggctttttatccttcctgtctccactgcatagctggggaaaacctagggattgcccggtgaatgccaacagagctttaacctgtgtgtccatggcttgccttccctgaagcctcaaagagaacagctgcgagtgcaaaaaccttatgagcaaaatttctgctccaggaacacttatctgggctgaggaaacatattctaagaatatctgttttgtaactaaagcttccatgtacttgtgtaacgctttgtgtaaaaccacgtactttgtatagcctttgctggagagtttccattttcctccagctcttcagtgtaagtgaaaaaatgtgcccagaatgtctctatagattattctgccttccctcaccttttagttttttccatggaaagctgacaggtcagaataggcatattttattagaaactcgaagtggtggggggtagaagtacacatctttgcctcttttttccttcttgattacagaagtaataatgctccaaagatgttttttaataaaactgagtctcgctctgttgcccaggctggagtgcagtggcgtgatctcagctcactgcaagctccactactcctgggttcacgccattctcccgcctcagcctccggagtggctgggactacaggcacccgccaccgcgcccggctaattttttgtatttttattagagacgggatttcaccgtgttagccaggatggtctcgatctccttaccttgtgatccgcccgcctcggcctcccaaagtgttgggattacaggcgtgagccaccgctcccagccgctccaaagattttttaaaaagataaataaattttaacttgaggaaaacatggttattcaaaaattcgtgttttttctttttctttaaaaaaaattttttttagagacagcttgtcgcactatcacccaggttgccatgcagtggcaagattatagctccgtgcagcctcaaactcctggactcaagcaatcctcccacttcagcctccctagtagctgggactgcaggtatgcagtctaattttttttttttaactttttgcagagatagggcctccctgtgttgccccagctggtctagaactcctggcctcctccaggagcgatcctccagccttggcctcccaaagcacaatacgtgtatttttcagagggaattctcaactttcatcagatttttcaaggaatatgttactcaaaaaaggacaacaaccacagcatcagtttgacttggttggttattgcatgtccttcctaaatctctcttataagcagctatggctttataaggattcctatgtaaaagcatcatttttagtagtattttatttaaaacaaaaataatttaatagattatgaaggaaagtcatagtgagtcaaagaacaaatctgaacaaatcttcctcaagtattttatttatttatttatttatttatttatttatttatttttgagacagagtctcactctgttgcccaggctggagtgcagtggcacgatcttggctcactgcagcctccacctcccgggttcaagtgattctcgcctcagcctcccgagtagctgggattacaggcacccgccgccaagcctggctaatttttgtattttcagtagagacggggtttcatcatgttggccaggctggtcttgaactcctgacctcctgaccttttgtcaagtgttcagacaaaaacgtgcacaaatgtttataacagcattattcacaggagtcaaaaagtagaaacagcccaaatgtccatcaactgatgaatagataaataaaaggtggtatatctgtacagtggaagattctttggcaataaaaagaaatgaagtatcagtatatagtacaacatggataccccttgaaaacatgctgagtgaaagaagctaattgcaatagaccgcatattgtataattccatttacgtgaaatgtccagaatatgtaaatctatagagacagaaagtacatgagtggtttgagtgattgcctggggctgtggtgggggtgcaggagaatgggaaatcactgctagtgggtatgtagggcaggggggatcttttcggggtgataagatgttctagaattgattgtgtacaatttgtgaatactaaaagctattgaattgtgcattttaagtgggtgaattgtatggtatatgaattatatgtcgataaaggtgtcatgaaactcaactagaaaaaatacaagtttatcatagaaaatatgtaaaatacagagaagtggaagaggaaaaaagtaattagcatttttaaaaattccctatttttatttcaatgataaaaaataatataagcttattcaagaacaatactgacactttaaaacaacattctcatataagatttcagtgctctctgggcgcggtggctcgcgcctgtaacgcctgtaatcccagcactttgggaggccgaggcgagcagatcacttgaggtcaggaattcaagaccagcctggccaacatggtgaaaccgtgtccctactaaaaatgcaaaaattagccaggcatggtggcgggcgcctgtaatcccagatactctggaggctgaggcaggagaattggttgaacccgggaggtggagcttgcagtgagccgaaatggcgccattgcactccagcctgggcgacagagccagactccgtctcaaaaaaaaaaaaaaaaaaagaaacaaagatttctcagtaattggtggtgggagagttggatcctcacgtgcctatgataaccgtgcagtcacagtgtataccgtattccactagtgaacaaaactttaatttttacagagcagcatcgtgttcagtgactattattttaactttattgattttttttgcatgtcataattcgtaaatttgttttggtttaattgtgttagagttagaagcacataaaaattatgtttttacatccttttttttttttctgagatggagtctcactctgtcacccaggctggagtgcagtggtatgatctccactcactggaacctctgcctcccaggttcaagtgactctcctgcctcagcctctttagtagctgggaccgcaggcatgttaccacgcgcggcacatttttgtatttttaatagagacgggatttttccatattggccaggttggtctctaactcctgacctcaggtgatccacccccctcagccttccaaagtgctggggttacaggcgtgagccaccgcacccagccacaaattatatttcttaattctttttatcctattaccccttcccttggctaccaccccctaccctccacccacatccacagtgctttaagataaaggagattaatttcgcctgtaggaatccatgggaacttggccttcagacttcaggcaagcaccagagtggaaacatttggaagtctcattctaacatgtttttaccttaaaattttttaaaaattggattaggtttttatgtttttagaaccatcttgccctcccttttctagcttttgacgggacattgccaaattaataggctgttttgaagattactaagatgggcatctttcatttcagtagggaaaagaacatgtgctaaaggaattattcaggtgaaaatgcttttgtgattaaaaatgttcttcagaactgatacttctcatgaagtaaatttcaacagtacaagcaaaccctgttttcctgttgttatgactttgttgttctcacctgtcctccataccgccccaccacagcgtcactccctttatagcctcttcctactggtacctccttattccggttctctttctagaccctctactatcctctgtgtttattttgaactgaactttggattaaagtactacctttttgtagctgttactcaaagtttgtcttcacttgtgcttggaatttgaggttactctactgttgttcagactttacctttaaaattccaggagcatcctgttagtaaaacaatgagttttaaaaatttcggtaaaggtggtcataattcttacaggaaccagttttatcccatttagttcacagattttcattttgcctttttaatgggcatagaattctctttcatgtttttctgtagccgagaaacctagtcaagaatgtgaggtgaacctttcaagtaaaattgtagttgaagaaacaaaagtggaaaggctaggttaaaataaatttgaccctggcctaattccatttatctcatacccactttagaaaagaactaaaacagtctgtgcatggtggctcacacctatcatttctttgcgtttttactaattcatgcttcttttttggactttgctgactcgtccctgtattaatctttcactgacaaaaatatcctctgttctcaagtttccctcttctgtttcctaccagataatacttgtggtttttttgttgttaagtacattttaaacatcatctttagagatataaccatttttttctacatctgtttccttgggtaaaaggtagtgagagactttagtattgtagttcaattgaacaaacattaattaaacaccgttcatatgcctgggctatgttttggtgaggattgtaaaagaagtaatgggcacattctcctgctgcaagcattcaagcacttgaattccagatgggaaataatatatatgcatgaaataacttgagaaaaattctaaaacaataaataagcaaattcgagacagtgtctactaaataccaaataagttacagtgctttaaaataagctctaaaattatcgtgctctaaaaaatgggtctctgaaaatgtttcagtgtggattctgtattaaccattgccttcggctgggcgtggtggctcacgcctgtaatcccagcactttgggaggctgaggtgggcggatcatgaggtaggagatcgagaccatcctggctaacacggtgaaaccccgtctctactaaacatacaaaaaattagctgggtgtggtggcacgtgcctgtagtcccagctactcgggaggctgaggcaggagaattgcttgaacccgggaggcggaggttgcagtgagccaatatcgtgccactgcactccagcctaggcaacagagagactccgtttcaaaaaaaaaaaaactattgcctcaaattataattggcctcttctaaggctaaatagtattattacaatttctgttcctccttctcctcctaacttatcaaactcttcaaccccagctcaaattccatcttgcttatggaatctgccctacataccacaagcagcacagaatctggagccagtctgcctaggttgagtcctaattctgagaactgtttgactttggatgagttgctttacctattagtgcttcaaattgcttgtctgtaaaatgctagtgctaataataactacctaataggactgttgtgaggaattgttactatatgcatggcaaagcgtaagcactatataaatgtgtcttgttattctcatactctggtattacggtcacttctcacaatagacttaaacataaacatttctataaagtgatttatttgagcttaaatattttttggaattttatattttgtatattctgctctataatagctgtttgtgttaacataaaattagcatctctcttccatcctcacctttagaagtgaattgatgttaccagagagtgtccatttatcatcctgtgactttgcagatccctggtcagctttttctctttcctgtttctgttaagtatgtattcattctgccttgttgcccattaggttctgcatgtgtgcttttcactaccttattataagctcttcctcccaaggagcaatgctgtttcagtgatgacaacaaatgtgattattgaactcttagtgctatgcatcttgctatcactagaaaattcatgattcacaaatagccagtagctgggctaggtggctcacacctgtaatcccaacactttgggaggccaaaacaggaggatcacttgagcccaggagttcaagaccagcccaggaaacatggtaaaactccatctcttctaaaaatgcaaaaatggtgggcacctgtaattccagctacttgggaggctgaggcaggagaatcactagaacctgggaggcggaggttgcagtgagccaagattgccccactgcactccagcctgggcgacagagtgagactctgtctcaaataaataaaaataaaaatcacacagagtcctcagcagagtaaataaaacaaaatttctagcggttgacatctggagactatttacaaggatgttcttaatttatctttatggatgactttagcagtttcccataaattgtctcattttattcttacagcaaagaaacaaaggcttatagagttgaactaatttgactaagatttcacagctggcgagtatcagaaaactgtatttgcactgagaagggaatgactccaaaattagagcttcctttcttactgctctgtcttatctctagtcttagttcttgttttgaaagggaacttctggtacttacgaatgacggggcttatcttcttgaaagtggtaataaactgtactaaatttctaaggttaaaaaattaagatgtaacattaccagttttctcttttattgatggtttccttagattttttttaaataaataatctcttgtacctttttttgagaactgtatgtagatttcattctggacatataaatattaagggttaggtagcatttaaagtatttgtggtcagaaattaaatgaatgcatgaaatactgtactcttttgagtaaattctaaaaataatccctaatcatttcattacagacagttggacattattttgccatttaccaatatactttttttttaatataccttaaagaccagagagaaaggtaagaacagttatgaaattgcacttctctgattagaagacttattcaggaggactggaagcagaattttcagacgtttctttctaaatggattctattaacttccacagtactttgttcatagcagaccttcaaatatttggttggcttcatgcaaaaaggaggtatctctttactcccttctgtattgctgatgctaattgaattatcttttaaagattcagcatattttacggggatttaattttgagaacattggtgtctttctgaaggtttctttttttttctttttttttgagacagtctcactctgttgcccaggctagagtgcagtatcatgatcttagctcactgcaacctctgcccccagggttcaagcgattgccccgcctcagcttcctgagtaactgggattacaggcgcgcgccaccacacccggctaatttttgtattttcagtagacgggatttcaccatgttggccaggctggtcttgagctcctgacctcaagtgatccccccaccttggcttcccaaagtgctgggattacaggcatgcgccaccacgcccagcctgaaggtttctttatagcatgtaaaaaaaatgtaattcatcgaaatatccactcacatcctgatacttccttgagtaataatcttctgtctttagttgctatttctgtcctgtattttcattgcaattgtatgcttttcttctttaaccattcccatacatggatatggtaacagccacattggatgaaacttcatcagtgtctccatgctgtattttttctacccataccaatctttttttttgagacggagttttgcttttgttgcccaggctggagtgcaatggcgcaatcttggctcactgcaacctgtctcccgggttcaagcaattctcctgcctcagcctcccgagtagctggaattacaggcatgcgcctccacgcctggctgattttgtatttttagtagagacagggtttctccatgttggtcaggctggtcccgaactcctgagctcgggtgatccgcccaccttggcctcccaaagtgctgggattccaggcgtgagccatcacacccggcccatcccaatcttttagaaacgtagtctgggtccttgtaaagcacatggttgcttaaaaacattccattacagctgcaaactcctaatgtgttctagaggacattgcattttacattttccatttcttataaacttttacaaaagcaatataagtaaatagctgataaagtgttctttgtggctttgaagaaacgttagtagcttaggagatgccctttaccagcagcccgttagtacttggtttatattattttttattcatatgtctgagctggattctgtagggagaaatgaaaaatgttttataggcaaaattttatgagatgtctgctaatatcataggcaaaagtatttttgcaatatgtattatatctaattaatttaatggtatccagtataatataatatcctttaactggggtttttttaaatagaagtgtcttttcattacagcttaaaagatggttgtaaactttcatataagtcaagtacgcagttgttaataaccttatatgtatgtactccttatatttagcaagatgaaatttttcagatccatatgctaagagttatcagatttactggcccttcacacaaatcaaaaaacgaagttaaacacgactttgctgttgctgtttttctttcctctgccttctcccactgtattctatctctcaccatctgttactgacagttatcagcatagagtgacctgtacctggaggtgggttcataactgtcttttaccttccacatctactcagtcctgcaaactgtgaactccacctccatgcttttttttttttttgaggtggagtccctgtctcccagcctggagtgcagtggtgtgatcccggctccctgcaacctccgcctcccaggttcaagtgattttcctgcctcagcctccctagtagctggaattacaggcacgagccactgagcctggccgggcttacgttttgtatccttctcccctttaccccctagtaattggttcatggcccactaggggaagaaaagatggtctttcacaacagatagtctgaaaagcgctggtctcaattcctgtactgggctctggccccgcctccgtttatcaggctcgtcactactttacttcagcactcttattccaaagtctaactattcgctgttcattctgtacttcctcacctttttatttggtcctgtttatttcttctcttgagattacctctccatgcacctcaggtacgagtagaatggagggaacacaccatctcagagctgggttacaatgtcctcttgtccagtgttatctgctatatcaacatttcctccagaccgtggctgaagatgaacaaggcagctcagcagattgaaggtgcctggggccagcactcattcgccctgtctgagaaacgcagggacctccctgaccctgttgtccgcccgttagcgtgatgagcagctgtggatttcatctgtgtttcttgggcaggggggcctgtaggtatagaaatggatactaccaattggattggctgatttaatacctcatgaatatcagtaccttcatgagtattttgtgtctcctctggtcttgtgaatatttggtggttatgagtgctttcattccttcctgtgtttaccatacagatgccctgtttactttctctgtgtctaacttctcacgctgtttgctctgcacttattttcatctcttttatttgtatctttgattttctgtaatggaattggatattctcaaatattcacgcattacacctttccacagtaaaagtaaccttcattcctctgactctcaaagaaattgcctgtcattgatcacattcttctttgtagcaaagtttttttgagagaagaggaatgttagggcagggtttatagacatagcgtataattcattacctgctagagtatcagctcttgtatttttattagctacttttagaatatatagtcctcagggcatgttgtgtctcatctgtctctctcttgcctcattgtatttagtatgtggatcttgtttgttgtagacactcaaaattgattaccctgaaggctggtgaagtttagttaaagctctgaggtcagagttcagtctcatgtggagacttatttgctttgtttcatgtcctcatagtaaccttgaatgctggccaagtggcttttggttacaaagagcactgggtaagacaaagaattagcacttgtattgcataagcagtttaaaaccagtgttcctctgaatgtggggcaggagcatcgtgttcccattcaaagggcaacattatatcataatttttcaagataagaaaaagtagacaatgaggatggcagaagaaaatatatgtgaatttgcctgtaactgtactttttttttctttttaagaggcaaggtcttgctgtgtttcccaggctggagtgaagggatggtcatagctcactgctgccttgaactgctgggctttaagcagtcctcctgccgcagcttcctgagtagctagaaccacaggcacacgccaccaagctcacctaatattttagagtgtctgtagagatggggtctcgcttcaagacccaggctggtcttaaatccctggtctcaagcgatcctcgcagagtgctgagccaccatgcccagccacatatgttggctttcttgtataggtataagaattcagtgatgtatctatgttagaagaatccgaaatcgctaagaaatatgaaatttcaaattcacttatataagtcaacattttaagaattaattttctttaagtgaagtaaaccaggggcaagagtttcaaaaaatgcattcagatgtccacataaagtgggaagaatggcggtgcagtcaagaataaagagggagcacaaatgaaaattggtgtcgagatagactgaagaaacctggtctttccattatgatgaaaaaaattccagcgtaggtatcagtcttattgatactttgtactcaagtagaagattaaggtacaggattcttttagccagattgtggatgatctgcatgatgagattgatttgaagacagtgtatgaaaccaagtcgaatggagacggagtgtgtagtggaactcatctcagtagaccgtcccggcagccctgcagtcctccacagctgccaggacagttactgttcagtttcccacactggctattttaaaccttctatatgctccccaactccttgctcccaacataccactccctccctgcctccggtatatggatctcctatgagtctgtttctgctgtttttttcccccagttttcttttttaaatcaagacgtgatctcttgtatgcctggttgttttggattatatactgaatattacatatgaaaagttgtggaaatagtttcagcctttgctggatttatcttgcagagaggattgactttagtttctggcaggcaacaggttagaacagaccaccttaattcaaccagagattagatgattgattctgctgggccttagtccctgtgagcactgatctatttcaggcttgccttttcttctggggagtatcacttttaggtcccaccgcaaggcctgtggtcccctcttcttggaagacctcgaactctggtttttcgtccagctctgtgagcctgctcaacactctgctcagcttttccggcttccaaactgaagctttctgccagcttttctagtgatcagcaggaggggtttgtctgaaatgagccagtctgcccttgccagaagtacaagctttcttatgtttgtttttgcacatgtttaaaatgacagagccaggtgctggctcacatctgtaatcccagcactttgggaggccgaggcgggcaaatcacttgaggtcaggagttcgagatcagcctgtccaacatggcgaaaccctgcatgtactaaaaatacaaaaattagccaggcgtagtggtgcatgcctgtaatcccagctactcaggtggctgaggcggcagaatcacttgaatcgggaggcagaggttgcagtgagccaagatcacaccactgccttccagcctgggcaacagagactctgtctcaaaaaaaaaaaaaaaaaaaaaatatacacacacacacacacacacacacacacacacacacacacacacactatatatgtatacagcataagtgcatatgatttatgaacagatatacctacagtgggtatactcaacgatcagtttctttgcctacgctgggcgtggtggcatacatctgtaatcctggcactttgggaggctgaggtggcaggatcacttgaggccaagagtttgagaccagcctgggcaacatagtgagactctgtttctacaaaaaatttaaaaattagctggatgtgatggcacgcacctgtagtcccagctatttgggaggctaaggtgggaggattgcttgagcccaggagttcaaggctgcaatgagctatgaccttgccactgcactccagcctgggggacaaagtgagaccatgtcttgggggagagggggagatatatatatatatatatgtgtgtgtgtgtgtgtgtgtgtgtgtgtgtatatattactgatagtatgcttataagcaaagatatatggtatatctttgatatgtatctttattatatagtatatataatatataccttttattatatctgatatatattatatataaagctatatatctttgatatatttctatatataagatacatatacaagctctatcttatgtatcatctatatcaactttatatgagataaataagatacatagatatataaaagatctatatcaaagatatatcaaatatataacatatcttttatatatatctatatatgatatatatgcaagctatatcttatgtatctcatatatatcttagctatatctgagatatataaataatatataaatatataaatataagtacaccaccaaagtttggagactcttgcatgttagtccctcttttttaacgtgatgttggttcagtaagtatctgtggcctgcctggtaaaaatttttctaaatgcacaaagatgaatgtcagagatcttacgataatttctaatggggcggttatatagcccaacatataaacctgaagaaatggactcataacattaaaggaatgcagcaaataaagagtcttattggtgggttttatttgctgtgtaacctatttttctacattgtacatatttggaaaacatctcaagatattggaaattgttcattttgtggcctccttaaagtagcaatttggtatttacaacatatacacctgaaaacagctggtttttaaaagtaatttaaaaatgattatagtggttaaggatacaggctctggaatcagattctaaattgaatcctggctttgccacataatagcagcgtgactgaggcctatgcgtttaatctttctattgctgtttacttctataaaaaatggaaataattttagaactactttataggacttataaggattaaattatatatatgtaataaacttaaaacactgatacttagtaaatcttcaataactgttaaagagatggagtcttgctatgttgcgcaggccggtctggtactcccaggctgaagcaagcttctcacctcagcctcttgagtagctgacactacaggccacaccactgtgcccgactagtctcagcattttattcagataatgcaagctattttgtcaggcatcttaaaagaaggttctaataaattatttgcttttgccattgtattttcaagaattgacattttaaaacaatgtatagttttatgtgtctatttaatgagtaaagtataagacagtttccatgaggatatatagttgatacaggcagtaaacatgatttttgttttaaaagaggtggctatagtctgaaccaaagtattttcaagtcttagattctgttggttgtggcttaaaagaatgattgcagtacatttttacaacaaagaggtatttaaaaccaaataagcacaatttggatgtgtttacttctcttttgtttatttaagtaaaacttgtgtatatctgtgcataagagaaggaaaagagaagagagatgactctttatcttcatactgcttgggtatacccacaatgaggcttttgacctgtcatttccatttatgtaatggattttgaactcaaaagccctgtaaatacataagcgatcttgaaccaagccccattgtgaaaggcaggattgaggaatatgaaacaaattatgcttcctttcattcactttatctgccccaaggtttttttcggaatatgagtcacatagtttcagttaatttcttcatatttttaacagtgctttctcttcataaccgaaaatctgtatttgatgtttttttcccttagaatcattatcttcacatttattcttgtttttccttttgtgtcttgtaactttgtcacatttttatccttcttgcctaccttatagcataaattttctcttctgtggcctttctttttgctaaatgaagaactaaatctttatgaaattatattttttatttttattaaagaaatgttaaaacaatgtgatttacttttatactgtactattatgtagaaatttaagtatttagaatgattactgaaaggccgttttactagttttaatgacaatactatttaacttttatgaagtgccaggggtatttggaatatggggaagtacaaaaaaaaaggaacagcatgatctagtgatttacattgtgaatatgggaaataaggaggtaaaaattaattttaaatagtatctatttccttccacaagtatttgcatttgtttaattacagtaataataatatctatatccaggaaatacctatagcataacttgtgttagcaaggaagaatccagaatggagtgattcaccatgagccatatttggctactgtgacactgtcaaggcaatgtcatagacagcagcatcgtccaatagaaatatgtgagacatatatgtaattttgtggtctagtaaccacattaaaaattttcaaagggaaaattaattttagtaatagtttattcaatatatctaaagtattatttcaacatacaatcaatgtgtagaattaataaattcttttatattgattttattcatactaaatcattgaaatatggtatgtattttataaatgtagcacatcttaatttggacacaattttcattggaaatgcttgaactatatttcaatttcataaaatgtacaggtgaaaaacattcacatacccaagttattccaaacatacttgagtttttcagtaactgaattgatgtccatttaaaaatttaaatttattaaaatttataaaaatgaaaaattgagtccctcaatgtgtgttcatatttcaggtactcaatagccctgtgtggttagtggctaccattttgaatagcataggtatagaatagagctcacagttgaagatgtcagctaagaaaccctgaatcattattattattgttttattttattttattattattatactttaagttttagggtacatgtgcacaatgtgcaggtttgttacatatgtattcatgtgccatgttggtgtgctgcacccattaactcgtcatctagcattaggtatatctcctaatgctatccctccccctccccccaccccacaacagtccctgatgtgtgatgttccccttcctgtgtccatgtgttctcattgttcagttcccacctatgagtgagaacatgcggtgtttggttttttgtccttgtgatagtttgctgagaatgatggtttccagcttcatccatgtccctacaaaggacatgaactcatcattttttatggatgcatagtattccatggtgtatatgtgccacattttcttaatccagtctatcattgttggacatttgcgttggttccaagtctttgctattgtgaatagtgccacaataaacatacatatgcatgtgtctttatagcagcatgatttataatcctttgggtgtatacccagtaatgggatggctgggtcaaatgatatttctagttctagatccctgaggaattgccatactgtcttccacaatggttgaactagtttacagtcctaccaacagtgtaaaagtgtccctgtttctccacatcctctccagcacctgttgtttcctgactttttaatgattgccattctaactggtgtgagatggtatctcactgtggttttgatttgcatttctctgatggccagtgatgatgagcattttttcatgtgtgttttggctgcataaatgtcttcttttgagaagtgtctgttcatatccttcgcccactttttgatggggttgtttgtttttttcttgtaaatttgtttgagttcattgtagattctggacattagccctttgtcagatgagtaggttgcaaaaattttctcccattctgtagttttaatgaactcctcattaaagaaggaagaggctttattcgggcgggagctttggcagacttgcatcttaagagccaagctccctgaaaaagaaatccttggcccttttaagggcttacaactctaaggggtccacgtgaaagggtcgtgatagatcgagcaagcgtggggagcgtgactgggggctacatgcatcagctgacaggacagaaagtttcgcagggcttcctcatacgatgtctggaatttacagataacacaagtagtttaggtcaggggttaatattattattatttttttaaccaccagggccaggtggtggtgccagggtcgtctggctatttatcttacttctgtttctttccaactttttgctttctcccttttcgcctgtcttataaactaggcaaaagtgggagagaggagggcagcaggagaagtggtggtctccttccttaatggtatagggtgaatattttatcttgtacttttcatggttttagagactgtactttacatgtttctaaagattaagcatttctactcattaagttgaagaatctttagaagtcctctcactgaggtttttttccagaattactggattatttctttcatacctatcatttttcttaaaatgtaatacacttgtagataataagaggaaataaaagatgactgataaagggcttgcagtctgttttgtaaattttaaaaatattagtggtatccttcaagcagatttagcatttcttccaattctacactaagagtagcctagagttaaccatggcctttttttttttttttttaagtgttcaaaaggattttgatgacaactctaaggtaccttccagggcttatttttaggaaataaaaaataaaacgatagtataaatatatgctacctaaacttcccctcacatacttttttctaggttatttttttttaaaatcttcaaacattttcatttccaaatattgctgctgtttagccagagaagaacttatacaactagctttcagttgtctgctgagtgtccagggattaacataagagactaatttcagcacataacctatttaactagtcatttcattcaggcagtggtcccaacctgatgcacattagacttacctagagaacttgaaaaatagtggtgcctaggttccatcctcagagattctgatgtaatggtctagaatagaatttgggcagcctctcaggtgatcatcatgaggagacaggcttgacacctgtagtattcatgtgagaactagctgagtttggggttgggttgcatatggtgaaagggaatgaacttaagtcatttccttctcttccctatttacaatgaaacaacctaagagaaggggaaaatcaaagatcactgagaatctgcaaaggttagaaaatgaagtagcttttttctttttgtcattgtagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggtattgtttaaaatagtatttatcctcttctttaattaattaaaaatgaacctccttccctcccatactgtgtttactgtcctgcaccttgcttctttgcttacgatattctggagctagttccgccgcagcacaagtagatccaactgcatgatattccagtgtgatacgtctccacactgttccaccgtatgggtgtaacacaatttatttaatcacttccttatggcccttcccagtcttttactatcataaacagtgctgaggccgggtacggtggctcacgcctgtaattagcactttgggaggccgaggtgggcggattacctgaggtcgggagttcaagaccagcctggccaacatggtgaaacgccatctctactaaaaatacaaaaaatgagctgggtgcagtggcgtgtacctgtaatcccagctactctggaggctgaggcaggagaatcgcttgaacctgggaggcggaggttgcagtaagccaagatcacgccactgtactctagcctggctacagagtgagacttcgtctcaaaaaaaaagaaaagaaaaagtgctgaaattgacatcctttgtacatgttttcacattaggtactttaaatatatgcagcctcctctccctcctttataaattagaccattttctaccaatatcaaccttaaaaattgccttctgtcattcctgtggctttgatccctaacctgtgagtttagatgctactgtgacctctttatagatctttccatctcactcagcaggtaaataaaatacaggaacatatattaatgtacaatttaatatgtagtgttgaataagacatctggttctaattatctgtatcactttggttaaaaagtaattcagagtatttcttgtttggtatgcagtttggcagttgaagtttagagctatggaatttttggcctgaatcacagggcccccttgggaaaaggcagcctctggttattttttttatcagaaacatatgggactagaaagttttggtatgccctagactggattccttagtgtagtaccactttttacccaagccaacagattttacatcagactctagtgaactaagtagaatgcctcttcatcttctgttctcttctttggttaattagaaatatatctgtctatatcgtattttttatttgtatttttaaaatttgaagtaaaatacaaaacttttcagtttctacaaaatccatatttattcaataaagtaatttgaaaactttttaatataattcataatctggctttctggttaatgtaactcataatttggcttttcacgtccctgtatctttttcttagtagactcaaaataatttttaaccagggatatgaaagctttttttttttttcttttttttgaggcgagtctcactctgtcacccagtatggagtgcagtggtgcaatctcagctcactgcaacctccgcctcctggattcaagcaattctccttcctcagatgattctcctgcctcagcctcctgagtagctgggatcacaggtgtgcaccaccatgcccagctaattttttttgtatttttaatagagacaaggtttcaccatgttggccaggctggtctcaaactcctgacctcgtgatccgcccacctctgcctcccaaagtgctgggattaaaggcgtgagccaccgtgcccagcaaaagcatttcttaaaagatctaataagcagaggatatttacagtactatgtatatataaatcagtttattctataactatcattcaagggcaaattcaccaggcctctcaatctgattttgtgattttattttattttcaagacagggtttcactctgtcacccaggctgaagtgcagtggcgtgaccatggctctctgcagccttgatctcccaggcacaagcgattctcccacctcagcctctggagtagctcggacaacaggcatgtgctaccatgcctgactaatttttcttttctttttatttttgtagataaagaatctcgcactgttgcccaggctgatcttgaatttctggcctcaagcgatcctcctgcctaggcctcccaaagtgttgggattacaggcatcttgtgatgtctttaagaactgatacttagttgcatacctatgagtcagtcatagctttaagattgtgagtccttttactcctcccttccatggtctttattccacttttcttaggtgtgattatattattattatatttattttagagacaggatcatgctaccttgcccaggttagtttcaaactcctgggttcaagtgatccttttatctcagcttcttgagtacctgggactacaggtatacaccagtgggcccagcttataatttaaagttatttagtatttataatactgtgagaagatatgtttagaattactattccctaatgcatttgaaacatatgatttataaaatctagggatagtctttatacagcttactttaaacattattttctatatcttatataaagtgagtttaagagagtaagaaaggccaggcgtggtggctcacacctgtaatcccagcactttgggaggctgacagggcagatcacttgcgctcaggagttcgagaccagcctggccaacatggtgaaaccccatctctaaaaaaatacaaaaattagctgggcctggtggcatgcacctgtagtcccagctacttgggaggctgaggtgagagaatggtttgagcctgggaggcggaggttgcagtgagccaagatcctgccactgcactccagtctaggcgatagtgccagaccttgtctcaaaagagtaagaaaacagaatgaggagttataaaacccaagtacaaatcttatgattccaggtcacttggtgagactgaagcagtctctaccttgttgttgtcgtctgtataatgatgatcttcatctacctaaatctatgaaattcctttttaagctgtgagtttcttagatttcatagtagagatggtatactctatacttgaataaaatgtggtgattcacctctagtgcatctatagagtttttatattttacagatacatttttgtttgtcttttaagttttgttgataaattaaaagaaaggatactcctgtctgcccgggctggccatggacgaggcgggactgagtgtcctggggtgagttagcagggcacaggtgtttgagatgggggacccttaattttaaactgaataggattcttttgggtgtggaattaatcctttctagatgtggaagagacctagaatgggaagaagctttagtattgcctggaaagcttccctcagagtttagttgctgggaccccaccctaagaacttgcttcagcctgtcgtctctcagtacgtatccatcacccggtctgagtaatgttatctccctgtgatctctcaagtcagtctgtttctctccatcttcactgccacagttcagcagcatcttcagctggagtactgcaaaagccccctacatttgtttcccatcttgcttccatcctccatgtcaaaaataatgcaaagagtttatgcataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaataaagtaaatttattcactctatgctcccttgtctagtttaatttgtagtcatttttcaattactactgtccaaaggctagtactggaaaaaaaatgatagtgcaggactcttgtcactaatagtcatgtcattcctaatagtcatgtcattaggagacatgtcactgtttatgggtttgctggaggcagtatttgtgtcaatgggtaaaaccttgatcttagcctcagggaagtccagttgtcatcatataatgagcttttttttttcccccttaagagaattgaatccccttgatatgcttaactaagcaggatttcaagctgtgttacaacaagttttcattatagggcgggtgcactggctcatgcctataattgtagcactttaagaagccaaggtggaggattgcttgagccaaggagtttgtgaccagcctgggcaacacagggagacctcatctctacaaaaagtaaaataattagctgggcatggtggcacgtgcctgtagtcccagctacttgggaggctgaggtgggaggatcacagcagcagtgagctgcatggttgcaccactgcaccccaacttggagacagagtgagatcctgtctcaaaaaaaaaaaaagaaaaagaaaaaatttttcactgtagttaaaatggcaaagctttaggtaaatattatcctaaaaactaatgaccattacttatttattattatttttcacattcttacctggggggagaaaaacaatggaaattaatgtgttttttaaacagttttattaagatgtaattcatatacatgcaattcacctacttaaaatatataattcactgatttttggtatactcacagggatgtgtaaccatcagcagtcaattttagtatgttttcttcaccacacaaagcagccacttacatattagcacccacttcttacttccacttagacatcctaacctgaggcagccattaatctacttactttttctacagatttgtctactctgaacattgcatattagtggaatcatacaatagaaggtctttgactggcttctttcatttaacatgttttcatggttgacccattttgtagcatatatcagtactttgttcctttttgtggtcagataatattctgttgcatggatagaccgtatttcatttatacatcagctgagggatgtttgggttctttccactttttgactattctatggacattgctgtacaagtttttgtagagacatgtgttttcatttctcttcgttatatatctctaggagtggaattgctggatcatatggtaactttatgccaaacagttttccaaagcaactgcaccattttacagtcctgccagcactgtatgagggttacagtttctctccatcttcaccaacacctgttaatatctgactatttgattatctccatgtagttttaaaaaacttgtaattcgtataccataaaattcacctttttaaagggtacaatttagtggttttagtatattcacaaagttgtacaatttaattccagaacattttatcctccaggaagaaatcacgtacccattagcagtcactcctcattcttcccttccccaagcggtggctaccactgtcccataaagtttgtatatttgtatgagacaagtttagatgatgtgttttatggttgtcgtaacaacactagatatttactcagcgctagtcaccatagtatcaaagcatttaacaaaacagttcagcaaatggcgggaagccagaaataggcagcacatggaaactgggaagggaagacctttctcaattgacctgccactatcagtgccctgacttgtttctctggaggccttcacagtgtggccagctgaaggatgacaaggaggctagaaccttaaaaagcctgagtcaggctggtgtagtgagaacaaagactttggatttgaatcttggttatttgagtctcggttctgcctgttcttacctatatgatcttagaaaaggagctcatttccctgaaccccttttctcatctgtaaggaaggctgatcctacatgtcttgcaggattgtccttagaatgaatgactctgtatgtaaagcactttgtaaagtacccagcataaaacagcttcttctaaatggtagttgttgtgtttatgtgtgtcacaagatggtatttatttatttatttatttatttaagacaggattttgttctgtcacctaggctggagtgcagtggcgtgctcgtggctcaaaaacatcctcaagttcccaggctcaggtgattctctcacctcagcctcccaagtagctgggactacaagcgcatgccgctgcgctcagctgaattttttttttttttttgtagtggcgggtttttgtcatgttgcccaggctggtcctgaattcctaggctcaagccatccaccagctttggccccctaaagtgctaggattagaggcaggagccactgcaccagctacacaagatgatttctgagtggcgtgactgggagtaccattaagcaaaattaagaaattaatttgatttgactttaagtccattttacttcttttgtcagtacttttttttatttcctaggaactttttaatactgtctcttttcagatgtacctgtccctgccccattcccctaatgtacattcctaaaaatatatttccagttccatactagtttaatgtcagatgcaacctgctttttgggatgttaactgatatcaaaagtaataactagtaatgccataaaatatgaatccccaaaggcctatttgcatttttatatattgacttcggctatagtagaacattgatagctggcctctaaatcagctttatggagacaattgggtaatatctgtactggccagagttgagatccctgagattggtggggactgtggtgaacaggagtctacatcatgccctgcctaagtgcattcaaatttttaaaatgtaaatgcctggctaagcccctgtaagcagaatgatagggactggggttgatgttttgtgattgtaacccattctactcactaggtagatagacggacagtttaactcccttaggagtacataccacactttcagaattcagaagtcctggtttaccttatttctgctcctagtagatgttccacctcttttaagttaacatttctttggacaatgacatgcagaaacagtagcctctcattttactcttccttctttaagggattgatcaatgaaggcaggccatgtcttttctgaaggtcagctagtaagaatagaataaagagttcctgatttatatagagtcaaataatttcacagtcagaagagacttcaaggtcactagccaaaactgtcttaggaaaaaaaaaaaaaagccccaatattaaaagtgtgttagttttctattgctactggaacaagttatcacaaatttacaaatctagtggctttaaacacacgacaacacaaatttattatcttacagttctgtagatgaagaatctgacatggttcctactgggctaacatcaaggtgttagcagggctgtgtccctttctggatgctccctgggagaatctgtttccttgccttttccggattctagaggcttcccacattccccagcttctgttacccttcctccatcttcaaggccagcagtggctttgaagtgagctcaagtcctcacattgcatcactttgaccagctgacacttctgcctctctcttccacgtttaaggtcccttgtgattacactgggtccacccatatattgcaggataatctccctttttaaagatcagctgggctgggcgcaatggctcacacctgtaatcccaacactttgggaggctaaagcgagcagcatatttataagttctgggtatggggacatgggcatctttgggagctgttattctgcctaccacaaaaagattttaatatagactagatgataactttacataacagaataattcttcactttataaaagtttttctgacattattttgtagacccgtacaggattacatagtcaatagatatttattgagcattgttgctgggcactataaaactgctggtgcacctccctttcagttttgtatgctcaagtgagggagccacgtaactaacaagtgcagtctagcaagacgggagtcataagtaagcacatggtcgtggaggtaacctgtcctggagagttagagaaggttgtcaggaggagttggtatctaagctgagttaggacaaataggtgctagtgaagtaaaagcaatgcggacaaagaggagaggaaggacgtcagagatggcaggcgtaccatgggctagagctcacaagacaagaagagagcatcctacatttcagtatctgctaatattcctgcttgagcagaataaaagaaaagagtgaatcaaggggaaatagtagagagtagagcagtagagagatggaggcttagaagattagcaaagtccagcttataaattgtttttaacatgaccagtttgggccttaacaacaggtttgaataagggaattgcattttttagaagattcctcagtctgcagtgtggagaattggttggagcaatggaagattagaagtaatacagagttaaggggttttacagtaacatctgccagagatgctggtgatctgtaatgagagagtagctgtacggctggagagaagtaagtgaattcagagttactaaggaggtggaattaacaggactggatcattaattagatatgaaaaaaagagtccaggataatctaattctcagttatctggtttaagcaccaggatgcttgataatgccatttattgatttattgagcataggaatacagggagagaaagagcaagtttggagagaagagagtagaagacagtgttgtgcttttgggtcaggtgtctggggtgtcgtagacgtctgagtagacctgttaaacaggcttctggtcttggctagagatacagatttgggagagttgctagagagggccttaaaagtgacctagtctaacttcttagattttacatgtgaggaagttaaagatttaattgagagaatacattgttcatttttgcaggagacagaataagaattaggatgtgaatctagggctcctaatgagctagaatgtgttttctatgcatcagaggcctacttctcccaccaaacaatgagacgccaggcatggtggctcacacctgtaatcccagcactttgggaggccgaggcaggaggactgcttgagtcaaggggtttcaagaccagcctgggcaacacagtaggacctggtcttttcaaaaaataaaaaaaatagcaggcgtggtggcatacatctgtagtcccagctactcaggagactgaggcaggaggatcacttgagcctgggaggtcaaggctgcagtgagccatgatcacgccactgcactccatcctgtgacagaatgagactcttgtctcaaaaaattaaaaaacaaaacaatacaaaacaatgaggttctgttggtagggtaaaaatgatgatgagccaccaactgttagtgattttttctattgtagaaatatttgccaagcattaggaatacagtaaggacaaagcagatcttgtgcttaccctcctagacccctggtggagtccagtgggaaggcaggtattaaataaaattaatggcctggcacggtggctcacacctgtaatcccagcactttgggaggctgaggcgggtgaatcacctgaggtcaggagttggagaccggcctgaccaacatggagaaaccccatctctactaaaaatgcaaaattagctgggcgtggtggcacatgcctgtaattccagctactcaggaggctgaggcgggagaaacacttcaacctgggaggcggaggttgcagtgagccgagatcatgccattgcattctagcctgggcaacaagagcgaaactcagtctcaaaaataaaataaaataataaataaataaataaaattattgcaagggtgtatagtctgcttctagaactgacacacattcactgtgtgtgtgtggaatggaatggagagagcagtttggaagatggtaggagatgagttttgaagtattacctcttggatattctgaatgctaatgagagaaaaccctttagtggaaagcttagttaagggttgatagttgggagtaacacaccacctacttataagaggaccctaaactgatggttagaatgatagaaatgcattccctgctgttatctagctctttccaacagactgcaccatttccaggagtgttgggaaaggtgtttgttacaattgaaagtacaaacgtcagaggaagggatcaacaaaatataataaaaaagcagaaaattgaagaattgtgcatggtctgtgcattagctatctcttgcagcgtaacaaaacttagcagctgaaaacagcaaacatgtatcatctcgtggtttttgtgggtcagaatctgtgtgtggcttagcttggagcttctgacttaagtctcttatgaggttgcagtcaagggttggccagggctatagtcatctcaaggtttgatagaggttggataatctgcttccaaggtcacatggttcttggcaggcttcagaccctcgccacatggcccactccacagggctgccttacaccatgacagctggcttcctccagggctagcagtcaaagagagagagcactcaacctggaagtcatacttttttaatgacctaattttggaagtgatattccatcacttctgcatattcctttcattagaagcaggttactgggtccaacttgtacttatgggaggaggttgtaaaagggcacaaataccaagaggcaggaatcacgggggcccatcttaaaggatgccaggagaaagtcggtgcctcagattgtggcaaggaccccgtgagaatgtaatggcaattctattcacagttccttttttccctctgaacacctttcctgagattgcaggtggaacccaggatatatgatggtacagacagcccagttagatagttttctttttgtctagttttttttttttatgatttcagtcgtgctgttaaaatgcagtatctatgcagagagaaggtgaaaaagaaaagaattacaatcaatcaaacctttcaaattctgtcccaaaaaacagcattctccaagtctcagtaatgagttaggtattttttaagtaatgtgatattttatgtgaagaaaaattaagaaatcaaaactaagaaattaagagatttacctccagatgcatgggaatatttatgcagttacatacatattaacctagatgaatgaagactttttaaaagtttttagatataagcatataggctatattttaaaatacggtattttattactgattttataggactcagattagtggaagcttaggtgggagtttagggactcttggcttctcagttctttactgtgaaagtcaaactttccaatatttaatcgttttctaaatagtcaccttttgcttttctgtttactccttttgtttttactggatcacgatctctacaaagagtgactgttttgtcttcatttgtttaaaataatggtttctaggcatcactgatagggtgagaactacaattaagagttttttgttgtcttgtttttttaaacaaagttatatgcgcctgccgcttagtttgtaaaaggcacacaagtgaacatttggaaatgtagtcacacaaatgaaaagcaggtagaggttatatgcatgctatttagcaatgaaaataaataaaatcctaatacatggtgtaacatggatgaatcttgaaaaggtgctaagtgaaagaggacatatgtgtgaaatgtccagaataggcaaatctatatggacagcaagtagatgagttggctgcctagagctagggaggcagtagggggatggggtgacagctaaaggatgtgggatttctctttggggtaataaacgttccaaaatgtaacatggtgatggttgtacaacacagtatactgaagtaaagccactgaattatgtgttatgagaattatatctcagtaaagccgttaaaagaaaaaaaggctggacgtggtggctcacactgtaatcccaccactttgggaggcctaggcgggtggatcacctgaggtcaggagtttgagaccagcctggccaactggccaacacggtgaaaccccatctctactaaaactacaaaaactagccgggggtggtggcgcgtgcctgtaccattataggcatgagccaccctgcccggctactggagagactgaggcaggagaattgcttgaacccgggtggcagaggctgcagtgagccgatatcgcgccattgcactccagcctgggcgaagacgcaagactccatctcaaaaaaaagaaaaaaaaaaggggcttggtgatagttggtttgatgatatgaagaaacggtgtagttatttgtctccacaaaatttaaaaactactagtgtaatggaaattgatgtaacaattttctgtaaactataataaaatgccattaaatgtgtttctctgtgcgtttgttttgatctattgaaagttcagggttaacccctgggcttctaatgcttccgttcttatatgatttcattaattgcaaagagaatctctgatgttagtagcttttagagaattatggaatattaaagaaggggggcttttaaggaaaatttcactgtttggtttgctttggctattaggctctcccccttctcccacaaatatatatattttcaggagacggaatatatatatataatacttatatttattgttattattttgagttgcactcttgctgtattgctcatgctggagtgcaatggcgtgatctccgcccactgcaacctctgccttctgggttcaagcgattctcttgcctcagcctcccaagtagctgggattacaggcatgcaccaccatgcctggctaatttttggatttttagtagagatggggttttaccatattggccaggctggtctcagactcctgacctcatgattcgcctgcctcggcctcccagagtgctgggattacaggcgtgagccaccgcacatgcaccattatttttgttttgaatttaaatacatgcctttatatttgttagagaaacaaaatatgtttattttcagacatacgagaaaatcatatacttgtaagaaaatcatatactttcttataaggtcatgtaaattttgagaattctgatagttgatgaattcagtgtgcttggaatgaacagggaaaatatggtaaaatttagccattttgatattagcaaagtcagtgtacttccaatggataaacaatgaatttaatcggatttgaaaaatccaaaatatggtgcttgagttgtttgtggacctggataagtagttttaagaatttggctaggcacggtgactcacacttataatcccagcattttgggaggccaaagcaagggagtcgcttgagtccatgagttaaagaacagcctgggccgggcgcggtggctcacgcctgcaaggctctaatatcagttggaaccccgggagcgcgccaacagacagcacaaggcggtgtggagcatcacgctgttttaatgcgcgcctgggtgcagacgggctgaggcctaaaatggcgtcagcgccacatgaggacggggcaggggttttacagtctcctgtaaacaggaagtgtccctgtctgatgtaacggctacgtggtacctggatggcctctctgtctatcctcggtggtgggtgtcttccggccggggtgcgtgtcttccggccggggtaggtgtcttccggccggggtaggtgtcttccggccggggtaggtgtcttccggccggggtgcgtgtcttccggccggggtaggtgtcttccggccggggtaggtgtcttccggccggggtgcgtgtcttccagccggggtaggtgtcttccggccggggtgcgtgtcttccggccggccctcttcctgcttctgcttctcgctgacgcgcgctgctggtgcaagcggccttgcgccttgggactgggtctgaggagggaggagttattcatccccccaagctttcggccccggggagaatctttcattcctgtctatttggttatagaaaaagggaaaaggggcgactttctccataactacttcaggtgtgacatagggggtggcgtgggcacctcggaaaaaaagaaaaaattttggcgtattcttgagagacgggttggtatccatcgtgtcgttgtagcaggagcatcgtctggattgtctggcggttaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcatctatgttaagacagcaattggacatgttaaacttagcacagaccgcaccctcttctgttaataagtagtctagagccagcctgttttgataaattgctgggtgcgtttggttttgttgtcacacgagcatttccagggctgaggcggtttggttagtgattatctctagagcagcctgtagtctaattattctatttaggatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaagatgaatccaggttgaattgtgcgtaggaagctagtgctaaggtagccgtgagcaagcctgggttccccatatccaaaggaatccatcggggcagtccgtcgtcagctggtgttcctaggattgtcgcatagtgcacttaggcaggcgtatgtggcagaagagttagtggtgtttgtacagttccaggccttttttgacaagacacaattgaggtagctgaagttagagggagaccaggctccggggggtaaccttggccaccactcggctgtggaggcgttgactgttagggtttggtgacgggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtataaagggatggaagtaccacgggtgattttcgggggagttaaccccgggagcgcgccaacagacagcacaaggcagtgtggagcctcacgctgtttaaagagcgcctgggtgcagacgggctgaggcctgagatggcgtcagccccacgtgaggaccgggcaggggttttacagtctcctgtaaacaggaagtgtccctgtctgacgtcactgctacgtggtacccggatggcctctctctcgatcctcaggagtaatgtcttccggccagccctcttcctgcttcggctaccttggtgacacatgctgctggcgcaagtgtgctttgggactgggcctgagaagggaggagttattcatccccccaagctttcaggccccggggagaatctttcaacgcttacaatcccagcactttgggagacagaggtgggcggatcacgaggccaagagatcgcgaccatccagaccaacatggtgaaaccccatctctactgaaaatacaaaaattagccgggcatggtgtcacccgcctgtagtcccagctgctcgggaggctgaggcaggagaatcccttgaaccggggaggtgaacattgcagtgagccgagattgcaccactgcactccagcccggcaacagagcaagactccgtctcaaaaaacaaaacaacaagaaaacagaacaaaacaaaacaaaaaccagcctggaaaacatagagaacctgtctctacaaaaaaaacaaataaataaataataaataaataatttaaattagctgggcatggtggcatgtgcctgaggtcccattgactcaagaggctgaggtaggaggatcatcactagaccccatgagttcgagtttgtatgatcctgccactgtactgtagcctgggcaacagagaccctgtctttaacgtttttttaaaaaagaagaggtttaagaattagcatcacaaattgcatgcttgggcaaatgtcttacacagttttagtttttaataaaacgtgttaaagtgtaaaatgtctaatcaaacttctgagaggaaaagtagagaatccaaacattaatgcttattgacatgttctacataatttagatgctaaatcccagaaatatttatgtgtactgattgtgccttgattagaaagcctgaagcaggctctagacagtggtggagcttgcgggagtcacataaatgctgtgtgatcaacaggatttaagcccgtgggttacctgcttttacaacctaagcaccaagggatggggagccttggccgttagcagcctaagggagctcttgttcccacgcatttttcaaattccactggagtttcatgaggttcgttttaagactgccacctgaaatcaagtccagtggctgttcctgtcttcccgtccctgtattgacattaaaaccacttagtcaacactcaagtgcaagaatagtgtcgccatgttgtatgcctagtaaattctggatgtacgttgtacgtcaccttatttaaccttttgccattagtttacaagaagacgggttgagcgagtcaggttgcttactttaggttaacagggcagctggactccagcctaagctcttcagtgaagccctgcatcactccctctgcaggcagagggtgcaacccgggggtgtgggagggagcatggcacactcagcacgtggtaattatgtcataatcacataatacattcttttggcccgaggtcaggtcagaaggaagttgactaatttccagatttatttcagtcataatacccgtgtctagtgttgaggaaaaggaagggatgtttcctgtttgctgcttcggtatggttagccaatgactggaggtatttaaaaggtgagcactggccaggcacggcagctcacgcctttaatgccagcactttgagaggctgaggcaggcggatcacctgaggccatgagtttgagaccagcctggccaacatggcaaaaccccgtctctactaaaactacaaaaaattatatgggcatggtggtgggcgcctgtaatcccagctacttgggaggctgaagcaggagaattgcttgaacctgggaggcagaggctgcagtgagccgagatcatgccatggcactccagcctgggcaacaagaacggaactctgtctcaaagaaaaaaaagtgagcattgtccttcaccctcctttccattttcatggcattgatcagaaccttagaggatgaaacatgtcagaaaaagggagcagggcagagagattcttcacaggaaccacatcaagcgtgtgttaaaatttatttctgatctgccttccaaaattatgcccaagatatgcatcagcattaatgggtaaggcggtttgaggaattcggttatgcaatgactcaaagacccattaaatcacagaactgaagacatttttttctgtacataaatgtgccattttaaccatttcattctacagttcagtggcattaattacattcataatgttgtgcaaccatcatttatatctatttctaaaacttttatctccccaaacagaatctctgtgccattaaacaataactcccagccaggcgcagtggctcaggcctgtaatcccagcactttgggaggctgaggcgggtggatcatgaggtcaggagttcaagactggcctggtcaagatggtgaaaccccatctctactaaaaatacaaaaaattagccaggcatggtagcgagcacctgtaatcccagctacttgggaggctgaggcaaagaattgcttgaacccagaaggcagaggttgtagtgagctgagatcgtgccactgcactccagcctgggcaatggagcgagactccgtcgcaaaaacaaacaaacaaacaaaaaacctccccattcttttttatattttctgtcttttttattgatattctcattttttcctacattgtcttcctgatttcctttagttcttcatctatggtttcttttaagacagttgatttaaattctttgcccaggaaattcaatgtctcggcttcttccgggatgttttctgtctatgtatttctttcaccagaatgggccacactgtactgtttttttgatatgcttggtgatgtctttgtattgaaaaccggacattggtgtattatgatgtggtaactctggaaattagggtctcgcctttgttcagggttggctgttcttgattgctgaagccttagcttgtgtttcttttccagtctttcagattggctctgtgctcaggtactcctttaacacttagccaggtcatctataattctgccccagccttcacttctgcttgcactaagttgatgggtcttctctggccctttctaagcgtgcgtcgtgtcctgagctgtcgcgtgtagctttctgaattctacagtaccacaaacatttttgaatgctctgatttcccaaggaagcgatcttcctggcttttccccctggctttagattgtctagtttatgcctcaaccgtattttttttgcacccctccgcccgcttggccgtgggtttttgatcacctgacaatattttccagcaacacctgctgcttttctgctctgaacgtgttctgagttttgcaacagagaggcaagtgccttgtttcagtctttgggtagccccagacagattagaacaaacacagtgatttgcaagtaagatctgctctgctcccttcaaaagcaagtactggggtgccacactgggaatgagggctgctgttgagctggggaaaggggtgaggtaagggcaagtaaaaacacccaaagctttgctactcttttgacattgcctttctcttgattcggtggtcactgtcttgttcaggcatacctttgtttttcacagttctaagaaagttacatcttatagttctggatgttgtttttttttaaaatatttctgtgaaagcctcagagtttgaagctgcctgttctgtcattttgcttatgacactcaaggccttttcattttagggcttccagtagcaagaactgtgcccagagggatggaattagatcgaactgctctgaaagagtactactatttcatatttttatacaaaagcatattttagataaggatgtcattgatttagaaactcaaaccaattaatctttgggaagtaatattatctctgttttagagatggaaaaaaaccagcacagatattgaagtctcaagacactggttgagatagagttaaaataatagagctttaggaaaacagttacacatagaattaccatttaatccagccattaacttctaggtatatacccaaaagaatagaaagcaaggacccgagcagatacttgtacactaaggttcatagcagcattattcacagtagcaaaaaggtagaaacaatccagatgtccatcaactgatgaatggataaacaagatgtagtatatacatataatgaaatgttcagatttaaaaaggaatgctaatctgatacacgctacgtatggttggatggatgctacagcacagataaaccttgaggacagtatgctaagtaaaagaaaccagacacaaaaggacaaatattttatgattccacttatataagctatgtagaattggcaaattcacagagacagaaagtagaatagaggtttccagagctggagcaaaggggaatgaagaattagtattttatgagcactgagtttctctttgggaatgatgaaaagttttggaaatggatagtggtgatgattgaacaacattgtgaatgtatttttttgtttgtttgagacagggttttgcatttgttgcccagactagagtgcagtggcacaatcttggctcactgcaacctccacctcccaggttcaagtgactcttctgcctcagcctcccaagtagctgggattacaggtgcatgctaccacgccgagctaattttttgtacttttagtagagacggagtttcgccatgttgggcaggctggtctcgaactcctgacctcaggtgatccacctgcctcagcctcccaaagtgctgggattacaggcgtgagccaccgtggccagctgtggacgtgtttaatgccactgaattgtataccttaaaatgtttaaaatgttaaattttgtgttatgtttttttaaaaaaatagccccccaaaatcataacaggtcaggcgcagtggttcgatccaataatcctagcactttgggaggccaaggcgggcagattgcttaagcccaggaattcgagaccagtctgagcaacatggtgaaaccccatctctaaaaaaatacatacaaaaattagccagggggtgtgcacttgttgtcccagctacttcagaggctgcagtgggaggatcacttgaactggggaggtcgaggctgcagtgagccatgattgtaccactgcactccagcctgggtgacagagtgagaccctgtctcaaaaaatatatatataacactccaaactcagtgttagggacatacaaagcttaactaattgaaatttgctgagttttaaaacatagttctcgagcatttattatttactatatgccagccactgtggtacatgctttatgtggattatctcatttactccttgtcacaatcttatcaagcataatacaattagctccaatttatagatgtgggatctgaagcacagagagattaagtaacgtgcccgatgtcattgctgaaaagtgtatcactgagataaagtacatcccaggacttcatcccaggtagtctgacttcagactttgtgtctaatggttaagctatactatctcacttttgctgaactttaaaagtgtgcttaaagcaatacatgactttccacaatttgccgcagaacaattattgcacattcctttcctcagggtgtgttggtggctatgattcctgcctgccagcctcagcaagacaaaacacaatcagagaaaaggtggatggttcactcttaagggaagtagtggatttgggtttgtttcagtaatcgtctctgaataatggcataaccttctctcagatttttaatttgatctagtttcattgcagtgaaaggaagctttaacacttggatcaaagaaagtatttgtataaaagcagcgaatgtagttttgaatgatagggtacttgtactctgaatagtagtatacaatatttgaactgtatgaggcctttttttattctttctttctctctctctctctcctcctctctacctctcctcctctctccctctctccctcttcccgtctccctcttctgagtctagctttgtcttccaggctggagtgcagtagcctgatctcggctccctgcaacctccacctcccaggttcgagtgattctcctgcctcagcctcccgagtagctggaactacaggtgcacaccaccatgcccagctaattttttgtatttttagtatagataggtttcaccatgttggccaggctggtctcgaactcctgacctcaggtgatccacctgccttggcctcccaaagtgctgagcttacaggcatgagccactgcacttggcctgtgtgaggtctttaaataacccttccctatcctcaaaaatgcccatcagcttagtttatgcatcagtaacactacaggttgaacatcccttatccaaaatgcttgagattggaagtgtttcatatttcaggtttttttttgattatggaatattcgcatatatatagtgagatatcttgaggatgggacccaagtctaaacacagcttttttatgtttcctatacccaccctgtgtatagagactgaaggtaattttatacaatattttaaaataattttatacatgaaataaaactttgactgtaacctctcacatgaagttaggtatagaattttctccctgtggcatcttgtcagcactaaaaaagtttcaggttttggagcatgtcggatttcagatttacagatcagagatgcttaacctgtatcatcgtatatataataattgccactctttacctaggccttggtgttttctgtgtgacatctttccagtccccattttgactgcaataaatttttttttttttttttggagacagtctcgctctctacaacctccacttcctgggttcaagtgattctcctgcctcagcctcctgagtagctgggattataggcatgcgccgccacgcccagctaatttttgtatttttagttgggacggggtttcaccatgttggtcacactggtcttgaactcttgacctcgtgatctgcccacctcagcctcccaaagtgctgagattacagatgtgagccaccatgcccggctgactgcaataattttttattctcttaattacttactaactagagtaccagctgtgagattttgctcttaaacatccagtcacatcattttcccaatcatgcaaagaaatggtaatatccttagtgatattcacagagcattgtgaatatctgccgatcaatgctagactattaaaaggaacgtgaatgtcagggtacattcctagtgttttaaggtaaaagtcattaaaggatactactatattgtttcacaaaatgcctcttgaccattatcagagatagattctaagctaaacggagcagttatatgttagaactgacacagaattcaggcggtgtgatcaattgaataaaatttctcaatcaaggtaatttccccagtctttggcccatggttattacaaaaaaaaaatttttttttctttgagacggagtctcgctctgtcacccaggctggagcgcagtggcgcgatctcggctcactgcaacctccgcctcccgggttcacgccattctcctgcctcagcctcccgcgtagctgggactacaggcgcgtgccaccaggcccggctaattttttgtatttttagtagagtcggggtttcaccgtgttagccaggatggtctcgatctcctgacctcgtgatccgcctgcctcggcctcccaaagtgctgggattacaggcgtgagccactgtgcccggccacaaataatttttaaaaagaaataatacctcttcacagctactcaggagactgaggcaggaggatcatttgagtccatgagttcaaatccagcctgggtaacataatgaaaccccatctctgggccgggcacggtggctcacgcctgtaatcccagcactttgggaggccgaggcaggtgaatcacctgaggtcgggagttcaagaccagcctgaccaacatggagaaaccccgtctctactaaaaatacaaaattagcctggcatggtgatgcatacctgtaatcccagctactcgggaggctgaggcaggagaatagcttgaacccaggaggtggaggttgcggtgagccgagattgtgcaattgcactccagcctgggcaaaaagagcagaaactccatctcaaaaaaaaaaagaaaccacatctctgaaacccttagtagttacatgtaaactgtcatctccattttagagcttaatgaagttgacaggtcttaaattaggtcttatgaatgtgcctgttactgtctttaaatacttataaatagcatcaccaagttatttaatgggtagtttttaactataggtcacttggctttcacggatgacaacgataaatagaactttttgttcttgtctagctatatggattcatatgtggcagcagaaagcttcatttatattgagtgagattttgtagggaattacatggggcggtatgttttgatttggtttttctccttaactataaatatatcttgaaaactttttgtgtatcagaaggaattttaggtcagacatggtggctggcgcctgtactcccagcattttgggaggccaagatgggaggaccagttgaggccagaagttgaagacaagcctgggcaacatagcaagacaccacccccactgcccccccagaaaatttaaaaatcatccgggcttggtggtgtgtgcctgtggttccagctactcgggacactgaggtgggagggtcgcttgagcctgggaggttgaggcttcagtgagtcatgattgggccactgcactccagcctgagcaacagaatgagacttatttttttcttttttcttttttgagttggagtctcactctgttgccaggctggagtgcagtggcccagtcttggctccctgcaaccttcgcctcccgggttcaagcagttctcctgcctcagcctcccgagtagctgggactacatacatacgccaccacgcccggctaatttttgtatttttagtagacacggggttttacaatgttggccaggatggtctcaatctcttgacctcatgatccgcccaccttggcctcccaaagtgctgggattacaggggtaagccactgcgcccggccaatacttttttttttcaagcaaaactttgtaagactcatgtgacatcaaacgtaataataaaaattttttgaaattcacacggaaaaatactaaaatttccgtgttacatcatgaatgctttaatattactttaaaatcttagtatattataaagacacacaattcacaattgtcaactcacagcacatcagtctaagtactcctgattatgctaatgtttattttctttattattgcttttactaaaaataagctcttagcatattatcccttactaaaaagaaatgaactgtcaagcattaaaagacatagaggaaaatttaatgcatgttactaagtgaaagaaggcaatctgaaaaggctacatattgtatgataaaatgtgaaaaaatatatacaagctcaatgatgttcaaacctacagtattggtgaataataacctaagcaatttaatactccagcttagttcttataactcctattattcactatgacatgagtcatataaactttattagctttaactacactttcctctgaatgtttgtcctcaaataagattggacttgtctcagaactgctttaccactcttgtgacctttttcagttaagtgacaataaagctgtttttcaggctgagacttaggggcactcctgcttttggcatgcactgtctcatttaatcctcacactaatattataaggtagatgcaacagcccccatgttacagaggaaaaaatagaggatcaaagagattaacttgccaaaagtatggctaataagtaggtgaagcatgctgagaacttagggctgccttaatatccatgtcattcttccaactctttggcaacagttttctaatatgagttctttaccccattaatgctgtgaaactaagaacaccatattttaagtggcttaaaattccaagcaaccagaatatggctagtgttactttcctattttatatgtgcctaaagtaaagtacatccttggtcatttcataacatgtataacaattgctatgattatttgagccacgatagaattctattctaagagcttggcagagctagaagaacaacctgctctttggtagggagtattgcagcacgcttcttgcaaggacattcagttttcttgcctgaaaagcaaacacaccactatttgtgtagtcaccagtctaggcaagggaggaacaatggttttaaaaatacacccagaaaggaactagaagatacttgtattaggtgggtaaccttaccttccattatcgtaaatagttgctcaagcttcttcacagtaatggtctgcatttcttatgtagcaaaacctctggagattttgaatgtttttgatggtcagaactagagaacttctctatccaatctcttcgttttaggtaaggaaactatataggtcagcaagtaaaaagtctaatcgaaggtctcttggaaaaatcatagcagaactgaagtctcttgctcctttcccagtgctctctgattttatattactctgtccccacaaggaatgttatctcaaggtaagatggttttgtatagtaatggttatctctgaagctcatgttgtttaaggcctgacagataatccttttgtagtatgagtcttgtagttttgctaacgtcttcagtgatttagtgtgacccctctgagcctagatcatattttccttcccctccctacactcaatgattaaagtacgatattctttctaattgcccattagccccctgctgctcttggaatccttagacttctgtgggcttttggaacttctgctgttaggtttcatgaataatagtcccctttctgttgagtttctctggttacatcattttatttaccaatgtattgctttttaatatcagtaacattgaatattaaagtaggtgataaaatggatcaagcaggaaacttgaccattacaaatcgatgctaactaaataaccgagataaccacgatgcaggttgccgattatccaggacccttttttgatctcctttggaaagggagtcatcaattctgtcctttttccttaactttgaaagtccatccttctttggcaatagtcttcaagggttttatttagctcccttttactaaaaacaagcatcacaaaatctcatctgttttttacaaagaagcctggagtaataccctgataactataggggaataatgtcatcaacagaagaatagaatttgggaagctgaccttatcacagtctatgagattaaatgtcttgggcatagtagtgtagctagagaaaagggaaaaaaaaaaaacactaattctcttagtttctttgtagttctccgtggaaaactcctttacccacattggtacccttttggttttgctgctatggtggttagaaaattagaaagcagaagaatcacctcctgtttttagaaataccctaaaaaatggcaggccatcactgggccttgtacttctaatggccaaaatgtatagcaacataaagtgtctagaagagaattctctaaaatacaagtaatcactgtaggtgattttttaaagaagcacagcacgtggaattgtagtgttgaagacaccatgctgggtatcactggaataacccctgtgctgccagcgttgatgtgaaatagaagatgacatcttaaaccaattactgtactgcaacctagcgtcatacgaggccatataccaggttcagaggaaagtaacttgacttcaagctcatgttatagggaaagatgtggattttattagagtagaacataaataggcttaaacaggaggaaaatattctagccgttaggatctgtaattgctcagaaaggcaggaagtattttactttgggagatgaagaatggaccagtctggccagggcagtgggtttcacattcaaatccaaagatatgaactacagggcagtagaaggcagggctctgggcacactctacagggaggacggcttcagtcatggtgcatacacacgatgggctctgggcacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcatcgtggtgcatacacacgatgggctctgggaacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcagtcgtgcatacacacgatgggctctgggaacactctacagggaggacggcttcagtcgtgcatacacacgatgggctctgggaacactacagggaggacggcttcagtcgtggtgcatacacacgatgggctctgggaacactacagggaggacagcttcagtcatgcatacacacgatgggctctgggcacactctacagggaagacggcttcagtcgtgcatacacacgacgggctctgggcacactctacagggaggatggcttcagtcatgcgtacacactatgggctctgggcactacagggaggatggcttcagtcgtgcatacacacggtattactgaagaagttcctttctgaggcagtctagctaaaggtatgcacataggcagatagtctattaaatttgaacatgaatattaaaactgacactgagatttcagtgaagggtgaagttataatttataacagtgtttaaaatttggtgtatttcagtagctgttagttaagcatttatttattagtgatttttgagaagtttgtgttacttctttttattaggaaaaacatttgactagccattagctctggcatctgaattcctgctactctcctagcatctagaagtatttctgatgttatcagacagagtttaatcagaaagactcaacttctttagtggtttcatatgataaacacatttaccttcctgttcaggtctgttttagtttgggcaagccagggcatcaaactatatgtaattgttttaatgtgttacaccatcatgggaattgatcctaacataggcattttctttacttcttaaaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgaagttgagcagttggattcaagagcacttcccctttgccttcatcaggtactctggtaaacccttcactttcagcctcacgaaaattcccctagcagtgtttggaatgatctaaaatgctgtcttggctgggcgcagtggctcatgcctgtaatcccagcattttgggaggctgaggtgggtggatggcttgagctcaggagttcaagaccagcctgggcaacatggcgaaaccccatctctacaaaatatacaaaaattagccgggcatggtggtgcacacctgtagtcccagctacttgggaggccaaggtgggacgatcactcaagcctgggaggcaaaggttgcattgagctgacattgcaccactgcactccagcctgggagacagagtgagagaacctgtctctaaatacataaataaatataaaaataaaaaataaaatgcaatctctgtaaaattgactgtgtcccactcatcactggtgagcccgggggagggtgaccctcgtgggatatttggcatattactaattgatggccacatcttggccttggctaatccatagtttaaacaatggttcactttttaaatcagtgataaagctgtgtaagagtttgataagcatctaccaggcaccaaagaccctgctggacatgggtaaacagagattacttggcagaatatgcccgtaagagagcccctgcagaacaggagcaacggttctatcgataagtaagtgtggaattttgtgttcagtgttagagtaaacatatgttaaagattcagcagcacaaaatgagtgattcattctgccctgtggacacttgggaacagaaggcgactcttgagctgggttttccaggcttattaggcgctcagtgggttaacagaatgagctggtccaggaagagatcagcctgtgaaagccgtggctgggatattattggagatgaagatgttaaaagaggaggtgagattgaatagctggtgacattgagactttatttttagggactgggaatttttaattctaagagtgcctgaatcacatttgcattttagaagaagaactcttttgaggattgagagggtgtagatgttagaggatggagaggctggagactggggagcctttaggccggtggtgaggaaacttttttttttacataagagctaattcagaagaaattaagatatttgagctgcatcttattttttattgtattgtattgtatttatttatttatttagagacagagtctcactctgttgcccaggctggagtgcagcggcatgatctcagctcactgtaatctccacctcccagattcaagccattctcctgccttagcctcctgagtagctggaattacaggcacacaccaccacgcctggctaatttttgtattttagtagagatggggtttcaccatgttggccaggctggtttcaaactcctgacctcaagtgatccacccgcctcggccttccaaagtgctaggattaacaggcgcgagccgctgcacccagcctgcattttatttttacataaaatgaaattaactggtacatgggaatggagaaagtgatttacttttgtaatgagaagtgaataatttttaatttttaacccatttagaaaaaaaaatagtgcagctggctgcaagtgcccagctttacataaacatgctctttgaggctgaagcaaatttgactaattgtcaatgtgaaaataaaatagaaaaactgttcttggagttatttctaaacagaatttgtctctaatcctaatgtaacaaaaacggatatgatgttacattaggatcagagacaagagtattctcagggcaaacagaaaatgggataaaaagtaaagtaggcagggcacagtggctcatacctataatcccagcactttgggaggccgaggtgggtggatcatgtgaggtcagaagttcaagaccagcctggccaacacagtgaaacctcatctcttctaaaaatatacacacacaaaaaaattaaccaggcatggtggcacgcgcctgtagtcccagctactcgagaggctgaggcagaagaattgcttgaacccaggaggcggaggttgcagtgggcggagatcgcaccactgcactccagcctgggtgacagagtgagactctgtctcaaaaaaaaagggaaaatagggccaggcgcggtagctcatacctgtaatgcagcactctgggaggtcgaggcaggcagattgcttgagcccaggagttcaagtctagcctaggcaacatcatgaaaccttgtctctacaaaaaaaaaaaaaatgtagccaggcacggtggcgtgcgcctgtaatcccagctactcaggacgctaaggtgggaggattgcatgagcccaggagtttgaggctgcaatgagccgtgattccatcactgcactccagcctgggtaacagaggaagaccccatctaaaaatagacaaacaaaaagttcaataggttttgtcccaattcaggaaaatgtatacttttacaaatttgtattatctcctttacgaacttgaagaatgcctttgaggaaatgtatactcctggcctctaagctgtcacgaactcaccattgttgagtagcaccaacatcaaggcagctttctaatcactcagctttcactgcatttgaacagtggattgcacggcaatcttttctctcctgggaaagaaggttagagaatacggtggtggtttaaaagtatgggctttggccctaccacaagctaagtggcttttggtttctcctgttgtaaagtaatagaggattaaatgggataatgcatgtaaaagcacttaacatatgtttgacgtacagtaaaagccaaagaaatattaaacatttaaactctattcctactgtcactaattcagagattgctcattggaaatcaagtctggggatcagcaaagaaatactgatgccattagaaagctgagacgtcagggtgacaagattcggttgatggctgcctcctcagcccaagaagacagaatatcctgtcacctcccaagggacacacaaatcagggagggatggagatatattttattcattttagtaattcccagcacatcacatggtatatttcacctagatttgccagttgttgacatttttatcaaatttttgctctgttttttagctggggctataggcatgtgccactgcgcccagctaatttttgtatttttagtagagatggggtttcaccatgttgcccgggctggtctttaactcctgatctcaggtgatccacccgccttgacctcccaaagtgctgggattacaggcgtgagccaccacgcctggcctttttgctcttgctctctctcgtgcacacacacgtattttttccattgaaacagttgaaagtaatttgcattatgacacttcacccctaaatatttgtacataaatctcccaagaagaaggatactctcctacataacatacaaggccattatcaaccccaagaaatgagtcactgatgcaataaaattatttaatatacaatccatattcaaatttcccccaagtagttccacaaatgttctgtgcaactgttttcccccagtgcaggattcagtgcaggatggcatattgcattcaactgtcagtattctttagtctcctgtaatccagaatgctcccagcctttctatctgtatcagtctttctccgcccctttctttctttcacactgacatttatgaacagtctaagaattcatgtagaatgtcccataatcaggatttgtctaattatttctttctttttttttttttttttttttttttgagatggggtcttgctctgtcacccaggctggagtgcagtggcgtgatcttggcccactgtaacctccacctcccgggttcaagcaattctcctgcctcagcctcctgagtagctgggactacaggcccgtgccaccacgcccagctaatttttgtatttttagtagagacaaggtttcaccatgttggccaggagggtctcgatctcttgacctcacgatccgcccgcctcggcctcccaaagtgctgggattacaggtgtgagccactgcgcccggcctaattatttctttaagatttgattcaggttaaacattctgggcaagaatttacttaggtaacattccatacccaattctctcttgaactgattctaatctggtttttgttcccaccactcccccaaaattgcactgtaaaagtcaccagtgatttccatgttgttaaatccggtggtcagacctcagttttcatctcactggagctattggaaacgtcaagttgatcacatactctgttttgaagcgttttgtttatttgcctttgggagctcttttcttggcttttacctcttacatcacttggccatgccttctccggctcattttctgagttcccatattttccttttttttttttcccactctgtcaccaggctggagtgcagtggcatcatcacggctcactgcagcctccacctcacgggttcaagtagtcttcctgcctcagcttctcaagtggctgggactgcaggcgcatgccaccgtgcccagctaatttttttatttttttgtagagacggggtttcaccatgttgcccaggctggtctcgaattcctggcctcaagtgatcttcccaccttggtgtcccaaagtgttgggatttcaggcatgagccactgcacccagccctaatttttaaacactgggatgcgtcagagttcagttcttgaatctcttctcattctgaattcacttcctggtgttttcatccaatcctgtaggtttgtccttttttttttttttttttttttttgagacggagtctcactgtgtcgcccaggctggagtgcagtggcacaatcttggctcactacaacctccgcttcccgagttcaggtgatctcctgtctcagctccacaagtagctgggattacaggcacgtgccaccacacctggctaatttttaaatttttagcagagacggggtttcatcatgttggccaggctggtctcaaactcctgacctcaggtggtccgcccgcctcagcctcccaaagtgctgggattacaggtgtgagccactgtgcccggcctgtcctatttcttttctgaactccagacttaactatccagcaactcaagatgtctcatgggcatttcaaacttaagatgtacaaactcaaactttgattttctcccgtatctgctgctttcctagtcttacctctcttgttaaatgccaacttcgtccctctagttgctgagaccaaatgccttgaagtgatactttatttacttttccctgcatccaaatccaatccaacagcaagtcctgcagatctacttcaaaatatacccagaacttcttacctctttcactgctaccatttccgtacaggataccatcaaatctcacccagattcttgcaataaatttctcactatagagacttttctgccttcactctcccttccacttagtgctttctctctacatgaccgtcactgtgatgcagataaaacataagtcagatcttgtcactccactgtgcaaagccctccgatggcttcccttctcatttagaataaaagccaaaatccttaccgtggcctacaaggccctacatgatcttgtcctgttagcctcctggatcttcattgctaaaattctccttaactcactcctttccaggttcactggccttctgacagcttctcagatataccaaggatgttcccacttcaggtcctctggtatctcctatctactccttctcaggaagccactaggtgatgtgctccagcaaaacaagggagtaaaccaagaaacaggaaggtgtgagatacaggaaactgggaatcctactcaggacagaggtgaagggaatctaagcaaagggagattttaagatgacagctgtatgccaggaaggagagggtaaccagtcctgtttcgagtggatcacaagagtctggggagaggcttttctatcattttcctgtttgtagaagtatttgactccttaaagcatagacatgtaaaatttggatgaaaataagaactaaaagaagacataattcaggcataaggtaatgaaagcatctaggctaaagtggtgacagtggaaatggagagggatggatgtgagatctttggaaggaagaataactaggacttggtatagattgttgtattagtcagggttctcttagagggacagaactcataggatatttatatatatcctatatatatttatatatataaaggggagtttattaagtattaactcgcatgatcacaaagtcccacaataggctgtctgcaagctgaggagcaaggagagccgagctaagtcccaaaactgaagaatttggagtctgatggtcgagggcaggaaacatccagcacgcgagaaagatgtgggctgggaggctaggcctgtctctctttttcatgtttttctgcctgctttatattccctggcagctgattagatggtgtccaccagtttaaaagggggtctgccttccccagcccactgactcaaatgttgatctcttttggcaacaccctcacagacacacccaggatcaatactttgtatccttcaatccaatcacgttgacactcagtattaaccatcacaattgtaaaaagagaataaaggagaaatcagagatgactgtaggaccattaacagaaataaggtattcgagtgtgagaactaattttaggaaaattgtgatttaaaaagtgatatataatatatagaataatatgtgctaaaggccaatggaaatacgacaacatatacttgtattttgagctcgtggaactcttaaaagttctgttttaaagttcttgttcttaggtatgagtggtcttttttacactgacttagttaatatgactacagattagctttaaatgtttaactgaagtcatatgcttggcaggtttcatatagaaaatcgggccctcccttgggcctcttttgtaagggcactaatcccattcatgagggcagagcccccgtgacctaatcacctcccagatacccccttcttcacactatcccctgggaactcggtttcaacatatgaatttgtgagggggacacaaagattgaggccatggcccttcacagtgtctttttttagagcgttcctgattggtaaaaggataaccaggatcaccttacacctgttgccttcccagcagttttcacctttttcacatgattccactcagcatcttgcaattcattccaaatcagactcaaaaaccattttaagcacttactgtagtgtgctgggcattatgctagatacatagtctctctgttttttttatttgtatttatttatttattttcatttgcttcctgtacctgggcagcaaacacaatctctctttcaatccttatggcagccttgttttatacagctgcaggtattactgtccctgttttaagataagaaagttgaggcttgagatgcgaaatgacgtgtccagggccacacagctggtaagtggcagggcttggactaaaacacaggccattcacctccaaccccatgttctttctgctctactgggctagctttcagatttagaaatatgctttaaaaaaaagtcacatcttctcttcctgctagacttgcaagggggagatttttaaaggggaaatactttgtatatttatttctcaagatgactttttacctggaaattttacttttgaggcactgggtttcataaccttctctgcatagttactttatggtattagaactgctacagaagcctgcaagctaatttctgcagtgccaggaaatctggtgacataatagttatggaccccatcaaaactcctcaaataagagctatttataagtaaccatgtgccaattttgcacaaatgcaaaaaggcaggaaaaatggctttgaagagccagacattttattttaatgggcaacctgaaactatatctcataccatatatagaaaggaaactgtgcaataccatagatgttttcactggaagtttgtacttgaaatttttttttctttgtttttttgagacagagtttcacactgtcacccaggctggaatgcagtggcgcaatttcggctcactgcaacctctacctcccaggttcaagtgattcttctgcctcagcctcccaagtagctgggaatacaggtgcacaccaccacacccagctaatttttgtgtttttagtagagacagtatttcgccatgttggccaagctggtgtcgaactcctgaactcaaattatctgcctgcttcggtctctcaaagtgctgggattataagcatgagctgccatgcccggctctgcagttgaaatgtcatcattgatttcaattaggtgtaaccccctcatatgctggaacctgctagtactgacatatgagaaccatgtttactgacgtccatcacattggtagcttgacatcggccatggtgggagtattgacaccactgaaatgagcaaacactgcaagttggggctctccccaacactctggagacgactgttaaatattagcacactgctggttacaccattatatgaaattctcattttgtaagctaaagaaatggttgaagattggcagtttgacttggttcatactacttttaaaacatattattagaacaataagctggtaaaagataaccagattcttaaaaatcagtttgtcccttgcaaaatctttaatataacataaatatggaatcaaactttatattaactgaaaactaatcatttatagagatgactgagtcagtcatctacatggctcatggaaaaaatgtcacatttgtaggatttaaactaggcaagtattttcctttaaaagtatgctgtttcccctgagggatttgggaaaatccattcctttttattgctagcttataggtttgacaagtactttaattactctttgcatcgtcaatttacctggaaaacggagatagtgatgtataaaggttatacctttttttactagagacaatctgtggaaaccattttttgttttggtttgttttggtttttttttgagacagagttttgctcttgttgcccaggctggagtgcaatggcatgatctcggctcactgcaacctccacctcccaggttcaagcgattcttctgcctcagcctccagagtaactgggattacaggcatgagacaccatgcctggctaatttttgtatttttagtagagatggggtttcaccgtgttggtcaggctggtcttgaacccttgacctcagatgatccacccacctcagcctcccaaagcgctgggattacaggcgtgagccaccatgcccggctggaaactgttttaagaatacagagtttatgcaatatttcagtgaatatttttagttttagtgatctgttcataaatgtcatatctaaataaagatctaaaaatatcccaaagtttttagaatcaaagaatctttaaatgtaaagatgtcttagaatgaatctgataactgacaagcctgaactgagaccagctcctgagtcttggatctctttatctagtgttctttaccatatgtagcactttgtacatattctaaacaatattaatcaactgttagtgctcagcctggccttttcttaactatcagaccagaccaaaaagtcagtgtcctgtgaggtcctcagccggtggtttgtgaaacaggaatgaaatcaataggatgttgaggtctcaggtgacttgacatatttctgctttttctttttattaattatttatttatgtttgcttcacagcatttgaaaggaatatttctacttttaatttacaataaacaatcattttttcatttgtgttctatttttgtaagtctctaacatttttctcattctttagagtcctaaactctaatgaatcagggaaatctactttgacttgaggtagagtaggaagaatgatgtgtaaacaccaaagaacgtctctgctttgcttgagatgagtaacttcagaattgcatcctgtgcctacagtcagatttcttctgaactgttgaatgtagtttaaaaaaagagttttcttaatttgatatcaaaaacatttggaatttcaagatcttaatttgtttcaaatttatcttctcatccaagtgttaatttaattttctctgtgttttctttgtttttaacagatagcagaatcctatttccaggaggaggactgtatccttttcttaattacaggaagaaatttttagaactcttacagaaccattcattttttttaattgaagtatattttacatgtaatagaatgtacagatcatatggtttcagtggttttgacagttgtatgtacccgtgtaaccacctcagaaagcaaaatgtaggaaatttctgtctcttcacaaaatttcctagaaccatccaaagtttaccttcataaataggccttaattttactaaaataagtatttgtatttattttttgaaggaaaatttgtattattttaattatttttatgtacagaacactcaacagtgtacatttaacccagtttagcggcatgttctttagcctttgcctttttgagcttggcaacgtgcgccacagacttgggacccgggacattgccgcccccgtgatggtgaatctcgtcgtatctgtcgttgtaattggtcctggactagacagcccagtcttgccttccccttggataatgcagtaagggacccccattttacgacatagggcaggcaagaagacagccagctggaagaaggcattagtggaagagtgtattttgaccaaaagcagtaaatctcaaagctagcttggtagcaagcgagagagagagaacttctgagtgatcatgaagacaaaaagctgaacagtgagtttttctcttccttttttctgggtcagcatttagagcattgcccagaggaaggtaggcagttggacagtgtatcctgacctcacaagatgcagatctgtgtgatacaaatgagaaggctaaagctcacaggatcatttacaaagaagtagaatcacgtgataataatggaaatcactgtggcaagttaattgagtgtttacaaaagacccatataagtttttgccctgtcattgtttaggcatgtgatcctttggtcttgtgggagaaaagcattcagtgggaaataataaggatcaaggtgacttgaaacagaaacacttgaccagagagtcacatagttctttgacagaaagtaaggagagaaataaaaaagggaaacatgtagattccaggattccatgtggtcctgtttccttaaattacttttagttgactccgcagcagacattccttgagcattaaaaccttcttttagtttctgtttgccgatagtgtggaatccaagtagctattgcataatatgccacattaaaatttacctacttcaaaaccaagaaacattactaggctgggcgcagtggctcacacctgtaatcccagcaatttgggaggctgaggcaggcagatcgcttgaggtcaggagttcaaaaccagcctggccaacgtggtgaaaccccatcttgacaaaaatacaaaaaggagccgggcatgatggtgcatgcctgtaatcccagctactctggaggctgaggcaggagaatcacttgaatccaggagggggaggttgcaataagccaaggtggcaccactgcactccagcctcggtgacagagggagactgtgtctcaaaaaaaaaaaaagctggacgcagtgattcatgcctgtaatcccagcactttgggaggccgaggcaggcagatcacgaggtgaggagttcgagacgagcctggctcacatggtgaaaccccgtctctactaaaaatacaaaaaaatcagccaggcgcagtggtaggcgcctgtagtctcagctacctgggaggctgaggcaggagaatcgcttgaacccgggaggtggaggttgtagtgagctgagattgccccactgcactccagcctggactacagagcaagattccatctcaaggaaaaaaaaaaaaaaagagagaaacattactttagatatgtttaaatttaaaaatatttagagtcctctcatgttttagtaagctgcaaatttctcaacatctataggacattgttcttcaaatatgggaataatgtaaatagtgtggatttctattttccttaaatgttctattcagatgagaaagcaatgaaattcattcagctagaacgattgtatcatgagcaattgctcgcaaatctttctgccattcaagaacagtggggtaagtacagaccaacatggaatgtggaattagcagtaatccaacaagtcactatctacaaaattaacatatttgacctggttttataaatcagaaaatagatgtttccataaacaagttaatgttgcaaagaaagtagcatttttaccacaagtctattatattgtgagaagacttttttctttgtattttgctcttcatatcaatgccaagaaaagaatacttgcaactatttgcatttttcctaatcacatttcatgccctactggctaatttagtctctaggatgatatttacttatattgaaaagtaataagttagttatttctaactgttgggttgtttgaaaagataattttgcatgcaaatctttatgagtggtgctagttaactgtttgtttgtttttttgctcctaaatatgttttataagagccagtgactaacaaatactttaaatttagaaacaaaatggaaaactgtgcaaccacatacagttacggctctaaggaattcagaaaagggatttaatggtgaagattttgaacggcttacgaaaatttgtgcaacacatcaagagtaagtatatcagaatttcgttagaatgagttggagtagaatattgaagaagcattatagcattgagtatccatttctttgttttatgttttcaactggagaaattaagatggatataatataattattgcaaggctctagtattggttcgaaccccgggagcgcgccaacagacagcacaaggcggtgtggagcatcacgctgttttaatgagcacctgggtgcagacgggctgaggcctaaaatggcgtcagcgccacgtgaggacggggcaggggttttacagtctcctgtaaacaggaagtgtccctgtctgatgtaacggctacgtggtacctggatggcctctctgtctatcctcggtggtgcgtgtcttccggccggggtgcgtgtcttccggccggccctcttcctgcttctgcttctcgctgacgcgcgctgctggtgcaagtggcctcgcgccttgggactgggtctgaggagggaggagttattcatccccccaagctttcggccctggggagaatctttcattcctatttggttatagaaaaagggaaaaggggcaactttctccataactacttcaggtgtgacatagagggtggcgtgggcacctcggaaaaaaagaaaaaattttggcgtattcttgagagtcgggttggtatccatcgtgtcgttgtagcaggagcatcgtctggattgtctggcgattaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcgtctatgttaagacagcaattggagatgttaaacttaccacagaccgcaccctcttctgctaataagtagtctagagccagcctgttttgataaattgctgggtgcatttggttttgttgtcacgcgagcatttccagcgctggggcggtttggttagtgattatctctagagcagcctttagtctaattattctatttagcatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaaaacgaatccaggttgaattgtgcataggaagctagtgctaaggtagccgtgagtaagcctgggttccccatatccaaaggaatccatcggggcagtccatcgtcagctggtgttcctaggattgtcgcatagtgcacttaggcaggggtatgcggcagaagagttagtggtgtttgtacagttccaggccttttttgacaagacacaattgaggtagctgaagttagagggagaccaggctccagggggtaaccttggccaccactcggctgtggaggcgttgactgttagggtttggtgacaggggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtgtaaagggatggaaataccacgggtgattttcaggggtagttgttggttttgagacttttgctttggctataatccattctctctttctgtcttcgagcacttgagcgtttgctccccattgtccaattttggtgaagcaaagccactgtttcccttttggacatgtagccccattatgactgccagatactcctagattttttactttataataactctttcctgattcaacacattcctcgactaaggttccacaataggatctttctatatgactatggtgagtgaaggactgttgacatgagtatggtgagtgaaggattgttgcatctttcctctgtggtggaaagactgataacactcacagcagctctgaagggctgctgtgggcagcagggcggctactgaccgtataaggatcgtggtgagggatattcccgtattaagacttttggttggaagtgaggcacagcatcggattgggtagatacaggccatctctggaagcaggtgtttagtcttcctcgtgttttggttttaagaaaaagaaaattttttggttaatttcagcttggtagaagaaactggcctggacaaccacttatctgttaatgttttggaggaagaagtagcctttggggtgagcttgaccctggtacgatggacccagttggggagtccttggactctcatgctgttagtgtgcatgctgagtatcacagcgtaggggcctgtccactttggttgtagctttttgtgaggatcaggttggccaataaacacgtctgtgcctgcaagacagttatgttgagaggacaaggaggtgtcggcagggagaggcatggcctcattcgctgcttcacaaatgaaagaccatgtctggattaaggagggtaagtaattcccgagtggctcagagtctggtgatggcggaggccctaagacaaaagttcgtccatacatgattccaaagggactataaaaagagggtgcttttggtgttgcacggagtctcatgagggtgtaagggagatttctcatccacgactggtgggtttctagagccagcttggtgagttgagctttaaggacagagttgatgttttcaagtttgcctgaagattgaggcctgtaaggtgcatggagaacccatttcattcctaaggacgtggagacaacttgggtgatttggctggtgaaggtgggcctgttattggattgcatggatgtcccaatggagtgtgaaacggggaattgtatacatgatgagagtttgtatgacaacatttgcaccttctgaagttgttgggaacgcttctacccacccagagaaagtacagacaaagactagaaggtaatggagccatttatcaggtgagtgaagtctacctgccaatcttgcccaggtacctggccctgggcttggtggttagaaaaaggcggtggccagagggagccctggggtgacactgagtggcagatacagcaggactggatgatctctggaacgcggctggaaaggtgaggacaagtgagaatagggtggagaagttgcaagagaggtttgtagccgacatggaaagagttgtggaggctttggaggataggcattgtttgagcatgaggaagaatgagaagcgcccttccttgatgtaccatggtccttgcttttggaggttctggacctggaagtcctccttttcttctgaggagtaaagaggaaagaataaggacagggacagaaactggccttgcacggttgtagggctacttgtttggccgcctgatctgctagtgcgtttccagcccgtataggattgtctggggtttggtggcccctgcaatgaatgacggcagctttctgcaggagctgggcagcctgaaggagcttgctgatgagagagccgtttatgacaggagtgttgtttgcaattaggaaaccccgttctttccagatggacaagtgtgagtgcactatgtggaacacataacgagaatctgaatatatgttcatttgttgtccagctgctagagtgagagctcgagtgagggtgatgagttcagccttttgggaggtggttcctagggggagcagattggcttcaatagtgtgggcgggtgacactatagcatagccagcatgtcggcatccttgatgtaggaaggaactgccatctacaaaccaagtaaatgaggcatctggaaggggttgatctgttaggtttggaaaaagtataagaaaggtttgaatggtgtccacacagaagtgtgcagggtcttgggaggtagtggcttcaggtaagagcatggccaggtttaaatgggagctggttagcacggtgatttggggagtttctatgaatagagcatacagttgaaggagccgtggggcagacatgagacttagtacactgcagtgagctagcatgtctttgatgttatgggttgaataaactgttaggttggcacgaagggatagttttaggcttccaagggtgaggacagcagctgccaccagtgcttggagacaggcaagccatccgagaactgtggttgtgagctgtttagagaggtaggcaacaatctggagggcgggtcccttagactggttagaacatgtagtgcaactccacgccgttcgtcgggatagagagaaaggtttggtgaggtctgggagagtgagaacgggggctgagatgagagccttctggaccagacggaaagggtgggtaatcggctgtgcagggtttaaaggcttatggagagggcctttagtagcttagtataacggtttggcaagtagagcaaaggaaggaacccagagcctaaaatatcccactagtcctagaaaagagagaatttcttgcttagtttgcggaggtgggaggaactggaggagcagtgtgcggtcggttgtgagccctcgggtttgcagggtaagagctaggcctaggtaggtgactgagggggtgcttacttgtgctttcttaggggagacccgatacccccactctgccaagaaatttaaaagacagatagcatgggcatggcagtctttttgagaggggctacacaggagcagatcatcaacatattgaaggaggtggacagttttaggaataaggtacagaggttgtgagcaagggcccgggtttcggcaccaggtgcaaggcactagtatttgttcaaatcccaagagtgcaccaaccaacagcacaaagcggtgtggagcaacacactgttttaatgagcacctgggtatagacgggctgaggcctaaaatggcgtcagccccacatgaggatggggccgaggttttatggtctcctgtaaacaggaagtgtccctgtctgatgtaactgctatgtggtacccggatggccaatctctccatcctcagggatacgtgtcttccggccagccctcttcctgcttctgctatcttgctgatgtgcacttgtcgcacaagtggccttgcgccttgggactgggcctgaggagggaggagttattcatccccccaagctttcaggccccagggagaatctttcatttattacattcctttctcagtttttattgagtttctcacactgaactcagtaaaaggtcaactttgtgtaggttcaaaagattcttctgattagatatttaaaaatataacttctgattttgatctctttttggttaggagatgagcagttcagatggacagaattgtgtattagggctttcgattcaacttgctaatgtttatgtgttgtagtaaaaacataacatttttaggagtagtctgatgctagaaagcaaatagaatacagtatctaaccaaaatcttgcagaagaaaagctgcatttaccaggtaattttcagttgcttgaattgtatcaaggagttgtattttttaaactaataataataataaggcacttacttttttaaaaaaaattccttattcagagatccagatttctgaagacaaagggagacaatagtgtttaaactagtgcaaatttctggaatttagaacatgaattctcaatacaaaggctaaaagactttccattttatggataactttttctccttttctctcagaatcatggagagtaaactaaagctctgtttgttaatagtgagacagtgccaggtaattgttgtgtagctcatacagcagataaagaactcactaacaaatatttattgaacatgacatgagcatggtgtctttatgcttcaaaatttggataactccccccatatcatttttaaattttttaatatttaaaaatattttcaagttacacataaagtgtacaagcttgatgaatttttgcatagacgtatatgtctatgtcactaccactctgagcaaggtacaagatatggaacattccagccctgcagaaggctccctcatgcacctgccaacttcgtacccacccacaatagtaaccactatctggactctataacaatatatttgcctgtcctgtaattttatataaatgggatcatgcagaatatagatttttatgtctagattcttgcacccatcagtatgtcttgttccatgttgttgcatgtaacagtggtttgctctgttttattgcagtacagatttcttggatgactatgcagcaatttattcattctattattagtagacttttaggatgtttcttgttttgtgaatattatgaataaagtggcgatgagcatttttgtgtgtgcctttaatggatatgtacattctgttatcttgggtattccctaacatttaatatttatactttttgttatctgtttccatggagaattccaacaaaattatcttcaaccataatctattttagactaaaatgacataaactgaaatttttaaaatatgtgtgtgtgaaatcgtctttattagcaaaaggttgtcattcttctttttttcttcttctggaatatagcatttgttgcttctttgggggtttccaatagcagttggccatctaaggagataaacacatgatatagctgcactttgaactatgtgagccagtggtaatgtttcagccgtggaaatgttctgtgctaatattagaatccagagaagctgtatttttttatagccatttcagtgacatttgtttggaagcatattgctgctgtaatttttttaaaattcttttttctttcttttttcctacagtcctcttttatccaaacataaggtaagagattgtttcttttgaatatatttctaggaaaaatgtttgtgtcatatgtctgttgtatggactattttggaaaatgaggaaacctttcccaagttattttcagcttcctagtttaatacaacagtttccccaaaagttgggttttcttgttttaaactttttagatagcagctgtggagaagtcccaggaaaggaaatgctccacgcagttactagtgtctgaagatccaaaggaaggaggagctaccaccaaagagtcaggtatgtttttaacttaagctatggagcaacgtaaaagatacctgcctcttctgatcttttacaagtgatacatctgaattgctgcaaaggatctggtttttttttttttttttttttgcacttacatttttgtacatatacctctcctagaaaaagagcaaaatgagactttttatattgggtagctccacattttagacatctattagtagataccataaaatctaagttcttataaaaacataaaattcttatgttttcagtaggtggttatatatatctaacagaataagaaaaggttgtacaaaatgctctgaaatagaattggtgttggtacattcatacattgttttctgtttaaaaaccaacagttattgtatacactttaccagaaatttgttctgtaaatttagatattttaaactctatatcttgataatttatagcaatttaatttctccccttttctgtttactaacatatgatatactttagtttgtatgtatacatttctaaagcatttatgatgtatttcataccaccttgtgccttacgtcaaaagattttaagaggctttcttctaaatgtttggcatgttgctcattataaaagctttagaaaataaaaataaataaatatgttttagggtttttttcccttgatacctaattttactattaatatatatttctaggctttatgttcctgggcctgagagccctaatattgaagaggaagtatcaggtgttttggatgagttgccctgaagtgatatgatgatggtgatgatggtggtgatggatggtgatgatgatgatggtgttgatgatgtcataattagccttttgccttttttccccccttttttgtttgagacagggtctcacgctgttgcccaggctggagtgcagtggcaccatcacggctcattgcagcgatctcctgggctcaagtaatcctcccgcctcagtctctccagtagctgagattataggcacacaccacggcgccccagttaatttttaaaaatttttgtgggtatggaggtctcactatgttgctcaggctggtctggaagtcctgagctcaagcgatcctctcacctcagccccacaaagtcctggaattacaggcatgagccaccatgcccggccagccttttactctttacaaagtatatttttattctttcaaatcttactttatctccttttcacttctgaaacaagctagggatattgcctggggtcagtcctactagactctgttcttccgtcttttccagtcatttttatattagaaatcacagtaaaatgagcttcataacaatcttaaaggaggaaaaatatcacaaagctgcccagtttgggtgtgaacgtgtctctgtgttgagcaccttgggaaaagtgctattacaggctgtgcatttgagtttgagacttacttagcatggttgctgcgcagcacctcctcctgcttggcctctgctttgagtcatgtggtacagatggggaaactgaggtaccaagtttcagtcacttgcttggtgctttgattcgcagctagaacctgggtcttcccatttctaattgaacgcagcctgcttctgctaagtacattgtatggattatcaaaggcttcaacaatccagatgtcccaggaataaccctatgagggagtatggactaaattctggggaaagaaatgttgctccagtttcaccaaacagtgttttaaagagaaatgtcaataatgtgggtgactctccgaatgtagtttggaactcttgccttttccaaaattatggtggagtttttttccccattattttctgtagtatttctaaataatgggatgaagcaaccattttcaggctattttgtaaataatacattgtacccacagatagtctttattacttatcacttaagtggtatctcagttcattagataccatactgtaagtggttgtatttcgtggcatagctgctgtccatcaccccatctcctactcatagaatggcacctcagactgttctgtaccttttcagtcacttataagctattaaatagtctcattttgccgggcgcgatggctcatgcctgtaatcccagcactttgggaggccgaggcgggcggttcacgaggtcaggagatcgagaccacagtgaaaccccgtctctactaaaaatacaaaaaaattagccgggcgtggtggcgggcgcctgtagtcccagctgctggagaggctgaggcaggagaatggcgtgaacccgggaggcggagcttgcagtgagctgagatggcgccactgcgctccgcctgggcgacagagcgagactctgtctccaaaaaaaaaaaaaaaaaaaaaaattgtctcattttgattatttagagcttagccctattcaatcctgaacttgattttcacatttaaatctcactgtactcaaagctcttctccgccctccagttgccagggctgggaacactgtctgctcctggttggagttagctggactggtgattatgactgaacccaggttgtgcggtggctccagcaggagcagctacggaggaggttactcccaagctgctcccctagataactgcagcctttaggtaactgaccctcaggtggaagcaacacaccccagtcctctgatgtgggggttctctctgccctgtgctttcacagtgcctgtgggactgtggtccccaatcttatttagtctctgagtcctgtggacatgttttgagggacatcttctgaacctttgggtacctggaattcatggaggagtggcttggccccctttcctttggatgtggccctcattgctctaaccttgccccattttaacagagggaggggcagacagcaagcccagtgtcaaagcaggcaaccaaagggaagtgaaaggtgcctttgttttcttgcagccttacaaactttgagtgattctttggggtggggagagagaaggaaggctgtattctcccaaaggtgaccccttcttccttctcctgatctgcatctgatatttgagtcagggtgtcaggggaggtgctatgaactctactgaatagctacctctcagcagcccgaagttgagtggcagcctcagcaccagatgctctgaaatctgcaggcaatgtttcaggaatgccttttgcttgatatggtatgggcctcaattgtcagttggtgattagtattaaagtatcaatatgtttttggagtccagggtgaaaaagaaagaaaaaaaaagtatcagtaaataaacaaatggaataaaattatcatcatattttctcttttattttcacctttggctcattatttatttaagttaaacaacatattagtataaaaaggttaaaactttttttttttttttttttttgagatggagtctcgctctgtcgcccaggctggagtgcagtggcgcaatctcggctcacagcaagctccgcctcccgggttcacgccattctcctgcctcagcctcccgagtagctgggactacaggcgcccgccaccgcgcccggctaattttttgtgtttttagtagagacggggtttcaccgtgttagacaggatggtctcgatctcctgacctcgtgatccatccgcctcggcctcccaaagtgctgggatgacaggcttgagccaccgcgcccggccaaaaaggttaaagcttctaaaatagttatgaatgctaagtgtaccaataaagcgaggataagcaagcttctctgttacctacccatccatgcacttctcattcattattcacacggaggtttttaactgtttcattttaaagtgaaggaaaaataagttggttttactcaaagtagaaattgaaagagatgtcagaattcaaacccatttctacttgttgcaaaaacttatcctttttattgctaccctttgctacctccctttaagaagttgctcggcgtggtggctcacgcctgtaatcccagcactttgggaggccgaggcgggcagatcacgaggtcaggagatctaaaccatcctggctaacacggtgaaaccccatctctactaaaaaataccaaaaattagctgggcaaggtggcgggcgcctgtagtcccagctactcgggaggctgaggcaggagaatggtgtgaacccgggaggcggagcttgcagtgagccgagatcgcgccactgtgctccagcctgggtgacagagcgaaactccgtctcaaaaaaaaaaaaaaagttgcaagtaatttgcaaacacatttattagtggtattatggtcaaattataaatttgaagagaaccgagtttgttcctttaatcttagtaaaccagaccagtactacttttcttacatttaaaatgatgaatgtgttactgaggttcatcatgtaaaaatatttacttaatacaccatgtctttttttgtttgtttgtttttgagatggagttttgctcttgttgcccaggctggagtgcaatggcgtgatctcaggtaaccgcagcctccgcctcccgggttcaagcaattctcttgcctcagcctcccgagtagctgggattacaggcatgtgccaccacgcccagctaattttgtgtttttaatagagacggggtttctccatgttggtcaggctggtttcgaattcccgacctcaggtgatccgcccacctcggcctcccaaagtgctgggactacaggcgtgagccactgtgcctggccccatacaccatgccttaaatgtgctgaaaataatttttgtaacttcattttaatgtaaaagtttaataaagttcagaatatcttttaaacctttgaaaatgactttgttgattttaatgaggactaagtgatttattcatattcacatgcttttgaataatccctgttatgtataaggattctttactaaatattttgggtatttcctctacctaaagacactattatgcaacagacagaatttccatttgaaagggttagaatattgctgtattacacatattcatatgtcccttcttttccttcctatacaaagtgttgttttgaatttttaacaatttatttttcttcatctttagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtggccagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggtaaatcagagatgaagtacaattaaaagtaaaatggcatttaaaaaacatatatatgtattaaatattgccttgtttttgtaagttttcccttgtctcaaacatgagggaaaattctagttaacgtaagcttttaattattagtagtttttacatttgtatgtattgaataaaatgacttttaatcattgcaatgttcatacta

SEQ ID NO: 2234 - DNA, 102247 bp, Homo sapiens
ccgaggattgtgagtggaccgttgaggagagcgaccgaccatccggctggtgtccggactcgtactctatggttgtccgcgctctgcgcttcctctctagccgccagtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccgggtgaggtgtagcccggtccccttacctcctccgcctctcaggtcgcctgttttcctctcctttctcagctactgtgggtctcctattgctgcgcgtcgcgccaatttctccctccctaggggactagcgccagaagtcgttcctcacccggctcctggaggagcctgcggcttccacggtctccgttcctttctgttgtgtggcccacagcccgctctccccaccctcgtggatggttttcatttcccccccacacctggtcccccccatcactaccactttggttgtcaagaaccgcgtggtgtctcccttccattcctctctctgggccaatattttccttaattttttcagtttgtgtgtttaaaagacttaaagttaagattaaaaatgaagatgtaaaagcttacaattcctttctaagcttaaaaagattaagactttaggatgcttactgtattccttatgtaaacttagtcaaacacatcgtactgtggaatgcgatttaaaagacccaattttgaagactaaaaataggatgctgtaatggaaattttggcagtctttttttttttacctattgggcaatgttagaagacacggttctttgagagtgttttccgtgtttcaggatcaaacttagagcttttacccattatccttaccaccaaggcaagaaacggcagccaatcaactccgtgtcttagaatacgtacaatcctttctgcttactctactgagagtgtaattgagtttggcatttaaatgcacgaggaaaaggttcctaaggaatgtatcacccagcaaatagtctgaagattatactcatctgatgaagctcaagcggataaagaattgacaactaaatatgaccttttgtgtattataaatttgttaggacatcatagaaaatatctcatcaactgttgtgcaaactgtggggactcactcattggtcttaatttgcttaaattcttttttcgtacagttttctcactgacaattttctagaggtgactttgcatcctctgaacctctctccattactgagctgcctccccctctccccttaaaaaacattttcatagattcagaaatacacttttttccccctccaggacctggagtcctaaatatttttaaatcagataaaatagaattatgtcttcatggttcactcatagaaatgtgtcgttgaatttctgactttttaaaaaaaacactgtggtggctgggtatggtagttcatgcctgtaatcccagcactttgggaggccaaggtgggaggatcacttgctgccgggagttcgaagccagactgggcaacatagactctgtctccttaaaaaaaaagaaagaaagaaaaagagaaaaagaaaaataaacacattgtggttaaaaacaaaacagttattttaaaatgcactgtcttatttcataatgtttgtggaccaaagttagcctactgagtcctagaaaaactgatgtcattttttattttgcttttgagtgttattattttctcttggttttgggaaagagaattacattataatattccctttttacagtgttgatggttcacttgtttgtaattgaaggtacttgaataataagagatttttgtacatcttattttttttctgaggtcccaggtgctgagaatgttgatttcaccttaaagatgaactttatgatcaggatttagacatactttattagaaaaacttgattagtgtgcagtatttcccatcttttttcttaagaagtgtggttttctatcctatgctgtttttgcctttttgaagtaattttgagatggagtctactctgtcgcctaggctggtgccatctcggttcactgcaacctccgcttttcgggttcaagcagtttctcctgcttcagcctcccgagtagctgggattacaggctcctgctactatgtccagctaatttttgtatttttagtagagacggagtttcgccatgttggccagggtggtcttgacctcaggtgatcctccgacctccacctctcaaagtgctgggattacaggcgtgagccaccacgcctttaaaatactttttttcttgctttttacatttaaatatatttatttatttgtgaaggcggagttttgctatgttgcccaggctggtctcaaattcctggcctcatgcaatcctcccacctcagcctcccaaaacactggtattacaggcatgagccaccacacccagcctcttttggcttttaaatgacaactgtaattgggaaatgccaagtgatagtccttgcttgctgttagaattaaggctgtaggtctgtagcagcagtcttcaatagaaatacaatgcaagccatataagtaatttaaaattttctagtagtggtattaagaaagtaaaaagaaacaggtaaaattttagtagtatattttatttaatcttatatatgttattttaacatgaaatcaatttttaaaatgagatattttacattatttgatactaaatctataaaatctggtattttatacttacagcacatctcagtttggagaagccacatttcaagtgctcaacagtcacatgtagctaaatgttaccttactgagcagcacaaatgataggatggtcacatgatttttaagctgtcttcctacactgagagtctgattctgtggggtaaattaaaaactcctcttcctgaagtactgcggtatttaatttgagaagtttctatgcaggaagagagttctaagtctcttccttttagtgtttttgttttgttttgtttgttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagcaaaatttagaaaggaagagagtaggttttatggctgtagaatgctgggagcctgagtaaagtaaaagattaacttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaacttccctaaatactactttagctgctgtgtgttatatctacattaatagctaaattagcctgaaggcctaattaatattcagtgtaatttaatacaggaaacatgccctcttctcaacctttatagtatgaagaaattttaaattacctggtcagtgaacaaactccctctgtcaaatatagtcatgatagacctggcacaatgtagggactatggggagtgttagaggatcaaagacagaattggggaaggggtatagttactggatgttacttgttctgtgagagatgtgtggatgttctataagaaaataataatgttttttgtttgtatttaaaactagatagctgtttattggcacccttttagttggataagagaaaatacattgcttggtttctacaagtgagtcttagcaaatttattgtagttattttaggaagagtaattgatagtgcagtaatcttcagtttttaaaaagccctgataaggtttaactgggctttaaaagcattatatgcttaatgagaaattctaacttaatatatgtatgtcttgatactgttatgtaacctttccagtttagggccttcaagattcacatgaatacaggctttcctttatgtaggaatcattctcatgggggaaattatatatcctctcagggaataattttgttttttaagcatttgaaataattgtttgtaatattcgttaaagaacacatcattagcagaattctgaagtcttataatagcttgagatttcttaaattgtttttatcctttttgagacagtcttgctctgtcgcccagggtggagtgcagtggtacgagatctcagctcactgcaacctccacctcctgggttcaagtgattctcctgcctcagcctcccaagtagctgagattacaggcgtgtgccaccacacccagctaattttttgtatttttagtagagacagggtttcactatgttggccaggctggtttcaaactcctgacctcaagtgatccgcccacctcagcctcccaaagtgctgggattaaaggcgtgagccactgtgccaggccaaatggtttttatcttagttttgagatcctgctctttaacattttggagatggaaactttttgccattataccctccacccttccgtctcttaggacttcctgtttttcatcatcattagccacgtggaaaggaaagacagtgtgtgcctatgaaaatactgacaaatcaagatgatttttccttttagattaagaaaaattctgaaacagtaaatggtaaattttgtcatatttatttacttattttagagatgaggtctcactatgttgcccagattagccttgaactcctgggctcaagtgatcctcctgctgtagcctcctgagctggggctataggcatgtgccacactgtctggttagtcacccttcattgacatttgggcatttgatatttaaattgacagtatctaggcaattatagaaattaacattattttgcaattggcatatgtattaaattttcttatgagaataattgccctgtttttttctggagagccactacctgattaaataatcacatattttttctaccttagctgcattttgaaaactcagtgaattaggtgactgtggttttctaatttgaatgaaggtaaagtaacctttaaaaatggtttttggccagtcacagccatgcctgggactcacgcctgtagtcctagctactctggaggctgaggtgggaggatcacctaagcacaggaggtcaaggctgcagtgaagcatgactgcaccactgtgctctgcactccagcctgggtgacagagtaagaccctgtctcaaaaatacatacataaatgaattaaatacttttttatattatagattttgaaataagttattaaaaaatttgggaactttataagatcaaatgctgctgtccttgagtatttgatagtatactgcttatattttgattttttgtatgcattgtccttgttcattatttttctcttctgcagcttttattcccagtatacaactaaatcttaaaaataatttttagatgaactgaaaaacattgcctaagatttttcaataaggatttttgtgaaaatgtgtgtggtttgttatttagagatgagatctcactgttttgcccaggctagtcctgaactcctgggctcaagtgatcctcctgccttgacttcccaaaatactgggattatagacgtgagccaccactcccagccaaatgtatgttttatttattgaataataaatagtggagttatttatttatgtgtgtgatatgtggtttttttaattattaattttttagaaaaatagaagcagggtttcgccatgttgcctagggtggtcttgaactcctgagctcgagcagagtgcctacttcagcctctcaaagtgctgggattacaggtgtgagtcactgcaccaggcctgagttatttgtttttacctcatgaaacaacaactaacattttagatttttttttccacttgtgaagcatgaaaaagtttacttaaattggatcttacaaggattcatgtaaccaacaggatttcctccctcagcgtcaactcacatgaaaagaggggtggacgtttgtgcaaattatactggttatgatattgtgaaatgtagtttcctggaaaagtcattattgatacccatttttggcatcttaattcaaattcagccatcaggctttattttaaatgatttacacagcaatctctagattcttcttgctacaagtattttaaaaattttgttgtggagttcttcggcatgccagttagagttatacctgtagcattggataagcactgtaaagagccaaaattagaggtaatacccttgctcttccctactttaatcatgtaatataggtcttgtgacttggaagaagattgtcttattaccattacatttgaacttttgttttaaaattaatctgttagatcatatattcaccaaagctcatcttttcactagccagagaaagctgtatttcaaaataacctaaagtaaaatagtatttaattcaagaagttagtttttattatatcaggtggcctcttggttggttatagtttcgtgcattctgatgcctgcgggctttttatccttcctgtctccactgcatagctggggaaaacctagggattgcccggtgaatgccaacagagctttaacctgtgtgtccatggcttgccttccctgaagcctcaaagagaacagctgcgagtgcaaaaaccttatgagcaaaatttctgctccaggaacacttatctgggctgaggaaacatattctaagaatatctgttttgtaactaaagcttccatgtacttgtgtaacgctttgtgtaaaaccacgtactttgtatagcctttgctggagagtttccattttcctccagctcttcagtgtaagtgaaaaaatgtgcccagaatgtctctatagattattctgccttccctcaccttttagttttttccatggaaagctgacaggtcagaataggcatattttattagaaactcgaagtggtggggggtagaagtacacatctttgcctcttttttccttcttgattacagaagtaataatgctccaaagatgttttttaataaaactgagtctcgctctgttgcccaggctggagtgcagtggcgtgatctcagctcactgcaagctccactactcctgggttcacgccattctcccgcctcagcctccggagtggctgggactacaggcacccgccaccgcgcccggctaattttttgtatttttattagagacgggatttcaccgtgttagccaggatggtctcgatctccttaccttgtgatccgcccgcctcggcctcccaaagtgttgggattacaggcgtgagccaccgctcccagccgctccaaagattttttaaaaagataaataaattttaacttgaggaaaacatggttattcaaaaattcgtgttttttctttttctttaaaaaaaattttttttagagacagcttgtcgcactatcacccaggttgccatgcagtggcaagattatagctccgtgcagcctcaaactcctggactcaagcaatcctcccacttcagcctccctagtagctgggactgcaggtatgcagtctaattttttttttttaactttttgcagagatagggcctccctgtgttgccccagctggtctagaactcctggcctcctccaggagcgatcctccagccttggcctcccaaagcacaatacgtgtatttttcagagggaattctcaactttcatcagatttttcaaggaatatgttactcaaaaaaggacaacaaccacagcatcagtttgacttggttggttattgcatgtccttcctaaatctctcttataagcagctatggctttataaggattcctatgtaaaagcatcatttttagtagtattttatttaaaacaaaaataatttaatagattatgaaggaaagtcatagtgagtcaaagaacaaatctgaacaaatcttcctcaagtattttatttatttatttatttatttatttatttatttatttttgagacagagtctcactctgttgcccaggctggagtgcagtggcacgatcttggctcactgcagcctccacctcccgggttcaagtgattctcgcctcagcctcccgagtagctgggattacaggcacccgccgccaagcctggctaatttttgtattttcagtagagacggggtttcatcatgttggccaggctggtcttgaactcctgacctcctgaccttttgtcaagtgttcagacaaaaacgtgcacaaatgtttataacagcattattcacaggagtcaaaaagtagaaacagcccaaatgtccatcaactgatgaatagataaataaaaggtggtatatctgtacagtggaagattctttggcaataaaaagaaatgaagtatcagtatatagtacaacatggataccccttgaaaacatgctgagtgaaagaagctaattgcaatagaccgcatattgtataattccatttacgtgaaatgtccagaatatgtaaatctatagagacagaaagtacatgagtggtttgagtgattgcctggggctgtggtgggggtgcaggagaatgggaaatcactgctagtgggtatgtagggcaggggggatcttttcggggtgataagatgttctagaattgattgtgtacaatttgtgaatactaaaagctattgaattgtgcattttaagtgggtgaattgtatggtatatgaattatatgtcgataaaggtgtcatgaaactcaactagaaaaaatacaagtttatcatagaaaatatgtaaaatacagagaagtggaagaggaaaaaagtaattagcatttttaaaaattccctatttttatttcaatgataaaaaataatataagcttattcaagaacaatactgacactttaaaacaacattctcatataagatttcagtgctctctgggcgcggtggctcgcgcctgtaacgcctgtaatcccagcactttgggaggccgaggcgagcagatcacttgaggtcaggaattcaagaccagcctggccaacatggtgaaaccgtgtccctactaaaaatgcaaaaattagccaggcatggtggcgggcgcctgtaatcccagatactctggaggctgaggcaggagaattggttgaacccgggaggtggagcttgcagtgagccgaaatggcgccattgcactccagcctgggcgacagagccagactccgtctcaaaaaaaaaaaaaaaaaaagaaacaaagatttctcagtaattggtggtgggagagttggatcctcacgtgcctatgataaccgtgcagtcacagtgtataccgtattccactagtgaacaaaactttaatttttacagagcagcatcgtgttcagtgactattattttaactttattgattttttttgcatgtcataattcgtaaatttgttttggtttaattgtgttagagttagaagcacataaaaattatgtttttacatccttttttttttttctgagatggagtctcactctgtcacccaggctggagtgcagtggtatgatctccactcactggaacctctgcctcccaggttcaagtgactctcctgcctcagcctctttagtagctgggaccgcaggcatgttaccacgcgcggcacatttttgtatttttaatagagacgggatttttccatattggccaggttggtctctaactcctgacctcaggtgatccacccccctcagccttccaaagtgctggggttacaggcgtgagccaccgcacccagccacaaattatatttcttaattctttttatcctattaccccttcccttggctaccaccccctaccctccacccacatccacagtgctttaagataaaggagattaatttcgcctgtaggaatccatgggaacttggccttcagacttcaggcaagcaccagagtggaaacatttggaagtctcattctaacatgtttttaccttaaaattttttaaaaattggattaggtttttatgtttttagaaccatcttgccctcccttttctagcttttgacgggacattgccaaattaataggctgttttgaagattactaagatgggcatctttcatttcagtagggaaaagaacatgtgctaaaggaattattcaggtgaaaatgcttttgtgattaaaaatgttcttcagaactgatacttctcatgaagtaaatttcaacagtacaagcaaaccctgttttcctgttgttatgactttgttgttctcacctgtcctccataccgccccaccacagcgtcactccctttatagcctcttcctactggtacctccttattccggttctctttctagaccctctactatcctctgtgtttattttgaactgaactttggattaaagtactacctttttgtagctgttactcaaagtttgtcttcacttgtgcttggaatttgaggttactctactgttgttcagactttacctttaaaattccaggagcatcctgttagtaaaacaatgagttttaaaaatttcggtaaaggtggtcataattcttacaggaaccagttttatcccatttagttcacagattttcattttgcctttttaatgggcatagaattctctttcatgtttttctgtagccgagaaacctagtcaagaatgtgaggtgaacctttcaagtaaaattgtagttgaagaaacaaaagtggaaaggctaggttaaaataaatttgaccctggcctaattccatttatctcatacccactttagaaaagaactaaaacagtctgtgcatggtggctcacacctatcatttctttgcgtttttactaattcatgcttcttttttggactttgctgactcgtccctgtattaatctttcactgacaaaaatatcctctgttctcaagtttccctcttctgtttcctaccagataatacttgtggtttttttgttgttaagtacattttaaacatcatctttagagatataaccatttttttctacatctgtttccttgggtaaaaggtagtgagagactttagtattgtagttcaattgaacaaacattaattaaacaccgttcatatgcctgggctatgttttggtgaggattgtaaaagaagtaatgggcacattctcctgctgcaagcattcaagcacttgaattccagatgggaaataatatatatgcatgaaataacttgagaaaaattctaaaacaataaataagcaaattcgagacagtgtctactaaataccaaataagttacagtgctttaaaataagctctaaaattatcgtgctctaaaaaatgggtctctgaaaatgtttcagtgtggattctgtattaaccattgccttcggctgggcgtggtggctcacgcctgtaatcccagcactttgggaggctgaggtgggcggatcatgaggtaggagatcgagaccatcctggctaacacggtgaaaccccgtctctactaaacatacaaaaaattagctgggtgtggtggcacgtgcctgtagtcccagctactcgggaggctgaggcaggagaattgcttgaacccgggaggcggaggttgcagtgagccaatatcgtgccactgcactccagcctaggcaacagagagactccgtttcaaaaaaaaaaaaactattgcctcaaattataattggcctcttctaaggctaaatagtattattacaatttctgttcctccttctcctcctaacttatcaaactcttcaaccccagctcaaattccatcttgcttatggaatctgccctacataccacaagcagcacagaatctggagccagtctgcctaggttgagtcctaattctgagaactgtttgactttggatgagttgctttacctattagtgcttcaaattgcttgtctgtaaaatgctagtgctaataataactacctaataggactgttgtgaggaattgttactatatgcatggcaaagcgtaagcactatataaatgtgtcttgttattctcatactctggtattacggtcacttctcacaatagacttaaacataaacatttctataaagtgatttatttgagcttaaatattttttggaattttatattttgtatattctgctctataatagctgtttgtgttaacataaaattagcatctctcttccatcctcacctttagaagtgaattgatgttaccagagagtgtccatttatcatcctgtgactttgcagatccctggtcagctttttctctttcctgtttctgttaagtatgtattcattctgccttgttgcccattaggttctgcatgtgtgcttttcactaccttattataagctcttcctcccaaggagcaatgctgtttcagtgatgacaacaaatgtgattattgaactcttagtgctatgcatcttgctatcactagaaaattcatgattcacaaatagccagtagctgggctaggtggctcacacctgtaatcccaacactttgggaggccaaaacaggaggatcacttgagcccaggagttcaagaccagcccaggaaacatggtaaaactccatctcttctaaaaatgcaaaaatggtgggcacctgtaattccagctacttgggaggctgaggcaggagaatcactagaacctgggaggcggaggttgcagtgagccaagattgccccactgcactccagcctgggcgacagagtgagactctgtctcaaataaataaaaataaaaatcacacagagtcctcagcagagtaaataaaacaaaatttctagcggttgacatctggagactatttacaaggatgttcttaatttatctttatggatgactttagcagtttcccataaattgtctcattttattcttacagcaaagaaacaaaggcttatagagttgaactaatttgactaagatttcacagctggcgagtatcagaaaactgtatttgcactgagaagggaatgactccaaaattagagcttcctttcttactgctctgtcttatctctagtcttagttcttgttttgaaagggaacttctggtacttacgaatgacggggcttatcttcttgaaagtggtaataaactgtactaaatttctaaggttaaaaaattaagatgtaacattaccagttttctcttttattgatggtttccttagattttttttaaataaataatctcttgtacctttttttgagaactgtatgtagatttcattctggacatataaatattaagggttaggtagcatttaaagtatttgtggtcagaaattaaatgaatgcatgaaatactgtactcttttgagtaaattctaaaaataatccctaatcatttcattacagacagttggacattattttgccatttaccaatatactttttttttaatataccttaaagaccagagagaaaggtaagaacagttatgaaattgcacttctctgattagaagacttattcaggaggactggaagcagaattttcagacgtttctttctaaatggattctattaacttccacagtactttgttcatagcagaccttcaaatatttggttggcttcatgcaaaaaggaggtatctctttactcccttctgtattgctgatgctaattgaattatcttttaaagattcagcatattttacggggatttaattttgagaacattggtgtctttctgaaggtttctttttttttctttttttttgagacagtctcactctgttgcccaggctagagtgcagtatcatgatcttagctcactgcaacctctgcccccagggttcaagcgattgccccgcctcagcttcctgagtaactgggattacaggcgcgcgccaccacacccggctaatttttgtattttcagtagacgggatttcaccatgttggccaggctggtcttgagctcctgacctcaagtgatccccccaccttggcttcccaaagtgctgggattacaggcatgcgccaccacgcccagcctgaaggtttctttatagcatgtaaaaaaaatgtaattcatcgaaatatccactcacatcctgatacttccttgagtaataatcttctgtctttagttgctatttctgtcctgtattttcattgcaattgtatgcttttcttctttaaccattcccatacatggatatggtaacagccacattggatgaaacttcatcagtgtctccatgctgtattttttctacccataccaatctttttttttgagacggagttttgcttttgttgcccaggctggagtgcaatggcgcaatcttggctcactgcaacctgtctcccgggttcaagcaattctcctgcctcagcctcccgagtagctggaattacaggcatgcgcctccacgcctggctgattttgtatttttagtagagacagggtttctccatgttggtcaggctggtcccgaactcctgagctcgggtgatccgcccaccttggcctcccaaagtgctgggattccaggcgtgagccatcacacccggcccatcccaatcttttagaaacgtagtctgggtccttgtaaagcacatggttgcttaaaaacattccattacagctgcaaactcctaatgtgttctagaggacattgcattttacattttccatttcttataaacttttacaaaagcaatataagtaaatagctgataaagtgttctttgtggctttgaagaaacgttagtagcttaggagatgccctttaccagcagcccgttagtacttggtttatattattttttattcatatgtctgagctggattctgtagggagaaatgaaaaatgttttataggcaaaattttatgagatgtctgctaatatcataggcaaaagtatttttgcaatatgtattatatctaattaatttaatggtatccagtataatataatatcctttaactggggtttttttaaatagaagtgtcttttcattacagcttaaaagatggttgtaaactttcatataagtcaagtacgcagttgttaataaccttatatgtatgtactccttatatttagcaagatgaaatttttcagatccatatgctaagagttatcagatttactggcccttcacacaaatcaaaaaacgaagttaaacacgactttgctgttgctgtttttctttcctctgccttctcccactgtattctatctctcaccatctgttactgacagttatcagcatagagtgacctgtacctggaggtgggttcataactgtcttttaccttccacatctactcagtcctgcaaactgtgaactccacctccatgcttttttttttttttgaggtggagtccctgtctcccagcctggagtgcagtggtgtgatcccggctccctgcaacctccgcctcccaggttcaagtgattttcctgcctcagcctccctagtagctggaattacaggcacgagccactgagcctggccgggcttacgttttgtatccttctcccctttaccccctagtaattggttcatggcccactaggggaagaaaagatggtctttcacaacagatagtctgaaaagcgctggtctcaattcctgtactgggctctggccccgcctccgtttatcaggctcgtcactactttacttcagcactcttattccaaagtctaactattcgctgttcattctgtacttcctcacctttttatttggtcctgtttatttcttctcttgagattacctctccatgcacctcaggtacgagtagaatggagggaacacaccatctcagagctgggttacaatgtcctcttgtccagtgttatctgctatatcaacatttcctccagaccgtggctgaagatgaacaaggcagctcagcagattgaaggtgcctggggccagcactcattcgccctgtctgagaaacgcagggacctccctgaccctgttgtccgcccgttagcgtgatgagcagctgtggatttcatctgtgtttcttgggcaggggggcctgtaggtatagaaatggatactaccaattggattggctgatttaatacctcatgaatatcagtaccttcatgagtattttgtgtctcctctggtcttgtgaatatttggtggttatgagtgctttcattccttcctgtgtttaccatacagatgccctgtttactttctctgtgtctaacttctcacgctgtttgctctgcacttattttcatctcttttatttgtatctttgattttctgtaatggaattggatattctcaaatattcacgcattacacctttccacagtaaaagtaaccttcattcctctgactctcaaagaaattgcctgtcattgatcacattcttctttgtagcaaagtttttttgagagaagaggaatgttagggcagggtttatagacatagcgtataattcattacctgctagagtatcagctcttgtatttttattagctacttttagaatatatagtcctcagggcatgttgtgtctcatctgtctctctcttgcctcattgtatttagtatgtggatcttgtttgttgtagacactcaaaattgattaccctgaaggctggtgaagtttagttaaagctctgaggtcagagttcagtctcatgtggagacttatttgctttgtttcatgtcctcatagtaaccttgaatgctggccaagtggcttttggttacaaagagcactgggtaagacaaagaattagcacttgtattgcataagcagtttaaaaccagtgttcctctgaatgtggggcaggagcatcgtgttcccattcaaagggcaacattatatcataatttttcaagataagaaaaagtagacaatgaggatggcagaagaaaatatatgtgaatttgcctgtaactgtactttttttttctttttaagaggcaaggtcttgctgtgtttcccaggctggagtgaagggatggtcatagctcactgctgccttgaactgctgggctttaagcagtcctcctgccgcagcttcctgagtagctagaaccacaggcacacgccaccaagctcacctaatattttagagtgtctgtagagatggggtctcgcttcaagacccaggctggtcttaaatccctggtctcaagcgatcctcgcagagtgctgagccaccatgcccagccacatatgttggctttcttgtataggtataagaattcagtgatgtatctatgttagaagaatccgaaatcgctaagaaatatgaaatttcaaattcacttatataagtcaacattttaagaattaattttctttaagtgaagtaaaccaggggcaagagtttcaaaaaatgcattcagatgtccacataaagtgggaagaatggcggtgcagtcaagaataaagagggagcacaaatgaaaattggtgtcgagatagactgaagaaacctggtctttccattatgatgaaaaaaattccagcgtaggtatcagtcttattgatactttgtactcaagtagaagattaaggtacaggattcttttagccagattgtggatgatctgcatgatgagattgatttgaagacagtgtatgaaaccaagtcgaatggagacggagtgtgtagtggaactcatctcagtagaccgtcccggcagccctgcagtcctccacagctgccaggacagttactgttcagtttcccacactggctattttaaaccttctatatgctccccaactccttgctcccaacataccactccctccctgcctccggtatatggatctcctatgagtctgtttctgctgtttttttcccccagttttcttttttaaatcaagacgtgatctcttgtatgcctggttgttttggattatatactgaatattacatatgaaaagttgtggaaatagtttcagcctttgctggatttatcttgcagagaggattgactttagtttctggcaggcaacaggttagaacagaccaccttaattcaaccagagattagatgattgattctgctgggccttagtccctgtgagcactgatctatttcaggcttgccttttcttctggggagtatcacttttaggtcccaccgcaaggcctgtggtcccctcttcttggaagacctcgaactctggtttttcgtccagctctgtgagcctgctcaacactctgctcagcttttccggcttccaaactgaagctttctgccagcttttctagtgatcagcaggaggggtttgtctgaaatgagccagtctgcccttgccagaagtacaagctttcttatgtttgtttttgcacatgtttaaaatgacagagccaggtgctggctcacatctgtaatcccagcactttgggaggccgaggcgggcaaatcacttgaggtcaggagttcgagatcagcctgtccaacatggcgaaaccctgcatgtactaaaaatacaaaaattagccaggcgtagtggtgcatgcctgtaatcccagctactcaggtggctgaggcggcagaatcacttgaatcgggaggcagaggttgcagtgagccaagatcacaccactgccttccagcctgggcaacagagactctgtctcaaaaaaaaaaaaaaaaaaaaaatatacacacacacacacacacacacacacacacacacacacacacacactatatatgtatacagcataagtgcatatgatttatgaacagatatacctacagtgggtatactcaacgatcagtttctttgcctacgctgggcgtggtggcatacatctgtaatcctggcactttgggaggctgaggtggcaggatcacttgaggccaagagtttgagaccagcctgggcaacatagtgagactctgtttctacaaaaaatttaaaaattagctggatgtgatggcacgcacctgtagtcccagctatttgggaggctaaggtgggaggattgcttgagcccaggagttcaaggctgcaatgagctatgaccttgccactgcactccagcctgggggacaaagtgagaccatgtcttgggggagagggggagatatatatatatatatatgtgtgtgtgtgtgtgtgtgtgtgtgtgtgtatatattactgatagtatgcttataagcaaagatatatggtatatctttgatatgtatctttattatatagtatatataatatataccttttattatatctgatatatattatatataaagctatatatctttgatatatttctatatataagatacatatacaagctctatcttatgtatcatctatatcaactttatatgagataaataagatacatagatatataaaagatctatatcaaagatatatcaaatatataacatatcttttatatatatctatatatgatatatatgcaagctatatcttatgtatctcatatatatcttagctatatctgagatatataaataatatataaatatataaatataagtacaccaccaaagtttggagactcttgcatgttagtccctcttttttaacgtgatgttggttcagtaagtatctgtggcctgcctggtaaaaatttttctaaatgcacaaagatgaatgtcagagatcttacgataatttctaatggggcggttatatagcccaacatataaacctgaagaaatggactcataacattaaaggaatgcagcaaataaagagtcttattggtgggttttatttgctgtgtaacctatttttctacattgtacatatttggaaaacatctcaagatattggaaattgttcattttgtggcctccttaaagtagcaatttggtatttacaacatatacacctgaaaacagctggtttttaaaagtaatttaaaaatgattatagtggttaaggatacaggctctggaatcagattctaaattgaatcctggctttgccacataatagcagcgtgactgaggcctatgcgtttaatctttctattgctgtttacttctataaaaaatggaaataattttagaactactttataggacttataaggattaaattatatatatgtaataaacttaaaacactgatacttagtaaatcttcaataactgttaaagagatggagtcttgctatgttgcgcaggccggtctggtactcccaggctgaagcaagcttctcacctcagcctcttgagtagctgacactacaggccacaccactgtgcccgactagtctcagcattttattcagataatgcaagctattttgtcaggcatcttaaaagaaggttctaataaattatttgcttttgccattgtattttcaagaattgacattttaaaacaatgtatagttttatgtgtctatttaatgagtaaagtataagacagtttccatgaggatatatagttgatacaggcagtaaacatgatttttgttttaaaagaggtggctatagtctgaaccaaagtattttcaagtcttagattctgttggttgtggcttaaaagaatgattgcagtacatttttacaacaaagaggtatttaaaaccaaataagcacaatttggatgtgtttacttctcttttgtttatttaagtaaaacttgtgtatatctgtgcataagagaaggaaaagagaagagagatgactctttatcttcatactgcttgggtatacccacaatgaggcttttgacctgtcatttccatttatgtaatggattttgaactcaaaagccctgtaaatacataagcgatcttgaaccaagccccattgtgaaaggcaggattgaggaatatgaaacaaattatgcttcctttcattcactttatctgccccaaggtttttttcggaatatgagtcacatagtttcagttaatttcttcatatttttaacagtgctttctcttcataaccgaaaatctgtatttgatgtttttttcccttagaatcattatcttcacatttattcttgtttttccttttgtgtcttgtaactttgtcacatttttatccttcttgcctaccttatagcataaattttctcttctgtggcctttctttttgctaaatgaagaactaaatctttatgaaattatattttttatttttattaaagaaatgttaaaacaatgtgatttacttttatactgtactattatgtagaaatttaagtatttagaatgattactgaaaggccgttttactagttttaatgacaatactatttaacttttatgaagtgccaggggtatttggaatatggggaagtacaaaaaaaaaggaacagcatgatctagtgatttacattgtgaatatgggaaataaggaggtaaaaattaattttaaatagtatctatttccttccacaagtatttgcatttgtttaattacagtaataataatatctatatccaggaaatacctatagcataacttgtgttagcaaggaagaatccagaatggagtgattcaccatgagccatatttggctactgtgacactgtcaaggcaatgtcatagacagcagcatcgtccaatagaaatatgtgagacatatatgtaattttgtggtctagtaaccacattaaaaattttcaaagggaaaattaattttagtaatagtttattcaatatatctaaagtattatttcaacatacaatcaatgtgtagaattaataaattcttttatattgattttattcatactaaatcattgaaatatggtatgtattttataaatgtagcacatcttaatttggacacaattttcattggaaatgcttgaactatatttcaatttcataaaatgtacaggtgaaaaacattcacatacccaagttattccaaacatacttgagtttttcagtaactgaattgatgtccatttaaaaatttaaatttattaaaatttataaaaatgaaaaattgagtccctcaatgtgtgttcatatttcaggtactcaatagccctgtgtggttagtggctaccattttgaatagcataggtatagaatagagctcacagttgaagatgtcagctaagaaaccctgaatcattattattattgttttattttattttattattattatactttaagttttagggtacatgtgcacaatgtgcaggtttgttacatatgtattcatgtgccatgttggtgtgctgcacccattaactcgtcatctagcattaggtatatctcctaatgctatccctccccctccccccaccccacaacagtccctgatgtgtgatgttccccttcctgtgtccatgtgttctcattgttcagttcccacctatgagtgagaacatgcggtgtttggttttttgtccttgtgatagtttgctgagaatgatggtttccagcttcatccatgtccctacaaaggacatgaactcatcattttttatggatgcatagtattccatggtgtatatgtgccacattttcttaatccagtctatcattgttggacatttgcgttggttccaagtctttgctattgtgaatagtgccacaataaacatacatatgcatgtgtctttatagcagcatgatttataatcctttgggtgtatacccagtaatgggatggctgggtcaaatgatatttctagttctagatccctgaggaattgccatactgtcttccacaatggttgaactagtttacagtcctaccaacagtgtaaaagtgtccctgtttctccacatcctctccagcacctgttgtttcctgactttttaatgattgccattctaactggtgtgagatggtatctcactgtggttttgatttgcatttctctgatggccagtgatgatgagcattttttcatgtgtgttttggctgcataaatgtcttcttttgagaagtgtctgttcatatccttcgcccactttttgatggggttgtttgtttttttcttgtaaatttgtttgagttcattgtagattctggacattagccctttgtcagatgagtaggttgcaaaaattttctcccattctgtagttttaatgaactcctcattaaagaaggaagaggctttattcgggcgggagctttggcagacttgcatcttaagagccaagctccctgaaaaagaaatccttggcccttttaagggcttacaactctaaggggtccacgtgaaagggtcgtgatagatcgagcaagcgtggggagcgtgactgggggctacatgcatcagctgacaggacagaaagtttcgcagggcttcctcatacgatgtctggaatttacagataacacaagtagtttaggtcaggggttaatattattattatttttttaaccaccagggccaggtggtggtgccagggtcgtctggctatttatcttacttctgtttctttccaactttttgctttctcccttttcgcctgtcttataaactaggcaaaagtgggagagaggagggcagcaggagaagtggtggtctccttccttaatggtatagggtgaatattttatcttgtacttttcatggttttagagactgtactttacatgtttctaaagattaagcatttctactcattaagttgaagaatctttagaagtcctctcactgaggtttttttccagaattactggattatttctttcatacctatcatttttcttaaaatgtaatacacttgtagataataagaggaaataaaagatgactgataaagggcttgcagtctgttttgtaaattttaaaaatattagtggtatccttcaagcagatttagcatttcttccaattctacactaagagtagcctagagttaaccatggcctttttttttttttttttaagtgttcaaaaggattttgatgacaactctaaggtaccttccagggcttatttttaggaaataaaaaataaaacgatagtataaatatatgctacctaaacttcccctcacatacttttttctaggttatttttttttaaaatcttcaaacattttcatttccaaatattgctgctgtttagccagagaagaacttatacaactagctttcagttgtctgctgagtgtccagggattaacataagagactaatttcagcacataacctatttaactagtcatttcattcaggcagtggtcccaacctgatgcacattagacttacctagagaacttgaaaaatagtggtgcctaggttccatcctcagagattctgatgtaatggtctagaatagaatttgggcagcctctcaggtgatcatcatgaggagacaggcttgacacctgtagtattcatgtgagaactagctgagtttggggttgggttgcatatggtgaaagggaatgaacttaagtcatttccttctcttccctatttacaatgaaacaacctaagagaaggggaaaatcaaagatcactgagaatctgcaaaggttagaaaatgaagtagcttttttctttttgtcattgtagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggtattgtttaaaatagtatttatcctcttctttaattaattaaaaatgaacctccttccctcccatactgtgtttactgtcctgcaccttgcttctttgcttacgatattctggagctagttccgccgcagcacaagtagatccaactgcatgatattccagtgtgatacgtctccacactgttccaccgtatgggtgtaacacaatttatttaatcacttccttatggcccttcccagtcttttactatcataaacagtgctgaggccgggtacggtggctcacgcctgtaattagcactttgggaggccgaggtgggcggattacctgaggtcgggagttcaagaccagcctggccaacatggtgaaacgccatctctactaaaaatacaaaaaatgagctgggtgcagtggcgtgtacctgtaatcccagctactctggaggctgaggcaggagaatcgcttgaacctgggaggcggaggttgcagtaagccaagatcacgccactgtactctagcctggctacagagtgagacttcgtctcaaaaaaaaagaaaagaaaaagtgctgaaattgacatcctttgtacatgttttcacattaggtactttaaatatatgcagcctcctctccctcctttataaattagaccattttctaccaatatcaaccttaaaaattgccttctgtcattcctgtggctttgatccctaacctgtgagtttagatgctactgtgacctctttatagatctttccatctcactcagcaggtaaataaaatacaggaacatatattaatgtacaatttaatatgtagtgttgaataagacatctggttctaattatctgtatcactttggttaaaaagtaattcagagtatttcttgtttggtatgcagtttggcagttgaagtttagagctatggaatttttggcctgaatcacagggcccccttgggaaaaggcagcctctggttattttttttatcagaaacatatgggactagaaagttttggtatgccctagactggattccttagtgtagtaccactttttacccaagccaacagattttacatcagactctagtgaactaagtagaatgcctcttcatcttctgttctcttctttggttaattagaaatatatctgtctatatcgtattttttatttgtatttttaaaatttgaagtaaaatacaaaacttttcagtttctacaaaatccatatttattcaataaagtaatttgaaaactttttaatataattcataatctggctttctggttaatgtaactcataatttggcttttcacgtccctgtatctttttcttagtagactcaaaataatttttaaccagggatatgaaagctttttttttttttcttttttttgaggcgagtctcactctgtcacccagtatggagtgcagtggtgcaatctcagctcactgcaacctccgcctcctggattcaagcaattctccttcctcagatgattctcctgcctcagcctcctgagtagctgggatcacaggtgtgcaccaccatgcccagctaattttttttgtatttttaatagagacaaggtttcaccatgttggccaggctggtctcaaactcctgacctcgtgatccgcccacctctgcctcccaaagtgctgggattaaaggcgtgagccaccgtgcccagcaaaagcatttcttaaaagatctaataagcagaggatatttacagtactatgtatatataaatcagtttattctataactatcattcaagggcaaattcaccaggcctctcaatctgattttgtgattttattttattttcaagacagggtttcactctgtcacccaggctgaagtgcagtggcgtgaccatggctctctgcagccttgatctcccaggcacaagcgattctcccacctcagcctctggagtagctcggacaacaggcatgtgctaccatgcctgactaatttttcttttctttttatttttgtagataaagaatctcgcactgttgcccaggctgatcttgaatttctggcctcaagcgatcctcctgcctaggcctcccaaagtgttgggattacaggcatcttgtgatgtctttaagaactgatacttagttgcatacctatgagtcagtcatagctttaagattgtgagtccttttactcctcccttccatggtctttattccacttttcttaggtgtgattatattattattatatttattttagagacaggatcatgctaccttgcccaggttagtttcaaactcctgggttcaagtgatccttttatctcagcttcttgagtacctgggactacaggtatacaccagtgggcccagcttataatttaaagttatttagtatttataatactgtgagaagatatgtttagaattactattccctaatgcatttgaaacatatgatttataaaatctagggatagtctttatacagcttactttaaacattattttctatatcttatataaagtgagtttaagagagtaagaaaggccaggcgtggtggctcacacctgtaatcccagcactttgggaggctgacagggcagatcacttgcgctcaggagttcgagaccagcctggccaacatggtgaaaccccatctctaaaaaaatacaaaaattagctgggcctggtggcatgcacctgtagtcccagctacttgggaggctgaggtgagagaatggtttgagcctgggaggcggaggttgcagtgagccaagatcctgccactgcactccagtctaggcgatagtgccagaccttgtctcaaaagagtaagaaaacagaatgaggagttataaaacccaagtacaaatcttatgattccaggtcacttggtgagactgaagcagtctctaccttgttgttgtcgtctgtataatgatgatcttcatctacctaaatctatgaaattcctttttaagctgtgagtttcttagatttcatagtagagatggtatactctatacttgaataaaatgtggtgattcacctctagtgcatctatagagtttttatattttacagatacatttttgtttgtcttttaagttttgttgataaattaaaagaaaggatactcctgtctgcccgggctggccatggacgaggcgggactgagtgtcctggggtgagttagcagggcacaggtgtttgagatgggggacccttaattttaaactgaataggattcttttgggtgtggaattaatcctttctagatgtggaagagacctagaatgggaagaagctttagtattgcctggaaagcttccctcagagtttagttgctgggaccccaccctaagaacttgcttcagcctgtcgtctctcagtacgtatccatcacccggtctgagtaatgttatctccctgtgatctctcaagtcagtctgtttctctccatcttcactgccacagttcagcagcatcttcagctggagtactgcaaaagccccctacatttgtttcccatcttgcttccatcctccatgtcaaaaataatgcaaagagtttatgcataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaataaagtaaatttattcactctatgctcccttgtctagtttaatttgtagtcatttttcaattactactgtccaaaggctagtactggaaaaaaaatgatagtgcaggactcttgtcactaatagtcatgtcattcctaatagtcatgtcattaggagacatgtcactgtttatgggtttgctggaggcagtatttgtgtcaatgggtaaaaccttgatcttagcctcagggaagtccagttgtcatcatataatgagcttttttttttcccccttaagagaattgaatccccttgatatgcttaactaagcaggatttcaagctgtgttacaacaagttttcattatagggcgggtgcactggctcatgcctataattgtagcactttaagaagccaaggtggaggattgcttgagccaaggagtttgtgaccagcctgggcaacacagggagacctcatctctacaaaaagtaaaataattagctgggcatggtggcacgtgcctgtagtcccagctacttgggaggctgaggtgggaggatcacagcagcagtgagctgcatggttgcaccactgcaccccaacttggagacagagtgagatcctgtctcaaaaaaaaaaaaagaaaaagaaaaaatttttcactgtagttaaaatggcaaagctttaggtaaatattatcctaaaaactaatgaccattacttatttattattatttttcacattcttacctggggggagaaaaacaatggaaattaatgtgttttttaaacagttttattaagatgtaattcatatacatgcaattcacctacttaaaatatataattcactgatttttggtatactcacagggatgtgtaaccatcagcagtcaattttagtatgttttcttcaccacacaaagcagccacttacatattagcacccacttcttacttccacttagacatcctaacctgaggcagccattaatctacttactttttctacagatttgtctactctgaacattgcatattagtggaatcatacaatagaaggtctttgactggcttctttcatttaacatgttttcatggttgacccattttgtagcatatatcagtactttgttcctttttgtggtcagataatattctgttgcatggatagaccgtatttcatttatacatcagctgagggatgtttgggttctttccactttttgactattctatggacattgctgtacaagtttttgtagagacatgtgttttcatttctcttcgttatatatctctaggagtggaattgctggatcatatggtaactttatgccaaacagttttccaaagcaactgcaccattttacagtcctgccagcactgtatgagggttacagtttctctccatcttcaccaacacctgttaatatctgactatttgattatctccatgtagttttaaaaaacttgtaattcgtataccataaaattcacctttttaaagggtacaatttagtggttttagtatattcacaaagttgtacaatttaattccagaacattttatcctccaggaagaaatcacgtacccattagcagtcactcctcattcttcccttccccaagcggtggctaccactgtcccataaagtttgtatatttgtatgagacaagtttagatgatgtgttttatggttgtcgtaacaacactagatatttactcagcgctagtcaccatagtatcaaagcatttaacaaaacagttcagcaaatggcgggaagccagaaataggcagcacatggaaactgggaagggaagacctttctcaattgacctgccactatcagtgccctgacttgtttctctggaggccttcacagtgtggccagctgaaggatgacaaggaggctagaaccttaaaaagcctgagtcaggctggtgtagtgagaacaaagactttggatttgaatcttggttatttgagtctcggttctgcctgttcttacctatatgatcttagaaaaggagctcatttccctgaaccccttttctcatctgtaaggaaggctgatcctacatgtcttgcaggattgtccttagaatgaatgactctgtatgtaaagcactttgtaaagtacccagcataaaacagcttcttctaaatggtagttgttgtgtttatgtgtgtcacaagatggtatttatttatttatttatttatttaagacaggattttgttctgtcacctaggctggagtgcagtggcgtgctcgtggctcaaaaacatcctcaagttcccaggctcaggtgattctctcacctcagcctcccaagtagctgggactacaagcgcatgccgctgcgctcagctgaattttttttttttttttgtagtggcgggtttttgtcatgttgcccaggctggtcctgaattcctaggctcaagccatccaccagctttggccccctaaagtgctaggattagaggcaggagccactgcaccagctacacaagatgatttctgagtggcgtgactgggagtaccattaagcaaaattaagaaattaatttgatttgactttaagtccattttacttcttttgtcagtacttttttttatttcctaggaactttttaatactgtctcttttcagatgtacctgtccctgccccattcccctaatgtacattcctaaaaatatatttccagttccatactagtttaatgtcagatgcaacctgctttttgggatgttaactgatatcaaaagtaataactagtaatgccataaaatatgaatccccaaaggcctatttgcatttttatatattgacttcggctatagtagaacattgatagctggcctctaaatcagctttatggagacaattgggtaatatctgtactggccagagttgagatccctgagattggtggggactgtggtgaacaggagtctacatcatgccctgcctaagtgcattcaaatttttaaaatgtaaatgcctggctaagcccctgtaagcagaatgatagggactggggttgatgttttgtgattgtaacccattctactcactaggtagatagacggacagtttaactcccttaggagtacataccacactttcagaattcagaagtcctggtttaccttatttctgctcctagtagatgttccacctcttttaagttaacatttctttggacaatgacatgcagaaacagtagcctctcattttactcttccttctttaagggattgatcaatgaaggcaggccatgtcttttctgaaggtcagctagtaagaatagaataaagagttcctgatttatatagagtcaaataatttcacagtcagaagagacttcaaggtcactagccaaaactgtcttaggaaaaaaaaaaaaaagccccaatattaaaagtgtgttagttttctattgctactggaacaagttatcacaaatttacaaatctagtggctttaaacacacgacaacacaaatttattatcttacagttctgtagatgaagaatctgacatggttcctactgggctaacatcaaggtgttagcagggctgtgtccctttctggatgctccctgggagaatctgtttccttgccttttccggattctagaggcttcccacattccccagcttctgttacccttcctccatcttcaaggccagcagtggctttgaagtgagctcaagtcctcacattgcatcactttgaccagctgacacttctgcctctctcttccacgtttaaggtcccttgtgattacactgggtccacccatatattgcaggataatctccctttttaaagatcagctgggctgggcgcaatggctcacacctgtaatcccaacactttgggaggctaaagcgagcagcatatttataagttctgggtatggggacatgggcatctttgggagctgttattctgcctaccacaaaaagattttaatatagactagatgataactttacataacagaataattcttcactttataaaagtttttctgacattattttgtagacccgtacaggattacatagtcaatagatatttattgagcattgttgctgggcactataaaactgctggtgcacctccctttcagttttgtatgctcaagtgagggagccacgtaactaacaagtgcagtctagcaagacgggagtcataagtaagcacatggtcgtggaggtaacctgtcctggagagttagagaaggttgtcaggaggagttggtatctaagctgagttaggacaaataggtgctagtgaagtaaaagcaatgcggacaaagaggagaggaaggacgtcagagatggcaggcgtaccatgggctagagctcacaagacaagaagagagcatcctacatttcagtatctgctaatattcctgcttgagcagaataaaagaaaagagtgaatcaaggggaaatagtagagagtagagcagtagagagatggaggcttagaagattagcaaagtccagcttataaattgtttttaacatgaccagtttgggccttaacaacaggtttgaataagggaattgcattttttagaagattcctcagtctgcagtgtggagaattggttggagcaatggaagattagaagtaatacagagttaaggggttttacagtaacatctgccagagatgctggtgatctgtaatgagagagtagctgtacggctggagagaagtaagtgaattcagagttactaaggaggtggaattaacaggactggatcattaattagatatgaaaaaaagagtccaggataatctaattctcagttatctggtttaagcaccaggatgcttgataatgccatttattgatttattgagcataggaatacagggagagaaagagcaagtttggagagaagagagtagaagacagtgttgtgcttttgggtcaggtgtctggggtgtcgtagacgtctgagtagacctgttaaacaggcttctggtcttggctagagatacagatttgggagagttgctagagagggccttaaaagtgacctagtctaacttcttagattttacatgtgaggaagttaaagatttaattgagagaatacattgttcatttttgcaggagacagaataagaattaggatgtgaatctagggctcctaatgagctagaatgtgttttctatgcatcagaggcctacttctcccaccaaacaatgagacgccaggcatggtggctcacacctgtaatcccagcactttgggaggccgaggcaggaggactgcttgagtcaaggggtttcaagaccagcctgggcaacacagtaggacctggtcttttcaaaaaataaaaaaaatagcaggcgtggtggcatacatctgtagtcccagctactcaggagactgaggcaggaggatcacttgagcctgggaggtcaaggctgcagtgagccatgatcacgccactgcactccatcctgtgacagaatgagactcttgtctcaaaaaattaaaaaacaaaacaatacaaaacaatgaggttctgttggtagggtaaaaatgatgatgagccaccaactgttagtgattttttctattgtagaaatatttgccaagcattaggaatacagtaaggacaaagcagatcttgtgcttaccctcctagacccctggtggagtccagtgggaaggcaggtattaaataaaattaatggcctggcacggtggctcacacctgtaatcccagcactttgggaggctgaggcgggtgaatcacctgaggtcaggagttggagaccggcctgaccaacatggagaaaccccatctctactaaaaatgcaaaattagctgggcgtggtggcacatgcctgtaattccagctactcaggaggctgaggcgggagaaacacttcaacctgggaggcggaggttgcagtgagccgagatcatgccattgcattctagcctgggcaacaagagcgaaactcagtctcaaaaataaaataaaataataaataaataaataaaattattgcaagggtgtatagtctgcttctagaactgacacacattcactgtgtgtgtgtggaatggaatggagagagcagtttggaagatggtaggagatgagttttgaagtattacctcttggatattctgaatgctaatgagagaaaaccctttagtggaaagcttagttaagggttgatagttgggagtaacacaccacctacttataagaggaccctaaactgatggttagaatgatagaaatgcattccctgctgttatctagctctttccaacagactgcaccatttccaggagtgttgggaaaggtgtttgttacaattgaaagtacaaacgtcagaggaagggatcaacaaaatataataaaaaagcagaaaattgaagaattgtgcatggtctgtgcattagctatctcttgcagcgtaacaaaacttagcagctgaaaacagcaaacatgtatcatctcgtggtttttgtgggtcagaatctgtgtgtggcttagcttggagcttctgacttaagtctcttatgaggttgcagtcaagggttggccagggctatagtcatctcaaggtttgatagaggttggataatctgcttccaaggtcacatggttcttggcaggcttcagaccctcgccacatggcccactccacagggctgccttacaccatgacagctggcttcctccagggctagcagtcaaagagagagagcactcaacctggaagtcatacttttttaatgacctaattttggaagtgatattccatcacttctgcatattcctttcattagaagcaggttactgggtccaacttgtacttatgggaggaggttgtaaaagggcacaaataccaagaggcaggaatcacgggggcccatcttaaaggatgccaggagaaagtcggtgcctcagattgtggcaaggaccccgtgagaatgtaatggcaattctattcacagttccttttttccctctgaacacctttcctgagattgcaggtggaacccaggatatatgatggtacagacagcccagttagatagttttctttttgtctagttttttttttttatgatttcagtcgtgctgttaaaatgcagtatctatgcagagagaaggtgaaaaagaaaagaattacaatcaatcaaacctttcaaattctgtcccaaaaaacagcattctccaagtctcagtaatgagttaggtattttttaagtaatgtgatattttatgtgaagaaaaattaagaaatcaaaactaagaaattaagagatttacctccagatgcatgggaatatttatgcagttacatacatattaacctagatgaatgaagactttttaaaagtttttagatataagcatataggctatattttaaaatacggtattttattactgattttataggactcagattagtggaagcttaggtgggagtttagggactcttggcttctcagttctttactgtgaaagtcaaactttccaatatttaatcgttttctaaatagtcaccttttgcttttctgtttactccttttgtttttactggatcacgatctctacaaagagtgactgttttgtcttcatttgtttaaaataatggtttctaggcatcactgatagggtgagaactacaattaagagttttttgttgtcttgtttttttaaacaaagttatatgcgcctgccgcttagtttgtaaaaggcacacaagtgaacatttggaaatgtagtcacacaaatgaaaagcaggtagaggttatatgcatgctatttagcaatgaaaataaataaaatcctaatacatggtgtaacatggatgaatcttgaaaaggtgctaagtgaaagaggacatatgtgtgaaatgtccagaataggcaaatctatatggacagcaagtagatgagttggctgcctagagctagggaggcagtagggggatggggtgacagctaaaggatgtgggatttctctttggggtaataaacgttccaaaatgtaacatggtgatggttgtacaacacagtatactgaagtaaagccactgaattatgtgttatgagaattatatctcagtaaagccgttaaaagaaaaaaaggctggacgtggtggctcacactgtaatcccaccactttgggaggcctaggcgggtggatcacctgaggtcaggagtttgagaccagcctggccaactggccaacacggtgaaaccccatctctactaaaactacaaaaactagccgggggtggtggcgcgtgcctgtaccattataggcatgagccaccctgcccggctactggagagactgaggcaggagaattgcttgaacccgggtggcagaggctgcagtgagccgatatcgcgccattgcactccagcctgggcgaagacgcaagactccatctcaaaaaaaagaaaaaaaaaaggggcttggtgatagttggtttgatgatatgaagaaacggtgtagttatttgtctccacaaaatttaaaaactactagtgtaatggaaattgatgtaacaattttctgtaaactataataaaatgccattaaatgtgtttctctgtgcgtttgttttgatctattgaaagttcagggttaacccctgggcttctaatgcttccgttcttatatgatttcattaattgcaaagagaatctctgatgttagtagcttttagagaattatggaatattaaagaaggggggcttttaaggaaaatttcactgtttggtttgctttggctattaggctctcccccttctcccacaaatatatatattttcaggagacggaatatatatatataatacttatatttattgttattattttgagttgcactcttgctgtattgctcatgctggagtgcaatggcgtgatctccgcccactgcaacctctgccttctgggttcaagcgattctcttgcctcagcctcccaagtagctgggattacaggcatgcaccaccatgcctggctaatttttggatttttagtagagatggggttttaccatattggccaggctggtctcagactcctgacctcatgattcgcctgcctcggcctcccagagtgctgggattacaggcgtgagccaccgcacatgcaccattatttttgttttgaatttaaatacatgcctttatatttgttagagaaacaaaatatgtttattttcagacatacgagaaaatcatatacttgtaagaaaatcatatactttcttataaggtcatgtaaattttgagaattctgatagttgatgaattcagtgtgcttggaatgaacagggaaaatatggtaaaatttagccattttgatattagcaaagtcagtgtacttccaatggataaacaatgaatttaatcggatttgaaaaatccaaaatatggtgcttgagttgtttgtggacctggataagtagttttaagaatttggctaggcacggtgactcacacttataatcccagcattttgggaggccaaagcaagggagtcgcttgagtccatgagttaaagaacagcctgggccgggcgcggtggctcacgcctgcaaggctctaatatcagttggaaccccgggagcgcgccaacagacagcacaaggcggtgtggagcatcacgctgttttaatgcgcgcctgggtgcagacgggctgaggcctaaaatggcgtcagcgccacatgaggacggggcaggggttttacagtctcctgtaaacaggaagtgtccctgtctgatgtaacggctacgtggtacctggatggcctctctgtctatcctcggtggtgggtgtcttccggccggggtgcgtgtcttccggccggggtaggtgtcttccggccggggtaggtgtcttccggccggggtaggtgtcttccggccggggtgcgtgtcttccggccggggtaggtgtcttccggccggggtaggtgtcttccggccggggtgcgtgtcttccagccggggtaggtgtcttccggccggggtgcgtgtcttccggccggccctcttcctgcttctgcttctcgctgacgcgcgctgctggtgcaagcggccttgcgccttgggactgggtctgaggagggaggagttattcatccccccaagctttcggccccggggagaatctttcattcctgtctatttggttatagaaaaagggaaaaggggcgactttctccataactacttcaggtgtgacatagggggtggcgtgggcacctcggaaaaaaagaaaaaattttggcgtattcttgagagacgggttggtatccatcgtgtcgttgtagcaggagcatcgtctggattgtctggcggttaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcatctatgttaagacagcaattggacatgttaaacttagcacagaccgcaccctcttctgttaataagtagtctagagccagcctgttttgataaattgctgggtgcgtttggttttgttgtcacacgagcatttccagggctgaggcggtttggttagtgattatctctagagcagcctgtagtctaattattctatttaggatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaagatgaatccaggttgaattgtgcgtaggaagctagtgctaaggtagccgtgagcaagcctgggttccccatatccaaaggaatccatcggggcagtccgtcgtcagctggtgttcctaggattgtcgcatagtgcacttaggcaggcgtatgtggcagaagagttagtggtgtttgtacagttccaggccttttttgacaagacacaattgaggtagctgaagttagagggagaccaggctccggggggtaaccttggccaccactcggctgtggaggcgttgactgttagggtttggtgacgggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtataaagggatggaagtaccacgggtgattttcgggggagttaaccccgggagcgcgccaacagacagcacaaggcagtgtggagcctcacgctgtttaaagagcgcctgggtgcagacgggctgaggcctgagatggcgtcagccccacgtgaggaccgggcaggggttttacagtctcctgtaaacaggaagtgtccctgtctgacgtcactgctacgtggtacccggatggcctctctctcgatcctcaggagtaatgtcttccggccagccctcttcctgcttcggctaccttggtgacacatgctgctggcgcaagtgtgctttgggactgggcctgagaagggaggagttattcatccccccaagctttcaggccccggggagaatctttcaacgcttacaatcccagcactttgggagacagaggtgggcggatcacgaggccaagagatcgcgaccatccagaccaacatggtgaaaccccatctctactgaaaatacaaaaattagccgggcatggtgtcacccgcctgtagtcccagctgctcgggaggctgaggcaggagaatcccttgaaccggggaggtgaacattgcagtgagccgagattgcaccactgcactccagcccggcaacagagcaagactccgtctcaaaaaacaaaacaacaagaaaacagaacaaaacaaaacaaaaaccagcctggaaaacatagagaacctgtctctacaaaaaaaacaaataaataaataataaataaataatttaaattagctgggcatggtggcatgtgcctgaggtcccattgactcaagaggctgaggtaggaggatcatcactagaccccatgagttcgagtttgtatgatcctgccactgtactgtagcctgggcaacagagaccctgtctttaacgtttttttaaaaaagaagaggtttaagaattagcatcacaaattgcatgcttgggcaaatgtcttacacagttttagtttttaataaaacgtgttaaagtgtaaaatgtctaatcaaacttctgagaggaaaagtagagaatccaaacattaatgcttattgacatgttctacataatttagatgctaaatcccagaaatatttatgtgtactgattgtgccttgattagaaagcctgaagcaggctctagacagtggtggagcttgcgggagtcacataaatgctgtgtgatcaacaggatttaagcccgtgggttacctgcttttacaacctaagcaccaagggatggggagccttggccgttagcagcctaagggagctcttgttcccacgcatttttcaaattccactggagtttcatgaggttcgttttaagactgccacctgaaatcaagtccagtggctgttcctgtcttcccgtccctgtattgacattaaaaccacttagtcaacactcaagtgcaagaatagtgtcgccatgttgtatgcctagtaaattctggatgtacgttgtacgtcaccttatttaaccttttgccattagtttacaagaagacgggttgagcgagtcaggttgcttactttaggttaacagggcagctggactccagcctaagctcttcagtgaagccctgcatcactccctctgcaggcagagggtgcaacccgggggtgtgggagggagcatggcacactcagcacgtggtaattatgtcataatcacataatacattcttttggcccgaggtcaggtcagaaggaagttgactaatttccagatttatttcagtcataatacccgtgtctagtgttgaggaaaaggaagggatgtttcctgtttgctgcttcggtatggttagccaatgactggaggtatttaaaaggtgagcactggccaggcacggcagctcacgcctttaatgccagcactttgagaggctgaggcaggcggatcacctgaggccatgagtttgagaccagcctggccaacatggcaaaaccccgtctctactaaaactacaaaaaattatatgggcatggtggtgggcgcctgtaatcccagctacttgggaggctgaagcaggagaattgcttgaacctgggaggcagaggctgcagtgagccgagatcatgccatggcactccagcctgggcaacaagaacggaactctgtctcaaagaaaaaaaagtgagcattgtccttcaccctcctttccattttcatggcattgatcagaaccttagaggatgaaacatgtcagaaaaagggagcagggcagagagattcttcacaggaaccacatcaagcgtgtgttaaaatttatttctgatctgccttccaaaattatgcccaagatatgcatcagcattaatgggtaaggcggtttgaggaattcggttatgcaatgactcaaagacccattaaatcacagaactgaagacatttttttctgtacataaatgtgccattttaaccatttcattctacagttcagtggcattaattacattcataatgttgtgcaaccatcatttatatctatttctaaaacttttatctccccaaacagaatctctgtgccattaaacaataactcccagccaggcgcagtggctcaggcctgtaatcccagcactttgggaggctgaggcgggtggatcatgaggtcaggagttcaagactggcctggtcaagatggtgaaaccccatctctactaaaaatacaaaaaattagccaggcatggtagcgagcacctgtaatcccagctacttgggaggctgaggcaaagaattgcttgaacccagaaggcagaggttgtagtgagctgagatcgtgccactgcactccagcctgggcaatggagcgagactccgtcgcaaaaacaaacaaacaaacaaaaaacctccccattcttttttatattttctgtcttttttattgatattctcattttttcctacattgtcttcctgatttcctttagttcttcatctatggtttcttttaagacagttgatttaaattctttgcccaggaaattcaatgtctcggcttcttccgggatgttttctgtctatgtatttctttcaccagaatgggccacactgtactgtttttttgatatgcttggtgatgtctttgtattgaaaaccggacattggtgtattatgatgtggtaactctggaaattagggtctcgcctttgttcagggttggctgttcttgattgctgaagccttagcttgtgtttcttttccagtctttcagattggctctgtgctcaggtactcctttaacacttagccaggtcatctataattctgccccagccttcacttctgcttgcactaagttgatgggtcttctctggccctttctaagcgtgcgtcgtgtcctgagctgtcgcgtgtagctttctgaattctacagtaccacaaacatttttgaatgctctgatttcccaaggaagcgatcttcctggcttttccccctggctttagattgtctagtttatgcctcaaccgtattttttttgcacccctccgcccgcttggccgtgggtttttgatcacctgacaatattttccagcaacacctgctgcttttctgctctgaacgtgttctgagttttgcaacagagaggcaagtgccttgtttcagtctttgggtagccccagacagattagaacaaacacagtgatttgcaagtaagatctgctctgctcccttcaaaagcaagtactggggtgccacactgggaatgagggctgctgttgagctggggaaaggggtgaggtaagggcaagtaaaaacacccaaagctttgctactcttttgacattgcctttctcttgattcggtggtcactgtcttgttcaggcatacctttgtttttcacagttctaagaaagttacatcttatagttctggatgttgtttttttttaaaatatttctgtgaaagcctcagagtttgaagctgcctgttctgtcattttgcttatgacactcaaggccttttcattttagggcttccagtagcaagaactgtgcccagagggatggaattagatcgaactgctctgaaagagtactactatttcatatttttatacaaaagcatattttagataaggatgtcattgatttagaaactcaaaccaattaatctttgggaagtaatattatctctgttttagagatggaaaaaaaccagcacagatattgaagtctcaagacactggttgagatagagttaaaataatagagctttaggaaaacagttacacatagaattaccatttaatccagccattaacttctaggtatatacccaaaagaatagaaagcaaggacccgagcagatacttgtacactaaggttcatagcagcattattcacagtagcaaaaaggtagaaacaatccagatgtccatcaactgatgaatggataaacaagatgtagtatatacatataatgaaatgttcagatttaaaaaggaatgctaatctgatacacgctacgtatggttggatggatgctacagcacagataaaccttgaggacagtatgctaagtaaaagaaaccagacacaaaaggacaaatattttatgattccacttatataagctatgtagaattggcaaattcacagagacagaaagtagaatagaggtttccagagctggagcaaaggggaatgaagaattagtattttatgagcactgagtttctctttgggaatgatgaaaagttttggaaatggatagtggtgatgattgaacaacattgtgaatgtatttttttgtttgtttgagacagggttttgcatttgttgcccagactagagtgcagtggcacaatcttggctcactgcaacctccacctcccaggttcaagtgactcttctgcctcagcctcccaagtagctgggattacaggtgcatgctaccacgccgagctaattttttgtacttttagtagagacggagtttcgccatgttgggcaggctggtctcgaactcctgacctcaggtgatccacctgcctcagcctcccaaagtgctgggattacaggcgtgagccaccgtggccagctgtggacgtgtttaatgccactgaattgtataccttaaaatgtttaaaatgttaaattttgtgttatgtttttttaaaaaaatagccccccaaaatcataacaggtcaggcgcagtggttcgatccaataatcctagcactttgggaggccaaggcgggcagattgcttaagcccaggaattcgagaccagtctgagcaacatggtgaaaccccatctctaaaaaaatacatacaaaaattagccagggggtgtgcacttgttgtcccagctacttcagaggctgcagtgggaggatcacttgaactggggaggtcgaggctgcagtgagccatgattgtaccactgcactccagcctgggtgacagagtgagaccctgtctcaaaaaatatatatataacactccaaactcagtgttagggacatacaaagcttaactaattgaaatttgctgagttttaaaacatagttctcgagcatttattatttactatatgccagccactgtggtacatgctttatgtggattatctcatttactccttgtcacaatcttatcaagcataatacaattagctccaatttatagatgtgggatctgaagcacagagagattaagtaacgtgcccgatgtcattgctgaaaagtgtatcactgagataaagtacatcccaggacttcatcccaggtagtctgacttcagactttgtgtctaatggttaagctatactatctcacttttgctgaactttaaaagtgtgcttaaagcaatacatgactttccacaatttgccgcagaacaattattgcacattcctttcctcagggtgtgttggtggctatgattcctgcctgccagcctcagcaagacaaaacacaatcagagaaaaggtggatggttcactcttaagggaagtagtggatttgggtttgtttcagtaatcgtctctgaataatggcataaccttctctcagatttttaatttgatctagtttcattgcagtgaaaggaagctttaacacttggatcaaagaaagtatttgtataaaagcagcgaatgtagttttgaatgatagggtacttgtactctgaatagtagtatacaatatttgaactgtatgaggcctttttttattctttctttctctctctctctctcctcctctctacctctcctcctctctccctctctccctcttcccgtctccctcttctgagtctagctttgtcttccaggctggagtgcagtagcctgatctcggctccctgcaacctccacctcccaggttcgagtgattctcctgcctcagcctcccgagtagctggaactacaggtgcacaccaccatgcccagctaattttttgtatttttagtatagataggtttcaccatgttggccaggctggtctcgaactcctgacctcaggtgatccacctgccttggcctcccaaagtgctgagcttacaggcatgagccactgcacttggcctgtgtgaggtctttaaataacccttccctatcctcaaaaatgcccatcagcttagtttatgcatcagtaacactacaggttgaacatcccttatccaaaatgcttgagattggaagtgtttcatatttcaggtttttttttgattatggaatattcgcatatatatagtgagatatcttgaggatgggacccaagtctaaacacagcttttttatgtttcctatacccaccctgtgtatagagactgaaggtaattttatacaatattttaaaataattttatacatgaaataaaactttgactgtaacctctcacatgaagttaggtatagaattttctccctgtggcatcttgtcagcactaaaaaagtttcaggttttggagcatgtcggatttcagatttacagatcagagatgcttaacctgtatcatcgtatatataataattgccactctttacctaggccttggtgttttctgtgtgacatctttccagtccccattttgactgcaataaatttttttttttttttttggagacagtctcgctctctacaacctccacttcctgggttcaagtgattctcctgcctcagcctcctgagtagctgggattataggcatgcgccgccacgcccagctaatttttgtatttttagttgggacggggtttcaccatgttggtcacactggtcttgaactcttgacctcgtgatctgcccacctcagcctcccaaagtgctgagattacagatgtgagccaccatgcccggctgactgcaataattttttattctcttaattacttactaactagagtaccagctgtgagattttgctcttaaacatccagtcacatcattttcccaatcatgcaaagaaatggtaatatccttagtgatattcacagagcattgtgaatatctgccgatcaatgctagactattaaaaggaacgtgaatgtcagggtacattcctagtgttttaaggtaaaagtcattaaaggatactactatattgtttcacaaaatgcctcttgaccattatcagagatagattctaagctaaacggagcagttatatgttagaactgacacagaattcaggcggtgtgatcaattgaataaaatttctcaatcaaggtaatttccccagtctttggcccatggttattacaaaaaaaaaatttttttttctttgagacggagtctcgctctgtcacccaggctggagcgcagtggcgcgatctcggctcactgcaacctccgcctcccgggttcacgccattctcctgcctcagcctcccgcgtagctgggactacaggcgcgtgccaccaggcccggctaattttttgtatttttagtagagtcggggtttcaccgtgttagccaggatggtctcgatctcctgacctcgtgatccgcctgcctcggcctcccaaagtgctgggattacaggcgtgagccactgtgcccggccacaaataatttttaaaaagaaataatacctcttcacagctactcaggagactgaggcaggaggatcatttgagtccatgagttcaaatccagcctgggtaacataatgaaaccccatctctgggccgggcacggtggctcacgcctgtaatcccagcactttgggaggccgaggcaggtgaatcacctgaggtcgggagttcaagaccagcctgaccaacatggagaaaccccgtctctactaaaaatacaaaattagcctggcatggtgatgcatacctgtaatcccagctactcgggaggctgaggcaggagaatagcttgaacccaggaggtggaggttgcggtgagccgagattgtgcaattgcactccagcctgggcaaaaagagcagaaactccatctcaaaaaaaaaaagaaaccacatctctgaaacccttagtagttacatgtaaactgtcatctccattttagagcttaatgaagttgacaggtcttaaattaggtcttatgaatgtgcctgttactgtctttaaatacttataaatagcatcaccaagttatttaatgggtagtttttaactataggtcacttggctttcacggatgacaacgataaatagaactttttgttcttgtctagctatatggattcatatgtggcagcagaaagcttcatttatattgagtgagattttgtagggaattacatggggcggtatgttttgatttggtttttctccttaactataaatatatcttgaaaactttttgtgtatcagaaggaattttaggtcagacatggtggctggcgcctgtactcccagcattttgggaggccaagatgggaggaccagttgaggccagaagttgaagacaagcctgggcaacatagcaagacaccacccccactgcccccccagaaaatttaaaaatcatccgggcttggtggtgtgtgcctgtggttccagctactcgggacactgaggtgggagggtcgcttgagcctgggaggttgaggcttcagtgagtcatgattgggccactgcactccagcctgagcaacagaatgagacttatttttttcttttttcttttttgagttggagtctcactctgttgccaggctggagtgcagtggcccagtcttggctccctgcaaccttcgcctcccgggttcaagcagttctcctgcctcagcctcccgagtagctgggactacatacatacgccaccacgcccggctaatttttgtatttttagtagacacggggttttacaatgttggccaggatggtctcaatctcttgacctcatgatccgcccaccttggcctcccaaagtgctgggattacaggggtaagccactgcgcccggccaatacttttttttttcaagcaaaactttgtaagactcatgtgacatcaaacgtaataataaaaattttttgaaattcacacggaaaaatactaaaatttccgtgttacatcatgaatgctttaatattactttaaaatcttagtatattataaagacacacaattcacaattgtcaactcacagcacatcagtctaagtactcctgattatgctaatgtttattttctttattattgcttttactaaaaataagctcttagcatattatcccttactaaaaagaaatgaactgtcaagcattaaaagacatagaggaaaatttaatgcatgttactaagtgaaagaaggcaatctgaaaaggctacatattgtatgataaaatgtgaaaaaatatatacaagctcaatgatgttcaaacctacagtattggtgaataataacctaagcaatttaatactccagcttagttcttataactcctattattcactatgacatgagtcatataaactttattagctttaactacactttcctctgaatgtttgtcctcaaataagattggacttgtctcagaactgctttaccactcttgtgacctttttcagttaagtgacaataaagctgtttttcaggctgagacttaggggcactcctgcttttggcatgcactgtctcatttaatcctcacactaatattataaggtagatgcaacagcccccatgttacagaggaaaaaatagaggatcaaagagattaacttgccaaaagtatggctaataagtaggtgaagcatgctgagaacttagggctgccttaatatccatgtcattcttccaactctttggcaacagttttctaatatgagttctttaccccattaatgctgtgaaactaagaacaccatattttaagtggcttaaaattccaagcaaccagaatatggctagtgttactttcctattttatatgtgcctaaagtaaagtacatccttggtcatttcataacatgtataacaattgctatgattatttgagccacgatagaattctattctaagagcttggcagagctagaagaacaacctgctctttggtagggagtattgcagcacgcttcttgcaaggacattcagttttcttgcctgaaaagcaaacacaccactatttgtgtagtcaccagtctaggcaagggaggaacaatggttttaaaaatacacccagaaaggaactagaagatacttgtattaggtgggtaaccttaccttccattatcgtaaatagttgctcaagcttcttcacagtaatggtctgcatttcttatgtagcaaaacctctggagattttgaatgtttttgatggtcagaactagagaacttctctatccaatctcttcgttttaggtaaggaaactatataggtcagcaagtaaaaagtctaatcgaaggtctcttggaaaaatcatagcagaactgaagtctcttgctcctttcccagtgctctctgattttatattactctgtccccacaaggaatgttatctcaaggtaagatggttttgtatagtaatggttatctctgaagctcatgttgtttaaggcctgacagataatccttttgtagtatgagtcttgtagttttgctaacgtcttcagtgatttagtgtgacccctctgagcctagatcatattttccttcccctccctacactcaatgattaaagtacgatattctttctaattgcccattagccccctgctgctcttggaatccttagacttctgtgggcttttggaacttctgctgttaggtttcatgaataatagtcccctttctgttgagtttctctggttacatcattttatttaccaatgtattgctttttaatatcagtaacattgaatattaaagtaggtgataaaatggatcaagcaggaaacttgaccattacaaatcgatgctaactaaataaccgagataaccacgatgcaggttgccgattatccaggacccttttttgatctcctttggaaagggagtcatcaattctgtcctttttccttaactttgaaagtccatccttctttggcaatagtcttcaagggttttatttagctcccttttactaaaaacaagcatcacaaaatctcatctgttttttacaaagaagcctggagtaataccctgataactataggggaataatgtcatcaacagaagaatagaatttgggaagctgaccttatcacagtctatgagattaaatgtcttgggcatagtagtgtagctagagaaaagggaaaaaaaaaaaacactaattctcttagtttctttgtagttctccgtggaaaactcctttacccacattggtacccttttggttttgctgctatggtggttagaaaattagaaagcagaagaatcacctcctgtttttagaaataccctaaaaaatggcaggccatcactgggccttgtacttctaatggccaaaatgtatagcaacataaagtgtctagaagagaattctctaaaatacaagtaatcactgtaggtgattttttaaagaagcacagcacgtggaattgtagtgttgaagacaccatgctgggtatcactggaataacccctgtgctgccagcgttgatgtgaaatagaagatgacatcttaaaccaattactgtactgcaacctagcgtcatacgaggccatataccaggttcagaggaaagtaacttgacttcaagctcatgttatagggaaagatgtggattttattagagtagaacataaataggcttaaacaggaggaaaatattctagccgttaggatctgtaattgctcagaaaggcaggaagtattttactttgggagatgaagaatggaccagtctggccagggcagtgggtttcacattcaaatccaaagatatgaactacagggcagtagaaggcagggctctgggcacactctacagggaggacggcttcagtcatggtgcatacacacgatgggctctgggcacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcatcgtggtgcatacacacgatgggctctgggaacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcagtcgtgcatacacacgatgggctctgggaacactctacagggaggacggcttcagtcgtgcatacacacgatgggctctgggaacactacagggaggacggcttcagtcgtggtgcatacacacgatgggctctgggaacactacagggaggacagcttcagtcatgcatacacacgatgggctctgggcacactctacagggaagacggcttcagtcgtgcatacacacgacgggctctgggcacactctacagggaggatggcttcagtcatgcgtacacactatgggctctgggcactacagggaggatggcttcagtcgtgcatacacacggtattactgaagaagttcctttctgaggcagtctagctaaaggtatgcacataggcagatagtctattaaatttgaacatgaatattaaaactgacactgagatttcagtgaagggtgaagttataatttataacagtgtttaaaatttggtgtatttcagtagctgttagttaagcatttatttattagtgatttttgagaagtttgtgttacttctttttattaggaaaaacatttgactagccattagctctggcatctgaattcctgctactctcctagcatctagaagtatttctgatgttatcagacagagtttaatcagaaagactcaacttctttagtggtttcatatgataaacacatttaccttcctgttcaggtctgttttagtttgggcaagccagggcatcaaactatatgtaattgttttaatgtgttacaccatcatgggaattgatcctaacataggcattttctttacttcttaaaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgaagttgagcagttggattcaagagcacttcccctttgccttcatcaggtactctggtaaacccttcactttcagcctcacgaaaattcccctagcagtgtttggaatgatctaaaatgctgtcttggctgggcgcagtggctcatgcctgtaatcccagcattttgggaggctgaggtgggtggatggcttgagctcaggagttcaagaccagcctgggcaacatggcgaaaccccatctctacaaaatatacaaaaattagccgggcatggtggtgcacacctgtagtcccagctacttgggaggccaaggtgggacgatcactcaagcctgggaggcaaaggttgcattgagctgacattgcaccactgcactccagcctgggagacagagtgagagaacctgtctctaaatacataaataaatataaaaataaaaaataaaatgcaatctctgtaaaattgactgtgtcccactcatcactggtgagcccgggggagggtgaccctcgtgggatatttggcatattactaattgatggccacatcttggccttggctaatccatagtttaaacaatggttcactttttaaatcagtgataaagctgtgtaagagtttgataagcatctaccaggcaccaaagaccctgctggacatgggtaaacagagattacttggcagaatatgcccgtaagagagcccctgcagaacaggagcaacggttctatcgataagtaagtgtggaattttgtgttcagtgttagagtaaacatatgttaaagattcagcagcacaaaatgagtgattcattctgccctgtggacacttgggaacagaaggcgactcttgagctgggttttccaggcttattaggcgctcagtgggttaacagaatgagctggtccaggaagagatcagcctgtgaaagccgtggctgggatattattggagatgaagatgttaaaagaggaggtgagattgaatagctggtgacattgagactttatttttagggactgggaatttttaattctaagagtgcctgaatcacatttgcattttagaagaagaactcttttgaggattgagagggtgtagatgttagaggatggagaggctggagactggggagcctttaggccggtggtgaggaaacttttttttttacataagagctaattcagaagaaattaagatatttgagctgcatcttattttttattgtattgtattgtatttatttatttatttagagacagagtctcactctgttgcccaggctggagtgcagcggcatgatctcagctcactgtaatctccacctcccagattcaagccattctcctgccttagcctcctgagtagctggaattacaggcacacaccaccacgcctggctaatttttgtattttagtagagatggggtttcaccatgttggccaggctggtttcaaactcctgacctcaagtgatccacccgcctcggccttccaaagtgctaggattaacaggcgcgagccgctgcacccagcctgcattttatttttacataaaatgaaattaactggtacatgggaatggagaaagtgatttacttttgtaatgagaagtgaataatttttaatttttaacccatttagaaaaaaaaatagtgcagctggctgcaagtgcccagctttacataaacatgctctttgaggctgaagcaaatttgactaattgtcaatgtgaaaataaaatagaaaaactgttcttggagttatttctaaacagaatttgtctctaatcctaatgtaacaaaaacggatatgatgttacattaggatcagagacaagagtattctcagggcaaacagaaaatgggataaaaagtaaagtaggcagggcacagtggctcatacctataatcccagcactttgggaggccgaggtgggtggatcatgtgaggtcagaagttcaagaccagcctggccaacacagtgaaacctcatctcttctaaaaatatacacacacaaaaaaattaaccaggcatggtggcacgcgcctgtagtcccagctactcgagaggctgaggcagaagaattgcttgaacccaggaggcggaggttgcagtgggcggagatcgcaccactgcactccagcctgggtgacagagtgagactctgtctcaaaaaaaaagggaaaatagggccaggcgcggtagctcatacctgtaatgcagcactctgggaggtcgaggcaggcagattgcttgagcccaggagttcaagtctagcctaggcaacatcatgaaaccttgtctctacaaaaaaaaaaaaaatgtagccaggcacggtggcgtgcgcctgtaatcccagctactcaggacgctaaggtgggaggattgcatgagcccaggagtttgaggctgcaatgagccgtgattccatcactgcactccagcctgggtaacagaggaagaccccatctaaaaatagacaaacaaaaagttcaataggttttgtcccaattcaggaaaatgtatacttttacaaatttgtattatctcctttacgaacttgaagaatgcctttgaggaaatgtatactcctggcctctaagctgtcacgaactcaccattgttgagtagcaccaacatcaaggcagctttctaatcactcagctttcactgcatttgaacagtggattgcacggcaatcttttctctcctgggaaagaaggttagagaatacggtggtggtttaaaagtatgggctttggccctaccacaagctaagtggcttttggtttctcctgttgtaaagtaatagaggattaaatgggataatgcatgtaaaagcacttaacatatgtttgacgtacagtaaaagccaaagaaatattaaacatttaaactctattcctactgtcactaattcagagattgctcattggaaatcaagtctggggatcagcaaagaaatactgatgccattagaaagctgagacgtcagggtgacaagattcggttgatggctgcctcctcagcccaagaagacagaatatcctgtcacctcccaagggacacacaaatcagggagggatggagatatattttattcattttagtaattcccagcacatcacatggtatatttcacctagatttgccagttgttgacatttttatcaaatttttgctctgttttttagctggggctataggcatgtgccactgcgcccagctaatttttgtatttttagtagagatggggtttcaccatgttgcccgggctggtctttaactcctgatctcaggtgatccacccgccttgacctcccaaagtgctgggattacaggcgtgagccaccacgcctggcctttttgctcttgctctctctcgtgcacacacacgtattttttccattgaaacagttgaaagtaatttgcattatgacacttcacccctaaatatttgtacataaatctcccaagaagaaggatactctcctacataacatacaaggccattatcaaccccaagaaatgagtcactgatgcaataaaattatttaatatacaatccatattcaaatttcccccaagtagttccacaaatgttctgtgcaactgttttcccccagtgcaggattcagtgcaggatggcatattgcattcaactgtcagtattctttagtctcctgtaatccagaatgctcccagcctttctatctgtatcagtctttctccgcccctttctttctttcacactgacatttatgaacagtctaagaattcatgtagaatgtcccataatcaggatttgtctaattatttctttctttttttttttttttttttttttttgagatggggtcttgctctgtcacccaggctggagtgcagtggcgtgatcttggcccactgtaacctccacctcccgggttcaagcaattctcctgcctcagcctcctgagtagctgggactacaggcccgtgccaccacgcccagctaatttttgtatttttagtagagacaaggtttcaccatgttggccaggagggtctcgatctcttgacctcacgatccgcccgcctcggcctcccaaagtgctgggattacaggtgtgagccactgcgcccggcctaattatttctttaagatttgattcaggttaaacattctgggcaagaatttacttaggtaacattccatacccaattctctcttgaactgattctaatctggtttttgttcccaccactcccccaaaattgcactgtaaaagtcaccagtgatttccatgttgttaaatccggtggtcagacctcagttttcatctcactggagctattggaaacgtcaagttgatcacatactctgttttgaagcgttttgtttatttgcctttgggagctcttttcttggcttttacctcttacatcacttggccatgccttctccggctcattttctgagttcccatattttccttttttttttttcccactctgtcaccaggctggagtgcagtggcatcatcacggctcactgcagcctccacctcacgggttcaagtagtcttcctgcctcagcttctcaagtggctgggactgcaggcgcatgccaccgtgcccagctaatttttttatttttttgtagagacggggtttcaccatgttgcccaggctggtctcgaattcctggcctcaagtgatcttcccaccttggtgtcccaaagtgttgggatttcaggcatgagccactgcacccagccctaatttttaaacactgggatgcgtcagagttcagttcttgaatctcttctcattctgaattcacttcctggtgttttcatccaatcctgtaggtttgtccttttttttttttttttttttttttgagacggagtctcactgtgtcgcccaggctggagtgcagtggcacaatcttggctcactacaacctccgcttcccgagttcaggtgatctcctgtctcagctccacaagtagctgggattacaggcacgtgccaccacacctggctaatttttaaatttttagcagagacggggtttcatcatgttggccaggctggtctcaaactcctgacctcaggtggtccgcccgcctcagcctcccaaagtgctgggattacaggtgtgagccactgtgcccggcctgtcctatttcttttctgaactccagacttaactatccagcaactcaagatgtctcatgggcatttcaaacttaagatgtacaaactcaaactttgattttctcccgtatctgctgctttcctagtcttacctctcttgttaaatgccaacttcgtccctctagttgctgagaccaaatgccttgaagtgatactttatttacttttccctgcatccaaatccaatccaacagcaagtcctgcagatctacttcaaaatatacccagaacttcttacctctttcactgctaccatttccgtacaggataccatcaaatctcacccagattcttgcaataaatttctcactatagagacttttctgccttcactctcccttccacttagtgctttctctctacatgaccgtcactgtgatgcagataaaacataagtcagatcttgtcactccactgtgcaaagccctccgatggcttcccttctcatttagaataaaagccaaaatccttaccgtggcctacaaggccctacatgatcttgtcctgttagcctcctggatcttcattgctaaaattctccttaactcactcctttccaggttcactggccttctgacagcttctcagatataccaaggatgttcccacttcaggtcctctggtatctcctatctactccttctcaggaagccactaggtgatgtgctccagcaaaacaagggagtaaaccaagaaacaggaaggtgtgagatacaggaaactgggaatcctactcaggacagaggtgaagggaatctaagcaaagggagattttaagatgacagctgtatgccaggaaggagagggtaaccagtcctgtttcgagtggatcacaagagtctggggagaggcttttctatcattttcctgtttgtagaagtatttgactccttaaagcatagacatgtaaaatttggatgaaaataagaactaaaagaagacataattcaggcataaggtaatgaaagcatctaggctaaagtggtgacagtggaaatggagagggatggatgtgagatctttggaaggaagaataactaggacttggtatagattgttgtattagtcagggttctcttagagggacagaactcataggatatttatatatatcctatatatatttatatatataaaggggagtttattaagtattaactcgcatgatcacaaagtcccacaataggctgtctgcaagctgaggagcaaggagagccgagctaagtcccaaaactgaagaatttggagtctgatggtcgagggcaggaaacatccagcacgcgagaaagatgtgggctgggaggctaggcctgtctctctttttcatgtttttctgcctgctttatattccctggcagctgattagatggtgtccaccagtttaaaagggggtctgccttccccagcccactgactcaaatgttgatctcttttggcaacaccctcacagacacacccaggatcaatactttgtatccttcaatccaatcacgttgacactcagtattaaccatcacaattgtaaaaagagaataaaggagaaatcagagatgactgtaggaccattaacagaaataaggtattcgagtgtgagaactaattttaggaaaattgtgatttaaaaagtgatatataatatatagaataatatgtgctaaaggccaatggaaatacgacaacatatacttgtattttgagctcgtggaactcttaaaagttctgttttaaagttcttgttcttaggtatgagtggtcttttttacactgacttagttaatatgactacagattagctttaaatgtttaactgaagtcatatgcttggcaggtttcatatagaaaatcgggccctcccttgggcctcttttgtaagggcactaatcccattcatgagggcagagcccccgtgacctaatcacctcccagatacccccttcttcacactatcccctgggaactcggtttcaacatatgaatttgtgagggggacacaaagattgaggccatggcccttcacagtgtctttttttagagcgttcctgattggtaaaaggataaccaggatcaccttacacctgttgccttcccagcagttttcacctttttcacatgattccactcagcatcttgcaattcattccaaatcagactcaaaaaccattttaagcacttactgtagtgtgctgggcattatgctagatacatagtctctctgttttttttatttgtatttatttatttattttcatttgcttcctgtacctgggcagcaaacacaatctctctttcaatccttatggcagccttgttttatacagctgcaggtattactgtccctgttttaagataagaaagttgaggcttgagatgcgaaatgacgtgtccagggccacacagctggtaagtggcagggcttggactaaaacacaggccattcacctccaaccccatgttctttctgctctactgggctagctttcagatttagaaatatgctttaaaaaaaagtcacatcttctcttcctgctagacttgcaagggggagatttttaaaggggaaatactttgtatatttatttctcaagatgactttttacctggaaattttacttttgaggcactgggtttcataaccttctctgcatagttactttatggtattagaactgctacagaagcctgcaagctaatttctgcagtgccaggaaatctggtgacataatagttatggaccccatcaaaactcctcaaataagagctatttataagtaaccatgtgccaattttgcacaaatgcaaaaaggcaggaaaaatggctttgaagagccagacattttattttaatgggcaacctgaaactatatctcataccatatatagaaaggaaactgtgcaataccatagatgttttcactggaagtttgtacttgaaatttttttttctttgtttttttgagacagagtttcacactgtcacccaggctggaatgcagtggcgcaatttcggctcactgcaacctctacctcccaggttcaagtgattcttctgcctcagcctcccaagtagctgggaatacaggtgcacaccaccacacccagctaatttttgtgtttttagtagagacagtatttcgccatgttggccaagctggtgtcgaactcctgaactcaaattatctgcctgcttcggtctctcaaagtgctgggattataagcatgagctgccatgcccggctctgcagttgaaatgtcatcattgatttcaattaggtgtaaccccctcatatgctggaacctgctagtactgacatatgagaaccatgtttactgacgtccatcacattggtagcttgacatcggccatggtgggagtattgacaccactgaaatgagcaaacactgcaagttggggctctccccaacactctggagacgactgttaaatattagcacactgctggttacaccattatatgaaattctcattttgtaagctaaagaaatggttgaagattggcagtttgacttggttcatactacttttaaaacatattattagaacaataagctggtaaaagataaccagattcttaaaaatcagtttgtcccttgcaaaatctttaatataacataaatatggaatcaaactttatattaactgaaaactaatcatttatagagatgactgagtcagtcatctacatggctcatggaaaaaatgtcacatttgtaggatttaaactaggcaagtattttcctttaaaagtatgctgtttcccctgagggatttgggaaaatccattcctttttattgctagcttataggtttgacaagtactttaattactctttgcatcgtcaatttacctggaaaacggagatagtgatgtataaaggttatacctttttttactagagacaatctgtggaaaccattttttgttttggtttgttttggtttttttttgagacagagttttgctcttgttgcccaggctggagtgcaatggcatgatctcggctcactgcaacctccacctcccaggttcaagcgattcttctgcctcagcctccagagtaactgggattacaggcatgagacaccatgcctggctaatttttgtatttttagtagagatggggtttcaccgtgttggtcaggctggtcttgaacccttgacctcagatgatccacccacctcagcctcccaaagcgctgggattacaggcgtgagccaccatgcccggctggaaactgttttaagaatacagagtttatgcaatatttcagtgaatatttttagttttagtgatctgttcataaatgtcatatctaaataaagatctaaaaatatcccaaagtttttagaatcaaagaatctttaaatgtaaagatgtcttagaatgaatctgataactgacaagcctgaactgagaccagctcctgagtcttggatctctttatctagtgttctttaccatatgtagcactttgtacatattctaaacaatattaatcaactgttagtgctcagcctggccttttcttaactatcagaccagaccaaaaagtcagtgtcctgtgaggtcctcagccggtggtttgtgaaacaggaatgaaatcaataggatgttgaggtctcaggtgacttgacatatttctgctttttctttttattaattatttatttatgtttgcttcacagcatttgaaaggaatatttctacttttaatttacaataaacaatcattttttcatttgtgttctatttttgtaagtctctaacatttttctcattctttagagtcctaaactctaatgaatcagggaaatctactttgacttgaggtagagtaggaagaatgatgtgtaaacaccaaagaacgtctctgctttgcttgagatgagtaacttcagaattgcatcctgtgcctacagtcagatttcttctgaactgttgaatgtagtttaaaaaaagagttttcttaatttgatatcaaaaacatttggaatttcaagatcttaatttgtttcaaatttatcttctcatccaagtgttaatttaattttctctgtgttttctttgtttttaacagatagcagaatcctatttccaggaggaggactgtatccttttcttaattacaggaagaaatttttagaactcttacagaaccattcattttttttaattgaagtatattttacatgtaatagaatgtacagatcatatggtttcagtggttttgacagttgtatgtacccgtgtaaccacctcagaaagcaaaatgtaggaaatttctgtctcttcacaaaatttcctagaaccatccaaagtttaccttcataaataggccttaattttactaaaataagtatttgtatttattttttgaaggaaaatttgtattattttaattatttttatgtacagaacactcaacagtgtacatttaacccagtttagcggcatgttctttagcctttgcctttttgagcttggcaacgtgcgccacagacttgggacccgggacattgccgcccccgtgatggtgaatctcgtcgtatctgtcgttgtaattggtcctggactagacagcccagtcttgccttccccttggataatgcagtaagggacccccattttacgacatagggcaggcaagaagacagccagctggaagaaggcattagtggaagagtgtattttgaccaaaagcagtaaatctcaaagctagcttggtagcaagcgagagagagagaacttctgagtgatcatgaagacaaaaagctgaacagtgagtttttctcttccttttttctgggtcagcatttagagcattgcccagaggaaggtaggcagttggacagtgtatcctgacctcacaagatgcagatctgtgtgatacaaatgagaaggctaaagctcacaggatcatttacaaagaagtagaatcacgtgataataatggaaatcactgtggcaagttaattgagtgtttacaaaagacccatataagtttttgccctgtcattgtttaggcatgtgatcctttggtcttgtgggagaaaagcattcagtgggaaataataaggatcaaggtgacttgaaacagaaacacttgaccagagagtcacatagttctttgacagaaagtaaggagagaaataaaaaagggaaacatgtagattccaggattccatgtggtcctgtttccttaaattacttttagttgactccgcagcagacattccttgagcattaaaaccttcttttagtttctgtttgccgatagtgtggaatccaagtagctattgcataatatgccacattaaaatttacctacttcaaaaccaagaaacattactaggctgggcgcagtggctcacacctgtaatcccagcaatttgggaggctgaggcaggcagatcgcttgaggtcaggagttcaaaaccagcctggccaacgtggtgaaaccccatcttgacaaaaatacaaaaaggagccgggcatgatggtgcatgcctgtaatcccagctactctggaggctgaggcaggagaatcacttgaatccaggagggggaggttgcaataagccaaggtggcaccactgcactccagcctcggtgacagagggagactgtgtctcaaaaaaaaaaaaagctggacgcagtgattcatgcctgtaatcccagcactttgggaggccgaggcaggcagatcacgaggtgaggagttcgagacgagcctggctcacatggtgaaaccccgtctctactaaaaatacaaaaaaatcagccaggcgcagtggtaggcgcctgtagtctcagctacctgggaggctgaggcaggagaatcgcttgaacccgggaggtggaggttgtagtgagctgagattgccccactgcactccagcctggactacagagcaagattccatctcaaggaaaaaaaaaaaaaaagagagaaacattactttagatatgtttaaatttaaaaatatttagagtcctctcatgttttagtaagctgcaaatttctcaacatctataggacattgttcttcaaatatgggaataatgtaaatagtgtggatttctattttccttaaatgttctattcagatgagaaagcaatgaaattcattcagctagaacgattgtatcatgagcaattgctcgcaaatctttctgccattcaagaacagtggggtaagtacagaccaacatggaatgtggaattagcagtaatccaacaagtcactatctacaaaattaacatatttgacctggttttataaatcagaaaatagatgtttccataaacaagttaatgttgcaaagaaagtagcatttttaccacaagtctattatattgtgagaagacttttttctttgtattttgctcttcatatcaatgccaagaaaagaatacttgcaactatttgcatttttcctaatcacatttcatgccctactggctaatttagtctctaggatgatatttacttatattgaaaagtaataagttagttatttctaactgttgggttgtttgaaaagataattttgcatgcaaatctttatgagtggtgctagttaactgtttgtttgtttttttgctcctaaatatgttttataagagccagtgactaacaaatactttaaatttagaaacaaaatggaaaactgtgcaaccacatacagttacggctctaaggaattcagaaaagggatttaatggtgaagattttgaacggcttacgaaaatttgtgcaacacatcaagagtaagtatatcagaatttcgttagaatgagttggagtagaatattgaagaagcattatagcattgagtatccatttctttgttttatgttttcaactggagaaattaagatggatataatataattattgcaaggctctagtattggttcgaaccccgggagcgcgccaacagacagcacaaggcggtgtggagcatcacgctgttttaatgagcacctgggtgcagacgggctgaggcctaaaatggcgtcagcgccacgtgaggacggggcaggggttttacagtctcctgtaaacaggaagtgtccctgtctgatgtaacggctacgtggtacctggatggcctctctgtctatcctcggtggtgcgtgtcttccggccggggtgcgtgtcttccggccggccctcttcctgcttctgcttctcgctgacgcgcgctgctggtgcaagtggcctcgcgccttgggactgggtctgaggagggaggagttattcatccccccaagctttcggccctggggagaatctttcattcctatttggttatagaaaaagggaaaaggggcaactttctccataactacttcaggtgtgacatagagggtggcgtgggcacctcggaaaaaaagaaaaaattttggcgtattcttgagagtcgggttggtatccatcgtgtcgttgtagcaggagcatcgtctggattgtctggcgattaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcgtctatgttaagacagcaattggagatgttaaacttaccacagaccgcaccctcttctgctaataagtagtctagagccagcctgttttgataaattgctgggtgcatttggttttgttgtcacgcgagcatttccagcgctggggcggtttggttagtgattatctctagagcagcctttagtctaattattctatttagcatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaaaacgaatccaggttgaattgtgcataggaagctagtgctaaggtagccgtgagtaagcctgggttccccatatccaaaggaatccatcggggcagtccatcgtcagctggtgttcctaggattgtcgcatagtgcacttaggcaggggtatgcggcagaagagttagtggtgtttgtacagttccaggccttttttgacaagacacaattgaggtagctgaagttagagggagaccaggctccagggggtaaccttggccaccactcggctgtggaggcgttgactgttagggtttggtgacaggggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtgtaaagggatggaaataccacgggtgattttcaggggtagttgttggttttgagacttttgctttggctataatccattctctctttctgtcttcgagcacttgagcgtttgctccccattgtccaattttggtgaagcaaagccactgtttcccttttggacatgtagccccattatgactgccagatactcctagattttttactttataataactctttcctgattcaacacattcctcgactaaggttccacaataggatctttctatatgactatggtgagtgaaggactgttgacatgagtatggtgagtgaaggattgttgcatctttcctctgtggtggaaagactgataacactcacagcagctctgaagggctgctgtgggcagcagggcggctactgaccgtataaggatcgtggtgagggatattcccgtattaagacttttggttggaagtgaggcacagcatcggattgggtagatacaggccatctctggaagcaggtgtttagtcttcctcgtgttttggttttaagaaaaagaaaattttttggttaatttcagcttggtagaagaaactggcctggacaaccacttatctgttaatgttttggaggaagaagtagcctttggggtgagcttgaccctggtacgatggacccagttggggagtccttggactctcatgctgttagtgtgcatgctgagtatcacagcgtaggggcctgtccactttggttgtagctttttgtgaggatcaggttggccaataaacacgtctgtgcctgcaagacagttatgttgagaggacaaggaggtgtcggcagggagaggcatggcctcattcgctgcttcacaaatgaaagaccatgtctggattaaggagggtaagtaattcccgagtggctcagagtctggtgatggcggaggccctaagacaaaagttcgtccatacatgattccaaagggactataaaaagagggtgcttttggtgttgcacggagtctcatgagggtgtaagggagatttctcatccacgactggtgggtttctagagccagcttggtgagttgagctttaaggacagagttgatgttttcaagtttgcctgaagattgaggcctgtaaggtgcatggagaacccatttcattcctaaggacgtggagacaacttgggtgatttggctggtgaaggtgggcctgttattggattgcatggatgtcccaatggagtgtgaaacggggaattgtatacatgatgagagtttgtatgacaacatttgcaccttctgaagttgttgggaacgcttctacccacccagagaaagtacagacaaagactagaaggtaatggagccatttatcaggtgagtgaagtctacctgccaatcttgcccaggtacctggccctgggcttggtggttagaaaaaggcggtggccagagggagccctggggtgacactgagtggcagatacagcaggactggatgatctctggaacgcggctggaaaggtgaggacaagtgagaatagggtggagaagttgcaagagaggtttgtagccgacatggaaagagttgtggaggctttggaggataggcattgtttgagcatgaggaagaatgagaagcgcccttccttgatgtaccatggtccttgcttttggaggttctggacctggaagtcctccttttcttctgaggagtaaagaggaaagaataaggacagggacagaaactggccttgcacggttgtagggctacttgtttggccgcctgatctgctagtgcgtttccagcccgtataggattgtctggggtttggtggcccctgcaatgaatgacggcagctttctgcaggagctgggcagcctgaaggagcttgctgatgagagagccgtttatgacaggagtgttgtttgcaattaggaaaccccgttctttccagatggacaagtgtgagtgcactatgtggaacacataacgagaatctgaatatatgttcatttgttgtccagctgctagagtgagagctcgagtgagggtgatgagttcagccttttgggaggtggttcctagggggagcagattggcttcaatagtgtgggcgggtgacactatagcatagccagcatgtcggcatccttgatgtaggaaggaactgccatctacaaaccaagtaaatgaggcatctggaaggggttgatctgttaggtttggaaaaagtataagaaaggtttgaatggtgtccacacagaagtgtgcagggtcttgggaggtagtggcttcaggtaagagcatggccaggtttaaatgggagctggttagcacggtgatttggggagtttctatgaatagagcatacagttgaaggagccgtggggcagacatgagacttagtacactgcagtgagctagcatgtctttgatgttatgggttgaataaactgttaggttggcacgaagggatagttttaggcttccaagggtgaggacagcagctgccaccagtgcttggagacaggcaagccatccgagaactgtggttgtgagctgtttagagaggtaggcaacaatctggagggcgggtcccttagactggttagaacatgtagtgcaactccacgccgttcgtcgggatagagagaaaggtttggtgaggtctgggagagtgagaacgggggctgagatgagagccttctggaccagacggaaagggtgggtaatcggctgtgcagggtttaaaggcttatggagagggcctttagtagcttagtataacggtttggcaagtagagcaaaggaaggaacccagagcctaaaatatcccactagtcctagaaaagagagaatttcttgcttagtttgcggaggtgggaggaactggaggagcagtgtgcggtcggttgtgagccctcgggtttgcagggtaagagctaggcctaggtaggtgactgagggggtgcttacttgtgctttcttaggggagacccgatacccccactctgccaagaaatttaaaagacagatagcatgggcatggcagtctttttgagaggggctacacaggagcagatcatcaacatattgaaggaggtggacagttttaggaataaggtacagaggttgtgagcaagggcccgggtttcggcaccaggtgcaaggcactagtatttgttcaaatcccaagagtgcaccaaccaacagcacaaagcggtgtggagcaacacactgttttaatgagcacctgggtatagacgggctgaggcctaaaatggcgtcagccccacatgaggatggggccgaggttttatggtctcctgtaaacaggaagtgtccctgtctgatgtaactgctatgtggtacccggatggccaatctctccatcctcagggatacgtgtcttccggccagccctcttcctgcttctgctatcttgctgatgtgcacttgtcgcacaagtggccttgcgccttgggactgggcctgaggagggaggagttattcatccccccaagctttcaggccccagggagaatctttcatttattacattcctttctcagtttttattgagtttctcacactgaactcagtaaaaggtcaactttgtgtaggttcaaaagattcttctgattagatatttaaaaatataacttctgattttgatctctttttggttaggagatgagcagttcagatggacagaattgtgtattagggctttcgattcaacttgctaatgtttatgtgttgtagtaaaaacataacatttttaggagtagtctgatgctagaaagcaaatagaatacagtatctaaccaaaatcttgcagaagaaaagctgcatttaccaggtaattttcagttgcttgaattgtatcaaggagttgtattttttaaactaataataataataaggcacttacttttttaaaaaaaattccttattcagagatccagatttctgaagacaaagggagacaatagtgtttaaactagtgcaaatttctggaatttagaacatgaattctcaatacaaaggctaaaagactttccattttatggataactttttctccttttctctcagaatcatggagagtaaactaaagctctgtttgttaatagtgagacagtgccaggtaattgttgtgtagctcatacagcagataaagaactcactaacaaatatttattgaacatgacatgagcatggtgtctttatgcttcaaaatttggataactccccccatatcatttttaaattttttaatatttaaaaatattttcaagttacacataaagtgtacaagcttgatgaatttttgcatagacgtatatgtctatgtcactaccactctgagcaaggtacaagatatggaacattccagccctgcagaaggctccctcatgcacctgccaacttcgtacccacccacaatagtaaccactatctggactctataacaatatatttgcctgtcctgtaattttatataaatgggatcatgcagaatatagatttttatgtctagattcttgcacccatcagtatgtcttgttccatgttgttgcatgtaacagtggtttgctctgttttattgcagtacagatttcttggatgactatgcagcaatttattcattctattattagtagacttttaggatgtttcttgttttgtgaatattatgaataaagtggcgatgagcatttttgtgtgtgcctttaatggatatgtacattctgttatcttgggtattccctaacatttaatatttatactttttgttatctgtttccatggagaattccaacaaaattatcttcaaccataatctattttagactaaaatgacataaactgaaatttttaaaatatgtgtgtgtgaaatcgtctttattagcaaaaggttgtcattcttctttttttcttcttctggaatatagcatttgttgcttctttgggggtttccaatagcagttggccatctaaggagataaacacatgatatagctgcactttgaactatgtgagccagtggtaatgtttcagccgtggaaatgttctgtgctaatattagaatccagagaagctgtatttttttatagccatttcagtgacatttgtttggaagcatattgctgctgtaatttttttaaaattcttttttctttcttttttcctacagtcctcttttatccaaacataaggtaagagattgtttcttttgaatatatttctaggaaaaatgtttgtgtcatatgtctgttgtatggactattttggaaaatgaggaaacctttcccaagttattttcagcttcctagtttaatacaacagtttccccaaaagttgggttttcttgttttaaactttttagatagcagctgtggagaagtcccaggaaaggaaatgctccacgcagttactagtgtctgaagatccaaaggaaggaggagctaccaccaaagagtcaggtatgtttttaacttaagctatggagcaacgtaaaagatacctgcctcttctgatcttttacaagtgatacatctgaattgctgcaaaggatctggtttttttttttttttttttttgcacttacatttttgtacatatacctctcctagaaaaagagcaaaatgagactttttatattgggtagctccacattttagacatctattagtagataccataaaatctaagttcttataaaaacataaaattcttatgttttcagtaggtggttatatatatctaacagaataagaaaaggttgtacaaaatgctctgaaatagaattggtgttggtacattcatacattgttttctgtttaaaaaccaacagttattgtatacactttaccagaaatttgttctgtaaatttagatattttaaactctatatcttgataatttatagcaatttaatttctccccttttctgtttactaacatatgatatactttagtttgtatgtatacatttctaaagcatttatgatgtatttcataccaccttgtgccttacgtcaaaagattttaagaggctttcttctaaatgtttggcatgttgctcattataaaagctttagaaaataaaaataaataaatatgttttagggtttttttcccttgatacctaattttactattaatatatatttctaggctttatgttcctgggcctgagagccctaatattgaagaggaagtatcaggtgttttggatgagttgccctgaagtgatatgatgatggtgatgatggtggtgatggatggtgatgatgatgatggtgttgatgatgtcataattagccttttgccttttttccccccttttttgtttgagacagggtctcacgctgttgcccaggctggagtgcagtggcaccatcacggctcattgcagcgatctcctgggctcaagtaatcctcccgcctcagtctctccagtagctgagattataggcacacaccacggcgccccagttaatttttaaaaatttttgtgggtatggaggtctcactatgttgctcaggctggtctggaagtcctgagctcaagcgatcctctcacctcagccccacaaagtcctggaattacaggcatgagccaccatgcccggccagccttttactctttacaaagtatatttttattctttcaaatcttactttatctccttttcacttctgaaacaagctagggatattgcctggggtcagtcctactagactctgttcttccgtcttttccagtcatttttatattagaaatcacagtaaaatgagcttcataacaatcttaaaggaggaaaaatatcacaaagctgcccagtttgggtgtgaacgtgtctctgtgttgagcaccttgggaaaagtgctattacaggctgtgcatttgagtttgagacttacttagcatggttgctgcgcagcacctcctcctgcttggcctctgctttgagtcatgtggtacagatggggaaactgaggtaccaagtttcagtcacttgcttggtgctttgattcgcagctagaacctgggtcttcccatttctaattgaacgcagcctgcttctgctaagtacattgtatggattatcaaaggcttcaacaatccagatgtcccaggaataaccctatgagggagtatggactaaattctggggaaagaaatgttgctccagtttcaccaaacagtgttttaaagagaaatgtcaataatgtgggtgactctccgaatgtagtttggaactcttgccttttccaaaattatggtggagtttttttccccattattttctgtagtatttctaaataatgggatgaagcaaccattttcaggctattttgtaaataatacattgtacccacagatagtctttattacttatcacttaagtggtatctcagttcattagataccatactgtaagtggttgtatttcgtggcatagctgctgtccatcaccccatctcctactcatagaatggcacctcagactgttctgtaccttttcagtcacttataagctattaaatagtctcattttgccgggcgcgatggctcatgcctgtaatcccagcactttgggaggccgaggcgggcggttcacgaggtcaggagatcgagaccacagtgaaaccccgtctctactaaaaatacaaaaaaattagccgggcgtggtggcgggcgcctgtagtcccagctgctggagaggctgaggcaggagaatggcgtgaacccgggaggcggagcttgcagtgagctgagatggcgccactgcgctccgcctgggcgacagagcgagactctgtctccaaaaaaaaaaaaaaaaaaaaaaattgtctcattttgattatttagagcttagccctattcaatcctgaacttgattttcacatttaaatctcactgtactcaaagctcttctccgccctccagttgccagggctgggaacactgtctgctcctggttggagttagctggactggtgattatgactgaacccaggttgtgcggtggctccagcaggagcagctacggaggaggttactcccaagctgctcccctagataactgcagcctttaggtaactgaccctcaggtggaagcaacacaccccagtcctctgatgtgggggttctctctgccctgtgctttcacagtgcctgtgggactgtggtccccaatcttatttagtctctgagtcctgtggacatgttttgagggacatcttctgaacctttgggtacctggaattcatggaggagtggcttggccccctttcctttggatgtggccctcattgctctaaccttgccccattttaacagagggaggggcagacagcaagcccagtgtcaaagcaggcaaccaaagggaagtgaaaggtgcctttgttttcttgcagccttacaaactttgagtgattctttggggtggggagagagaaggaaggctgtattctcccaaaggtgaccccttcttccttctcctgatctgcatctgatatttgagtcagggtgtcaggggaggtgctatgaactctactgaatagctacctctcagcagcccgaagttgagtggcagcctcagcaccagatgctctgaaatctgcaggcaatgtttcaggaatgccttttgcttgatatggtatgggcctcaattgtcagttggtgattagtattaaagtatcaatatgtttttggagtccagggtgaaaaagaaagaaaaaaaaagtatcagtaaataaacaaatggaataaaattatcatcatattttctcttttattttcacctttggctcattatttatttaagttaaacaacatattagtataaaaaggttaaaactttttttttttttttttttttgagatggagtctcgctctgtcgcccaggctggagtgcagtggcgcaatctcggctcacagcaagctccgcctcccgggttcacgccattctcctgcctcagcctcccgagtagctgggactacaggcgcccgccaccgcgcccggctaattttttgtgtttttagtagagacggggtttcaccgtgttagacaggatggtctcgatctcctgacctcgtgatccatccgcctcggcctcccaaagtgctgggatgacaggcttgagccaccgcgcccggccaaaaaggttaaagcttctaaaatagttatgaatgctaagtgtaccaataaagcgaggataagcaagcttctctgttacctacccatccatgcacttctcattcattattcacacggaggtttttaactgtttcattttaaagtgaaggaaaaataagttggttttactcaaagtagaaattgaaagagatgtcagaattcaaacccatttctacttgttgcaaaaacttatcctttttattgctaccctttgctacctccctttaagaagttgctcggcgtggtggctcacgcctgtaatcccagcactttgggaggccgaggcgggcagatcacgaggtcaggagatctaaaccatcctggctaacacggtgaaaccccatctctactaaaaaataccaaaaattagctgggcaaggtggcgggcgcctgtagtcccagctactcgggaggctgaggcaggagaatggtgtgaacccgggaggcggagcttgcagtgagccgagatcgcgccactgtgctccagcctgggtgacagagcgaaactccgtctcaaaaaaaaaaaaaaagttgcaagtaatttgcaaacacatttattagtggtattatggtcaaattataaatttgaagagaaccgagtttgttcctttaatcttagtaaaccagaccagtactacttttcttacatttaaaatgatgaatgtgttactgaggttcatcatgtaaaaatatttacttaatacaccatgtctttttttgtttgtttgtttttgagatggagttttgctcttgttgcccaggctggagtgcaatggcgtgatctcaggtaaccgcagcctccgcctcccgggttcaagcaattctcttgcctcagcctcccgagtagctgggattacaggcatgtgccaccacgcccagctaattttgtgtttttaatagagacggggtttctccatgttggtcaggctggtttcgaattcccgacctcaggtgatccgcccacctcggcctcccaaagtgctgggactacaggcgtgagccactgtgcctggccccatacaccatgccttaaatgtgctgaaaataatttttgtaacttcattttaatgtaaaagtttaataaagttcagaatatcttttaaacctttgaaaatgactttgttgattttaatgaggactaagtgatttattcatattcacatgcttttgaataatccctgttatgtataaggattctttactaaatattttgggtatttcctctacctaaagacactattatgcaacagacagaatttccatttgaaagggttagaatattgctgtattacacatattcatatgtcccttcttttccttcctatacaaagtgttgttttgaatttttaacaatttatttttcttcatctttagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtggccagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggtaaatcagagatgaagtacaattaaaagtaaaatggcatttaaaaaacatatatatgtattaaatattgccttgtttttgtaagttttcccttgtctcaaacatgagggaaaattctagttaacgtaagcttttaattattagtagtttttacatttgtatgtattgaataaaatgacttttaatcattgcaatgttcatactacaagatgttctattgcatgcctccagctagagtgagcgttattgtatatatccattttttatagtcctgactgttatgtggcagttccagatattggaatcaaaaccagaatagtcacattctaataaggaagtctcatttttcttctcatacatctagcagataaaatatgatatgtacttactgtttcttcctcttgttaatatattttttaagtcttttaaaatagtctaaagaatagagggaacattttaaaatataagaggtactagattaatttttaaccttatattaagttgaaaaaagagattaaggaaaaattaccatttttcattgtttgataatacaaaaaaaaagtttggaaaaagaaaagataaaagccatatccaaactacagcacactcacgaaggcggcctggtgtggtagagcagaattcgattgccttagttccagtacaatcccaccaggtagttaacagcttcttggagttaccttttacctctgtaagcctgttttcttctctgaaaattaggatactagctgcctttccttttcttcaccatttttccccccaagttcacttttaagtcccatttgtactcattgtgttctaaatcagcattatcattgaaaaaataagggggaaaatgaaaaagtaacaaagccaaagtagacagtaaaatatatgtgaaaacagaagactgaaaagctgtctaaggtaattatagctgctatattactagctccctttattgccatttatagtcaattctctataaacaatgacttttctttttaatttttttcttgccaaaattagatagaatagtaaagcacttggcttactattcattctcttattttaaccagacagcttggttgccatttgcagttaattctctacagactgttgttttgtttttttttttttttcgtagtttttgcttaacaaaattatttaatattgcttaatgggcacagaatttccatttggggcaatgaaaaatgttggaaatagatggtggtgatggtacacgttttgattgcaatgaatgccactgaattgtatacttacaaagagttaaaatggcagtttcatgtgatatatatttttccacaatgttaaaaatagttttttaaaaaattagagctaatggtatagcacttaatccggtattcattctcttgtacattttaactaaatctctggtacaggaagttaacaacacaaagcttatacccatattcaaatcttagctgtaataccaaaaagttaccattgtctgactgtcctttctcatgccaacaatcaagttgaccataaagggagaacccatgtggtctaattttacctttttaggtataaactgtgaagaagaagcagagagctcctgttgtcttgcccaccttataaaacgttttcctctatttcaacatttgactagttacacactgataatcatatggtgtgcctttttagaactatctttccccagtaactcatatttgggaggataataggaacttttggaatttcaatttttgcttctgcctgaaagctgttcggctggataaatttctatcatctagtttgccagatgtcccctccagagcaattctttgagttttggtaacctttatcttcaacctcctccctactcagctgtgttgaagatgcacaagggtcttgtcgtggatgtatcaaaggtctgtagcatttctcctgtatatttcagtcatctattgacatgtatttccaaagcctacaattgatcaacatccctttcccaaattatttttccccacatcactaaatttaaaattgttctcaactgagtcatcctatttctaagaaattaaagagttgtttatattggggaaaaaatattttaaggtggcagattgttaaattaatgttgcgtattacaattaaatggaatattccctcctcagactcaaaacacaatgtcacttctgctgggtaacagctaacagtggaaattacatgtgtttaaagttgtcttttctattaagttaatacataatggtctcctttcctaagattatattgatctattaagttaagctattttaagaaccccaaaagctacatatacatgacttacaaaactaatttactttcctatgacaatgccaagcagattgttaaacatttgctttctgaatacttactaccctcgctattctgaaaagcatggtttaacaaagtctgcctaactctgtcaggaaaggagtttttaaagtttcaatgctaaaaatcactaatacttaatattttctaataccttaacaatgaggttttggaccaagtaaaatatccaggcaattgtgggtttgcttataagtgcaaacttaggatttttattttaaaaatttcttttagatttgaacatataaaattttaattcaaactttttttttttttttttttgatacagagtctcactctgtcgcccaggctggagtgcagcggcacgatctcagctcactgcaacctccatctcctgggttcaagcaatactcgtgcctcagtctgtcgagtagctgggactacaggcatgcaccaccatgccctgctactttttatatttttagtagagatggggtttcaccatgttggccaggctggtcttcaactcctggcctcaagtaatccacctacctcggcctaccaaagtgctgggattacaggcttgagctaccatgcttggccttcaaacactttttctgtttgtgctttcagtaaaattttattaagagtcttccctgtgtttggtgctgaggatacaatgagaaatcagatgatgttgttggccttttgggggatctctgctgtcacacttggctgattttactggaattgtttttgaaatttttttttatgcttccttccgtttgtgattagaggatatagaacatgatctcttaataaccaagtaattatgaacaacatttttcttgcacttaggaaccccgaggcaatgagtctgccccctccacccctccacgctgctgtgctatcgcaggtggtccttctctgttcgctttcccagatctccctatcatttctccccgcccaggttctcttacttccctctttctaccattgtgtttgtggtagagcatgctggtttgttctttctttgccagctttcccctttcctcttgtctgtctgctttcattttcttgccacttttgcattgcccagccttggctccagtggaatttggttttgatcatcattgccagcccagtgcaagcacttgttttgttgtgttgctttgaacagttggattcatcagatcaaatgaaataatttacataaaatgtcacagagaactaaaaatgtctatactatttatatagtgacatgtataaagggaacttgtctaggtttggaaagctttttcaaacccagtaatttgctatgtaaagtgatagcttaatatctgaagtattgctattctttcttacataaaaaatagcatgacacgttatcatcaaaagtatagtttatactgtatactgtttttaaaaagcatcaaaaattttatcctcctttcatagatttttaagaaaaaaaatgatcacatgtgcattgtcagacaacacattggaaagatttactcgtttattctctcattctgtaatttttattgagtgacttctctgtgagggccgcattacagatgcagtgactgaaaatacacgtaaggatttttatgcagatgaagcctgcaatctaacagtcgtctggcaccaagtgtgttgtctttttgctgaatttgaacatcccatagtttttggcaaaggatgaaattgtattataatacctataatacactgacgtgatgattttagtgtcagaacccaaaccccctttactcaggaacctgatcatgcaaataaatcatgtgtttgtttggttctggaacctggaagagttgcattatcttctctttaaactcttcagctgttcctcctgtagcctgagactcagagggagctcctagcatccaaacttgaacgaaatgtgccatgtaaactcagagtgccaggatgacccacgggggtgcgcactcagcttgtacagactcttacacacatagagatgaggtagctgttttctgaacaagtgaggttgaaattgaatgttggatacattttacgaaagttaatctatttttgaacattgaaaataatcatagtatgtaattcagaggtccccttgtgagcagattttagcaacatgatatgctgtgtggagataaaccattcatttttcttcattaacatctacatttataatctgcttgcagaaatgtcatatgttcagaaaaatatattaagtgtttcagattgaagtgatttttgtttttagaaataatttcattatttctaaaatctgaggaagaagccctgtgttactgcttgggtctttagaaagcttttaatctggccgggcacagtggctcacgcctgtaatcccagcactttgggaggccaaggcgggcggatcacgaggtcaggagatcgagaccatcctggctaacacggtgaaaccccgtctctactaaaaatacaaaaaactagccgggcgtggtggcgggcgcctgtagtcccagctactcgggaggctgaggcaggagaatggcgtgaacctgggaggcggagcttgcagtgagccgagattgcaccactgcactccagcctgggctacagagtgagactctgtctcaaaaaaaaaaaaaaagaaagcttttaatctaggagagagcaactcatgttccttgccctctgtctagattagcaacatttacttaaatgttttcagaactgcttgtatcacatgaagcaaaatacaggggaggacataagttcacagtgtctagtggggagaaaaatgacaacccagattgctcctggatttgcctttagagaagctatctaatcgaagctgtgagttttcttccctgttgcctattaagtgaggtagttatttcttgactagatagatcactgggatcagggaagttactttacgactagctgctgtgggattctcttgccaagtgaagatgggaggctagcactaagcagtagtcgcttatgaaatcacattggtagctgctctatggatccggaacaaaagagggtcttagaaacagcaatcatggttgttctgcccagaatggctcttttgagaggagcaggggaagtccagcctcctcacaatagaagaaatgcagtcttccaataatgtaagaggttttagaaacaatggttggcccagaatttatgtagatatctaaagagcgcccaaaggaaaacccaggaattacctgttttccaaatggcctcgtccttgccttttgtttttatcatgacctctacattttctaattaattaatgcttctcttgatagccatgtctcttgcgcaaagctctttttcttttcctttttaatcactcttttaatttatatttgtactgctcttcctggacttttgcagtagttacttaataagtttccctgtcccttgtttcatcttctcccctccaaattggtcttacgttagcactctataaacttggggtctcaaactggtacccaaggagccagtcaggtattagaagtcaatgaaatgagttaggtgtagagtgataggaagaaggtttccacgccttgtctggaagtatacagcttttttaaactccacagattaaaccaaccacagctgagggttcttgatcgaacacacggactgtgagtttaaactcctgctatgaaacacttttaaactatcattcctttcccacggctctctttacctgcaggataaaggctgtactactcgacattcaggactcctgtcatctggcccactctgtctccccaacgtcatcttctgtcctggggtctcagactataccgtagtcagactggccccctcgccacctcccagatacaccttgcatgtcgtcacgtttgctcttttccctctgtgtatgtcagctccaccctgaggtgagcaaccttctttccacatacctatctcttcccagccctccacatctaggtcatggctttttagcatggagagtaccaaacagtgcctagctcatggccagtactcagtaagtgctagctgatgctatgattccctgatcactggagtccagaagtttgtttctttcaaacaattcctcggaacttcaaatgaggttgaggctggaacatcactcttcccaaagtcctgtctagctgtaatctctctctgttatcgtaagacgcacacatactgtcttctacatcaaactgcaaactccttaaagatacggattctgttaaatacatctttatattctctgcaaagctaatacaggctgttgtaaataacagccactatacacagtaaggctttttttcttagttcacttataaaaataaatatcctttaatgatagatttggttttgattattttcagtgaaaaagctacattactcaaacaagtatttgctaggtgctatctatatgtaaattgcttatctgtgtttttttttttattctttggcatatttagtgagcacctactatattatagaaactaggaagacagcgctgaacacagatcaagtccctgctctcataaagcttactttctagagggagagacacgtaataagttaacataaaaacaaaaatatagttttggatactggaagaactattaaagaatttcagcaaggtcaggggatttaaagtaactgaactggcagctatttaaacaattttctgggccttaaaaatgggatcatatcttgacattctcatttctttttctattttgtacttactaaattgcccccttaagcaagcaaaacaaattgcaaaaacatgaggtaatgcctcacctagaaacttagacacattgtaaaactcctgtgatttttttaaaggctttttcctttttaagtgaatcttttaaagattcgacattgatgtacttcatcatcatgcgtttttccccttgtttgccttctccctgtattgcagtgttctaagatgcagtgctgtgggtctgaggtgaccgccgtgttctttctggaaaatggctgctgcttacagctggtactccctggcccagcggtgacatgtttttatcaatctgccatagaaggagccatgacattagtctacttccagattaatcaaatgacacaaagatctttcatctaatctcctcttcccctgtgtctctagatgggcaaatttggccattagtttaagtatctcataaatgaggtgatgtgtaagataagaatttttgctagagtcttatttgaaagttctattaatcttgttttaattgtaatatatattatagcatatggcataaagcaacattttaatagtcatagaaaataagatattttcacattaaggaactggcaagaggtttgatactgaatttgttttcaaactctaccagctactggcactgcaagcttaagcaagttactcaagcccttgaagcttggcctcttcgtctgcaaaatggggctgataaggcttctaaaagagagttgtgaaaattaaatatgatatagtatgtaaatatcgttacataaaatgtacacatttactaaattatagttgttattatggaacccaacactaaagaagcgggcagagaatatcacttgtttctgtagttaggaatagtagcagtaaatttgacatgtgccactatagtgaaattgctggcacttaagttatttgtcatatactataataatatgatttatgaatgttaattctcaaatcagttggaagccaactgtgtgttcttgttcagaattgaccaacctagaggttctgaattgagtgaaacctatatcattaaaagaatgtgacttggtatctgttttcttctttaattttgtgaggaggcacttccaacagcagtgtgtctctgaatatttttcttgtcacattaggattcactattccagaagagttgcgaataattttgttttcacaactagttcattctgaaaatgctatttaaggtggtcactgatatttgaggggaagtgtgggaagaactatttatttgcaaatacagaagactgggccagatggaattttttttaattctgcatttattcatagagcaccacccgtaacaattacattaattatagctcagacattctttttggtctcaatagaagggcttggtatatttgtttgggtaagaatttggcaattgaagtgggaaactaaatttagttttaaggctttattttttgagatttaaaaattcttcaccttttaatactgacactatagttttaaaaacaatggaaatatttttaagaatagtctggggccgggcacagtggcgcaaatctgtaatcctggtgctttgggttgcttgagcccaggagttcgagaccagcctgggcaacacagcaaaaccctgtctccacaaaagaatgccaaaaacattagccaggcatggtggcgtgtgcctgtagtcccagctacaggaggctaaggtgggaggattgcttgagcctaggaggttgaggctgcagcgagctgtcagcatgccactgcactccagcctgggcaacagagtgcgaccctctctcaaaaaaaacagacaaaaacaaaacaaaataatagtttggagggaacacattgctctatgccctaaatcagcagcccagtgtattttagaaacacttgtcagtcttttgagtgagaccccaaaccgagaccatgactttgttttgtcttacttgcccttcaagtatgaaattgaggcaaaccccaccaaacttgtttcttaagatctttatgttggactgccctgaagtggtaagaaaaaattctgttacaggtagatctgaactgcgcccaaaactctcgcaaaaatagaaaggctcgatgctgtccgccactcccacctgagagtgcctccttggcctgcatctcttatgcataagcttggcccaccgtcccttgttctccatctgtaggctgtagaatcagaagacagttacaacagaaagacctagagaagatcactgagcaagaactgaaaggaaatgatggaaaagagcagactccttcacttcagacactggggcaggccctgctgaaacaaaagggttttggtggcagaaaaaaaaggcgtggttcgatttttagcaagaattaaggtattgtgacggagggggtgtcaaaaatgttagcccatcccacacaattgtaatttctcatactctgcttctcccatctttaaaaagaattcagaaaaagttgccagagttcattgccacccatagtaaataaggtgggaccacctgacaaggcttgtatcccttagtgttgacttccacagccaaacaccaccctccctggttgaggctgagcaggagctaaggcagggacctcacagccgctgcactaggaccagctctaggttcagttggctcattctgtgcctttccagatgatttcaggagcttctcttcctctgtcaacatgtttgttcctatttgcattgtcttttgatttatggcttgtatccgtttcttgaatttatagatgcagaattcatatcagaaagatcaattaagagcaacacaactctggggctcatctttaaaactattcttaatagggttgttttttctaagtagttaaaacggcaccttgaaaatccctgtggtaggtgaattcaccattggtaagtgtatgacagtattttatggagaaaatagatcgtgaaggaatcaataaacttcctccccgcttttaaaatttttggaaaaattttagaacagccagattcaagatcctctccttttttttacatgtactaaaaattaaaagaatatcaatgatacatctttagtagtaatgtattcatgaaaattaattcttgttttccatcttttgctctttacaaactggttaagactgtttccctctcagtgtcagcaaggtgcttataaaacctgttttctctgttgtgtgagggagttctttaatgacgatgttgctttcttcatatatttgtactttaccatttcaaggccactaaagtacttctgttttctcagaacaaggacttctgaaatacattatttcctataaaaagaaaagaatatattgttggcttgttgattttttttttgagataatggtttctatagacccacattcagggaagcatagtcaaagactatcttggtctatttggccctaaaagccctaagatataaaaagaactaatcgaatctgtaatatttatgcatagcgcattatcgaagatggctggctggaactgcaagtcatatttagtgttttatgctattgattagataaatgacattagaggccatcctcagcttagtcactgaggccagcaagtcactgatgccagcaagtcactggcctgatgccagcaagtcactgacatcttcggtgttaggcccacagtgcctgcctgtgtcatcacctacagcttgtagcaatcaggcaactaacaagttaacttctgtgactggccctgctgttcaggggccttcggcaaggcctcctgcttcccagcctggctctcccacctgctcctcttccttcttcctgcaccttggagtctgttagctcctaaatggcgagggtttttggttttgtttctaaataaggggtggaacataggcaggagagaggcagcccaagtgaaagagctagaaggcaacatataaaggggtggggtgggtgtctgaagagatattaggcagcagactttttctaggaaaggccaaattactaatattttaggctctatgatctcttagaaccgcacagtgccattgtagcccagaagcagctgtgcacagtgttcagatgaatcggctcagctgtgttccaattaaattatattcacaaaagtaggcagcactggcctttggcctgtgggccatagtttgccaacctctgcatactagaaagtaatatgtcccaggccgggtgcggtggctcacacctgtaatcccagcactttgggaggccaaggcgggcagatcacgaggtcaggagatcgagaccatcctggctaactcggtgaaaccccgtctctactgaaaatacaaaaaaattagccgagcatggtggcgggtgcctgtagtcccagctaccccggaggctgaggcaggagaacggcatgaacccgggaggcggagattgcagtgagccgagatcgcgccactgcactccagcctgggcgacagagcaagactctgtctcaaaaaaaaaaaaaatgtccctagtaaactggctctgagagaaattctggaagtccttaaaatattgtgagcagtagagcattatttagtaaatgcgtagtttctcagagaaactgaggacaacactttaatgttaaaagcttggtatctaaatatattttaagcttcatatgttcatttgtttaaaattgctgatgaatgaaaaaagcagtggaggattataagcatttattataaagcaaaacccagtgctaatgacgaagcaaagaggggactgtgagtgatcattttaccgataacagggaagttaagctacaaagcaaggtgttctgatttccagtcgactgaacacgtcatgctgcctgtccccggagtgagttcaggggttaaaaaaggaaaccagggttttggacttttgtgtttctcagtcatctgcagagaagtgaaagttttattctgttagattttgatgttatttttttctataggaattggatacccctgtaataaaaattcaaatatctgttgaatgagcctttttatagctacatgtagagatgtcccgccttaataaaagaattataggttcttataatttctgacaggttgttcctactgaaggattggtctccatattaaagaagaggaatgatactgtaggagatcatcctgcccaaatgcaacacaaaccatctaagcgaagagtgagattccaagaaatagacgatagcttggatcaaggtaaaccgcttggcactgtggctagcaggatagatgctcagtgtttgctgaaaggatgagtttgtgaatgatgtgacgtttactaacaggatttgtaaaagactatgtccgccaggcacggtggctcacacctgtaatcccagcactttaggaggctcaggcgggcagatcacttgaaatcaggagttcgagacaagcctgaccaacatgacaaaaccctgtgtccactaaaattagaaaaattagcgagtgtgggggtacgcgcctgtaatcccagctactcaggagactgaagcaggagaatcgcttgaacccgggagacaggttacagtgagccaagagcgtgccactgcacttcagcctaggtggcagagcgaggctccatctcaaaaaataaatataaataagtaaataaaagaatatgtcagtttagttgctttatcttctaagggagaaacatataaaatccaactatcatcttaaatcatttctaaatctttacttgcttaaataagtgagcaagctgcaaaattcaacttgtggcctccctgttccatagacagttaatgttgagagcttagttcagtttccctctttagtactttttgtgtgagtctgctatttttgtcttttgttgtttttttgttttttttttaagacggtcttgctctgtcacccaggctggattgcagtggcgcaaatcactgcaacctcaacctccacctcccaggttcaagcaattctcctgcctcagcctcctgagtagctgggcttacaggcacatgccaccacgcccggctaatttttgtatttttagtggagacggggtttcaccatgttggtcaggctggtctcaaactcctaacctcatgaggttaggatctgcctgccttggcctcccaaagtgctaggattacaggtgtgagccaccgcaccaggccctggctagttttctgtatttttagtagagatgaggttttgccatgttggccaggctagtctcgaactcctggcttcaagtgatccacccacctcggcctcccaaagtgctgggattacaggcatgagccaccatgcccggcttgtcttcttttcagtggacaattaatactcctcctttattgtggaaaatatttatgaatattctcttcagtgatttcctcttcattgatagaaaagagtgtctctcgagagcagcagttttacaccattgctgctgtttgacttcttcgtcctgggcctgtcaaacttaaggccctgacttggtctaacatgaggtggtgagttttgtagtgaacaatgctgccttttatggttgcaaatatgtttatctaaggtgtaagtaaataagagtaaatggaaaggtaacccagaacctgtcagtgggcttctcatattcataaaacaactgcattgttaaaataacagtgtaaatatttaggtatgctttctgggtgtgacataagtgataacagtagaggtttctgcatttttacaattagaaagctggttagggggccttagaaataatgtcctaacccctgattttacttctgcaccttgcttgtaactctcacagtcttctccagataaggtgctcacttctgtttgcactaatttgaccaaatcgttccttaataggaggaaccccggatttgaaactcacagtctgcatttcactttgtagccacctcatcttaaactaagtcacttacttgtaggagactgagttccatcatctttaaaataaggagaataacatctgcctctctgtccctattgaaaagcgtgtcagataatatgtataaattcattttgagaattataaaactaaatgtaaatgttgattgtgttggtttgttcctaagctctgtgacttacacggtgttttcataaacctcaccttctgccaaaatcttcctaaaagggcctgttcttccttctgtaagccaatgctatcccctggaaattaatgtgaggcacatgtatgattttcagctttgtagtagccatgttaaagtgaaaagaaacaggtgagatgaattttattttttatttgattttattttttttgagacgggatctcactctgtcgcccggctggagtgcagtggtgcgatcttggctcgctgcaacctccgcctcccgagttcaagcgattcttctgcctcagcctcccaggtagctgggattacaggcatgttccccgacgcctggctaatttttgtacttttagtagagacagggggtttcaccatgttggccaggctggtctcgaactcctgacctcaggtgatctgcctgcctcggcctcccaaagtgctgggattacaggcgtgagccaccgcacctggccagaattttaagaatgtattttatttaacccagtacataaaaattatttcaaaatgtgatctatatgaaaaaattactagtgagacattttacatcctttttttcacactaagtattcagaatctgtgttcatcgccgctcagtttggaccagctacatgtcaagtgcccaacagccacctgtggctcacatcggacagtacagctcagacaggtctaggacatataaataaaacaaacagcatagatgcttttacatatttaagctatatttaaatgtttggatttgaatatatgataatgaagaaaaatactttaggttgttaacatagatgaagtgggggtaggaatcatgttaagaaaagcacgtaaggcatggtgcagtggctcacacctgtcatcccagcacttggggaagcctcctcccaagtcttcctcctggatcactcgaggccaggagttggagaccagcctgggcaaacatggcaagaccccatctctacaaaaaatacagaaattagcagggcatggtggtgtgtgcacctttggtcccagctacttgggaggctgagatgggaggatcgcttgagcccaggaggttgaggctgcagtgagtgtggcctggtgacagagcacaaccctatgtctaaaaaaaaaaaaaaaagaaagacaagaccgaactgtccaaaaaaatacagcatgattaatatgatcctatttcttcatttatataaaagacatattttcatacataggtataaactattttagactgggcgtggtggcttatgcctgtaatcccagcactttgggaggccaaggcgggcaaatcacctgaggtcaggagtttgagaccagcctggccaatatggtgaaaccccatctctataacaatacaaaaagtagccaggcatgatggcaggtgcctgtaatctcagctacccaggaggctgaggcaggagaattgcttgaacccaggaggcagaggttgcagtgagccaagatcacaccattgcactctagcctgggcaacaagaacaagactctgtctcaaaaaaaaaaacaactattttaaaatgtaaatttcagagcaaacaattttttaatcctattttgatgtaagtcctgaaatcatacgtgtttgatctgaaatgacacacaccaaatttaacagtgtttacctctgggatgggaaggaaatatgattgggcgggagaaaaacggatagtcccttagactctaagatgcttttggggttgcgtttttacagggagaatatattcatgtattactgcacaatgttctaaataaagtctatttggtatccattaggttttgtaaaatttgtttcttgtaaaaatatatgctaattatgaaaaaaatcagtttaataaagtaaaaattaaatcatgagtcttagacatccttcaatgaaagaacatattaaatttacttcattctattaaatacttacatcatattccattatataaatgtcccataattgtttaactgttccattgtaaccagaaccactaagttattcccagccttttgttataacaaaccctgctgcagtgaacaagcttgtatatatgatatttgttgtgcagaactgtagcctaattcttaaaggtggatttgctgggatatgttgaaactatatgtcccaggtggcctgaggccgtcctggtttacacctgttgtcccggaattgcattcagttaacactgtctttttttctttttttttttttgagaaggagtctcgccctgtggcccaggctggagtgcagtggtgtgatctcagctcactgcaacctccgcctcccaggttcatgccattctcctgcctcagcctcctgagtagctgagactataggcacctgccaccacgcccagctgattttttatatttttagtagagacggggtttcaccgtgtcagccaggatggtctcgatctcctgacctcgtgatccgcccgcctcagcctcccaaagtgctgggattacaggcgtgagccaccacacccagccttaacactgtcttttactctcaaaattgtccagtctgtaggataaattaattttaaattttaatagatactgccaaattaccttccaaaaaggcattcctacactttaatcatgctgcagatcagaagactttttggtctttttgaaattaaaattttttttaaattatgaataattaagatatttttcaaccaaagaatgattgttttcttcaatatagaaagatgcaaaagagatcccacccaaaggcatttttattgtttaatattaagtcgactttgctctcaggtagtcccattatgtgaaccccaaggatcttagaacagccaggctgtactgtagactgtcaaataatgctgtcggggtgggcatgctggctcacacctgtaatcccagtactttgagaggccatgacatgaagataacttgaggccaggagttcaagaccaccctctgcagcatagtgagaccccatctctaccaaaaaataaaaaataaatagccaggcatggtggcacaggcctgtagtcctagctgctcaggaggctgaggcaggaggactacttgagcccaggtgtcagggctgcagtgagccaagattttgccactgcacttcagccagggtgacaaagtgagaccctgtctctaaaaaacaaacaaaaatgaatgaattcattaatgcgtgctatgagcacgtgagctgtttttcttcttctcatggagtgattctgtccattgtataaatgagctagttttaattttagcttgtacaagctccacaagtctgaatcttcttggtatttaataggtaggtctttgtagagtcattagcagcatgagttttctgtcaatacttcctatccgtagaggaccaacagtagaaatgtgtagttatcttaattagtgaaaagacagcagatgctaagatttccatttcggtgacaatgtaacctcactctttctcatgtttgcagatgaagttggaggtggctcctgtattttgctggtcttgctgtgcatagcaacggttttcctcagtgttggaggaactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagtttgtgtgtaatcagaaggagttaccttatggtttcagtgtcattctttagttaacttgggagctgtgtaatttaggctttgcgtattatttcacttctgttctccacttatgaagtgattgtgtgtttgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtggaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcaaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaacaacaaagaaaaaccaaacatgaattatagtttttaacaagtgatctttatttcctgtcttctgttaggatcatttgaaagaaaaagggagaacttactttctagttgttactggctggcacagtacctccctttgtgtttctgcttatttatttagattatgtgaatcttaaagggctttttatatcagttgaaagtgtgttactgcgcatgcatttggtgattccagtgctagatatttaattactgtgtatttagtgttttgattttctataatttcagttccgcgtgtttttacacttgttcattttaaattgatgtttcattttcacttataatactgtttgacttgtctctatcatgtcaccataaactgtaatattttcaagggttatagatcaaagatatttatttagaaatgtacaagataatgaaatttagattccttatacttaaggctgattttattagaagattattttaatgttctattataaattttaagaatttgtattcaaattgtatgtaaaatatgtaaaatgttgacggtactatattaagtggttctataaaagctattcacaagttctactgtgatggacatcctcatcatagacaaacctcctctgttttatcctcaatttctagttacagaaatttggtgatgcttatttttgccaattttatgtcaaaataagttaaaacttccctcctgttcacctcttgggtctctatcctgtgtaacctctggtgtagtatttgcccataggcaaccagagccacttcctctgaacccaacatctcctggggaccttcgcagcaagaggaaagcactgagacaatagcttgctaagcaggggcccagtggtgtctcagagaaaccatgggtgtcctcgccacttcccagggagggtgaggtgagctcgggaacataacgatgttttgacttacaataggcatgaaatcgcaactagaaaaattagggcagtttttaaaaatgtcatagttatctattgcatgaactggagtaattccacctggtggtgaaaggattgttatttcacacatgaaaaattcatccagttttactaaaatgtaattttttctgtcatttgaaagtactgacaactatttgtaactaatcttccttaagaactgtatttgagggtatcaaatcaagcttgtaatttaaaatctgtaccaacaaagtgtctcagagagtttatttgaaccattgggtgctgagaaaaaactgctttaaagtgaaactttgatttcagaagttgatctggccctacaagtagacagtcatctactttgggaagactaataggtccttaggtaacggctcttctgctttaaaatacctcccccatctgctgacagtagctgaagattattctaaacattcattcttttagatttaaaaataaaaatcttctggagga

SEQ ID NO: 2235 - DNA, 6305 bp, Homo sapiens
atccgagagtaaataattcttgctttattatgaaccaagtcacattttgtctcttccaacagatgcttgagccaaaaaagcaaacataggcagaaatacaattgagaatatcttcatgtttcaacctttaatctgacttgccttttactatcctttccccatttcttctaatctcttttgccttacaatatattaccttctaggtatcacctcatcctatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtatgtttgctaagtattcaagaacatccatgattatagtaggttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttccatttatacatgaatttctacagtgagctatttaaggtggtagaaatcattttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattattatactgtgtatttttgttgttgttcttcattgttattttttgtctttttacctccagtattttcaacccacagttggttgaatccaaggatgcagaactggaggacatggagggctgacgtgtaacatacataacatataaaacaggtcccttccagcgctagcacactgcaattacatcttaccctgaataagagagaaactctgttttggctggtaaaatttccaatgtcttcaccaataacaaagctcattttcacagaagtttgcataaactggaaacctggataaaaacaaagttgtaacatatttggttggattattttttaaatgtttcatgtatttacatgatcactaataatttttattcttatgctattaagattttacaagtgtattaataaattaccaaagtctgtaacacccaccctcaataaggagagactggtagaacgaaagtctctcctatcaatgtctaccctaccatccaacttcacgtccaaactatttagttttttgccaaaccttcaatgcactatgaccttttttttttctctcttgagatggagtttcactctcgtcgcccaggctggagtacaatggcgtgatctcggctcactgtaacctccacctcccaggttcaagcgattctcctgcctcagccccccaagtagctgggattgcaggtgcgtgccaccacgtctggctaatttttgtatttttagtagagagggtttcaccatgttggccaggctggtctcgaactcctgacctcaggtgatccgcctgcctcggcctcccaaagtgctgggattacaggcgtgagccaccatgcccagtgcactatgacctttataccatatccatgctgccactcccaactttttcatttcatttggaatgccttttttacctcctctctgtaactttccattcttttgctcactagcttctgggaattacaatcaccttttcatttaagttctcactattttgtgtcttataatagttggtgcttttcttggtcaccagtatttggtacaatcacatacagcctaagtttctcattggcaaaaaccttggccatttttatctttacattctcatccaagtatctggcacaagatagtcaataaatgctagacaaaaagaaacagtccaggttcctggccaggtgcggtggctcacgcctgtaatcccagcactttgggaggccaaggcaggcagatcacacggttagaagttcgagaccagcctggccaaccatggtgaaaccccgcctgtactaaaaaaaaaaaaatacaaaaattagcctggcatggtggtgtgcaactgtaatcccagctactcaggaggctgaagcaggagaattgcttgaacccgagaggtggaggttgcagtgagccaagatcacgtcactacactccagccttggcgacagagccagactcgtctcaaaaaaaaataaaaatagtccaggttccccttcccctctatccagactttcacactttacaatttcaaactttaagagtaacctaccttccatgaccacctggaacctccagtgtacagcttccttcattgttccattaattccgaaatgtcacactaggtgatatagcagtaggtaccagctaaatagctgattaaaatagaattatggttattagtagtcttaaaaacttcttgtggcttatctatcatacctacttttaaaaaatctttaagtgctttatgcactttccccttccctcacccctccctctttggttttccttgactgtttgtgcttttccatctcagtaaaaggacctcggggaatttaaaattaactagctcttctctggacttgtgattatattgtctgagtttggcaa

SEQ ID NO: 2236 - DNA, 14227 bp, Homo sapiens
agctggacaaagtacttttaatgcttattttacaaatatgtacctgtggtgctaatactaggcaaagaaaacaggacgattcaagagcagcctatgtaactaccaactcaagcactaacactagctagatcaccttcatgctttaaaatttaaagttatggagtagctgtgcccacacccccccccaaaaaaaagctttaataaaggcactgcagcgttaactaagttttagggtaaatttaggcaattaacaattcgaagagacttgtggtttatgtattagtaattcaaattactgttttagagatctcaggtagttaaccaattcttgctcaaagcactaatgttcagtccctcaccatttatgctgggtatgagtcccaatgcatgggtattgcaacctattgtcaggccttaacatgtatgtgtttgcttttattattactaaaatgttaaaacttaaacccaattattcaccaaactctgaacacctcaacctcagagctccagaattaggaatgaatgacaaagtttagactctaatcattttaagaatgttaggtgggaagaaatggcttcagatgcagtattgtgttcatctttccaggggaacatctcaaatgggtattctgaagcaggttgagaagtagataaaattctctgctacaagttccatccactttttttttttcaagagaccaggtctcactatgttgcccaggatggtctcaaactcctgagctcaagtgatcctcccgccttggcctcccaaagtgctaggattacaggcgtgagccaccacacccagccaagttccatccacttttgaaaacaagacatttatgtataggaagagaattatggaaacactttgtaaaacatccatttattatatccaatgctaaacactaccacttggactctaagatatgtttatgcctctctgtttattctagttttttaaaaatcaaatatacaagatctacaattatttatatccaagatgtctacaccactgcctaagaagctattaaaatatttgtatttgtgcaatggaacccattattcacatggtcctagaataaaaagtcaatttatattgtgaataaatttatcaaaaaacatgtcatccaattcccacaaatgagacattttaaatacagaatacactctgttcatgaatataaaatccccaggtgaaagtcccttaaaacactattatggttatgtttcctagaataattttataactttttcagagaattcctttaaacttgttaaaataccttgttgctagtgctcagaacatctaggttcagtctttatttttaagacagtatctatcctaggcaaatgagagcttgtttttatgtatttaagagtttcctcttgtcatttcaatgtcaaattgatttgactcaatttcatgatttcatctcgctcaaggccatcaaccggtcagagccagagcccttcaaaggctgtatgtgagtatatgagggaaaactttccacataattttacatcatttctatctcatagcagttttagttttctcatagctatctcatagcagttttagttttctcaaattctatgctgtttttgtactactgcagctgaccaatccaaagccagtttacactcagcatgtgttattctactttaaaatataaccttagtgaaagcacccttcaaatcaacagcaatctcacagtgagtttcctctgggtagtcaggatttgtccagaactacatccttttcagatgttcagagttttgcttgccattagggaggcaagggaaggatgagcaataaatcaggtttctcgttcgtatcttacttcttacctaattttctccctgttgcttatttggtacattcccttctctgaattccttaaacactttataaggttatttctgccatacaagtgtagacaattgtattaattctagtcttgactaaagattttaacatttttctgggtgccatttttatctattctctctccccccaaattctctgggctaaacaggcatgatagtctacctagtgttacttgaccattactttcccactgcaattataaaatgaattccttaataagcaattttaaactagaagatatatccaaaactttttaaaggcacaaaggacaactttaggacacaacactgattagcatcaaaacctgaaactgttcctctagtaagtctatgcaatcctaataatgtatactgaagagtagtagctcaggccagtggttcttagcattacttgctaaaaaagataaaaatccatgacactatcttcaactgttaaatatcttatgttaactaaggatttgcctgttccaaaaatgtctcaactgaacctatacatcacctaaactccagcttatagcaagaaaattccttagaagtatgaattcatatttatgatctgattttaaagggctaaaacaaaattctaagcaatcagaaatatagcaaacctaaacttaccaaagcaacctaaaaacaccaaggaaacgctagactgaagtcaaattttagttctacagtttgactcctgattcctcacttcacattggtgaggggaagattaaagtgttctgtgcaaacccaatataattacaattaggggatctaatgttattacatagctacagtcaagttagcagtgttgtgtagcagtgacatcaatgactggcttgcatgatggcttctaaaagcatctgatcccagagtttcatgtatcatatatatgtatataaaataatcagttgaggacagcattagcattctgtaaagatgataaactcagtgttaacttctcccagccagtaccttttcccctcattaaatatgttaaaagttgtctgggggggaggggaagggaagaattcaactttacttcataattatgtatcaattgtcagtatacatttaagtttttaaaacctaaatgttctatgcagagtaaagaataagctgtccagaaagcacacacttaataaatttctcctcttgggagttatataaagggattttgaaccttgatggcgagaatcccaaaacaagagtaaaatgaattctttttattgcaaacaaacgtctaaattaatttctccacccactttctttagaaagaaaaagaaatcagcaggctaaggagatacccattcaagaactgacatgattaaaaattaagatataaatgggtgactcacaatttcattagcttacaaagatggtggagttaactactacaagcacactagttatacagtattttgtgggagaagggcatacagacatggctaacttcatatagatcccattagacaactggatttacaacaagtttttttaataagaaatgggcaaagccagctttcttttcagaatcaaaatgcagaacaaatggaaaaattatggtattaaccttcacaagtttgagcctccacaaataatgcaaccaagttttacatttttaacagcccttctacatacactccatcttctctatcttagttccaagttttagttttcaatcccaattataccaattccattgttattttaagaaaaaaccttcccagttattgtcagaaactatgatttagcttaccccctccactacccagcaaactacagagaggatggagtgtaatatgagcagtacagagtcttaatgcaattcatgaggaccacttagtccttacatgaatctggttgctaacatttctattatattgtgacaatgactcccgactgttattctctgtgagaaatggggggagtaaattcttaataaaagacaccaggtacaaagcaacattttacttctgttgtgataaaaaaaaaaaaaagtcacattttacagataaaatgtagaaccctgaaatactgacacattctcttatcgtgcacaatgctgaggttctcttacgattcacttttaaactgcaattaaaaatgtacaaaaaagaaaagaaaaaaaatcaacccacaaagcttctaaaaaaggaacccgcaggcacttcctcttgtggaatgtttaaaaagttagcctactaaagaaaacagtcgacttcttgtgaaggttttggagaaatatgtatcagttcgttttatttgggtattcaataatatccttggtgataatgctgactccatggcttctgaccccagaattgctgtaagagaaaattttgtttttaaagaaaaaacatcaataagccactcaaactgtttttaggaaatgacaatgaatctaattcagagtaatttgctggaaacaaatttatacctgtcatacctctgatttctaccaaaccagatttagttttaatatcccataattatcaatacacattacaaaacgaaacatcatgactttgttagtttacacaattaaagctagcagtaaaagaactgtatatattaaataatattactttattaaaaaaatttaacttatagcaatcttcaacctattttgccttcaaaaggtagattatggctactactgcaagacgattcacactttaccctattaacacttataaacacttcaatccctgaacaagatctttttcaagactgataaatcttaggaactcaaaatacaattaatgtacataaagcacataagaaattacttacaccctgctgccactggttgtagccctgagattgatttttgtagccacgattgtttcctcgtcctctgaagttctacaaaaaggaaatactctctaagagctctgagcccaattgcttgttaggtttgtgggggtgagagagaggagcagaaatggacaggttgctagcccctaatcttaggtagcaagcaatacacaaattctggataccctctgctggtttcttatgttttaattttttattcattatgagaaatgcatctgacttgtttagtacacctgaaaaaactcaaaagtaagtagactcatttcaccattactagttcaattttccttatgtcaatgcctatcatgttccttacggattactaagacaccccaacataaagctcacacctttccagactaagctacagttatcaatcatgcttccagggatcttgaatcattacctggttgtagttccctctgttgggcattccacctctgttgtagttccctctgtttgagtaactaccacggccaggaaaaacaggggcacgagggtatggatagccgattccaccacttcctccaccgccaccacctctctgtggcatgttgcccctcctattatatccgccacgattcccaggggctaaaagacaagagctgttttagtttcattgtatattgtaccctacttatacagaagacttaggattcctctagattgttcctttttctccaaaaataattgtttaaagacaaaagaaatgtttaattctaaccattaacataacctaggtgtatttaatatcaaatcacatgaatactttagttactgtgacagtataccattaatgaggaagaaacttcagctacatccaaactataaaattatcacttgtttcgatcctgaactaaatacagaacactcaaaattaacttgcctcctcctctgaaatttccaccacgcatattgaatcctccacgtcctctatggccaccacctctgttaaactggttcttgccactcttatttttattgcttttctttgagccagtgttctgtttcttttctggtggaagagcctttttgctttcttccttatattgctccaagagtttttgggcttcttccttctgaagttcaacataggttatttcatcaaagcactcagctacctctgggagggtaaagtttcctgcaggaaacaaagtcatattattaatttagaaacccaccacgaatcctcacaatcctaaagctgacaattcttgaggtttagtaacatattttcctaaaaataaaaacagaccaaacatatatgcatatgtaacaactgcaattttaattcctgaagcagtattgctggaaaaaatgttaactttcaggaggcctaagtcctaatagatttaacatagttacacaagcagaatatgtaggaaaaacattcttttaaaaagaagatttcacacagtaacagaattaaaattccatgcctttcattttgaggaccgcatgttctggtaggtctttcccctctacttctgctttcttctgtgttctttgcttatagtcttcatcttttgggcaaactacaacagcttttcgctggaagcctgcaaacaggcacatttttctcctctgggcagcagcagacacatttgtctttaaaaaaagaaatttatgtttacaaccctaaacattaattctacaccaatctatctaaattatcagttaatatttttcaatttcaaagctacagcgtacctgatccagaataaaatttcgcttctttcgggcagcaatctcaataaatttcccaagacactggggggctctctgcaacagtgtgttcagttttccagtatctgccatttgcttcttaaaacctgccacctatattcaaaagttaaaatttccccttgaacttgtgaattttaataagttatgctttttaaaattcaactcatatctatatgtaaagcaggcaacattttataatttaaatattacctttgtccattattgctacaaaaacagggtcacttaaactatgtaacaagaccttacacttactcaattctttttagctgctagatgttaagagctcaaaaacactacggaaaaaaacagaagcctagccagtggaaggcagtttaccctcagagttgaaagaaccaacttaatcttgcctttcctcccatctctttaagatactaacaaaatggatagagacaaagacaaaaagtttacctagaatacctcccggtctataatttttcttttcttttttttttttttctgagacggagtgttgctctgtcgcccagactggagtacaatggcacgatctcaactcactgcaacctctgcctcccaggttcaagtaattgtccctgcctcaacctcccgagcagctgggattacaggaacccactaccacacccagctaatttttaaatttttagtaggaacggggcttcgccatgttggccaggtgggtctcaaactcctgacctcaggtgatccatccacctcagcctctcaaaatgctgagattacaggcgtgaaccaccatgcccagcctctcccagtctattttaaacactgagatcaggccctaaacattttacttaccatcatcttatccataatagtatttgtgccaagaatgttatatttccctggattttctgctgcatgtttagtaacccaggtagtttttccagctcctggcaagccaatcatcatcacaacctagtgaaaagaaaagaaatgtcatttcactgtcagtagacaccacctaataattctttaaatattgttaaggccaatttaaatatctaagttttcatagcccttacactaacggacaaaaatttgtttatggaaagattaacagtcaacataagggggaaacaattacttaagagcaatatgcacagcacaaagtaaatgaaacagactaatcatctagttcttctaaatgtcattttgtgccaggcaagcaatattcaaatgccacagttaaaaaaaaaaaaatcccttacttcacaatctttcttctcttcaggcccctttggtcctctaactcgatcctctaaggggacgttctggatgaaagtatactcttcaggtattggaaaatatggcttttccttctgaccaaaattaaattcaactgcacagttgtggcagagaacatgcgggaacagtggccgtccagcaagaacttccttactgattttgaaggcaacgccaagatcttgtccattcttagcatacgagagttctacttcatcactttcaaagttctgttacacagaaaaaaattcaacagttaaaatctgcttccttaaactttctaaaaaactaagaattaaaattaggagcaaagcttatcctgtggaagctacaggttaaagaactattaggtggcctttaagggctacacagttaagaaatctgatggttgtaaaccatgaagcacgtatctccagaaccagaaacaatactgacctagaagctagactgaattttctaggtcaatttcatgttcactgttttcagtcaaaatgaattagtgagttcctcaaaaatgtcctgtgttttcccaattcaactgctgaatgaagtctttacactaatccagggactggtgtattttgttgctcatattgaaaactgacctcagtaaagcttctttaaagttcctagatatagctactaactttgccatttatacatagaaagttagctttaacttacagcaaaacatgtaatcacatcattttcatcaaacttttctccataatcttcagtctcacagttgcatgtttttattccttttagagaatacccataagaaaattcttcttcacctaagaaaataattaatcttcatgaagtagatgtttaaaatagtccaaagactcatctattttactacttaagatgtaggctacaagagaaataagcatataacctaatcacctgtcactgacactattacttttctatctctgtaccagaattgatggaagttaggagggatatatacgcagagaccaaattagttgacgatttgcatatcacgggtaagattttatttcaaccattggtcataaacttctaataaaggaacaaaaactaaaatgtagcctgtgcctactatgtgctaatattacctgtctgaagtattaacagaatagataaaaacagacaaaaggcttagaatgccctctagttaaaaaacactgaaatcagaccctcctgaacattcatgagcccacatcagtcaaaaagaagctttaccaagtaacattccacttgtagttagtgaccagccaatacgaacttcatgtatgtcaatatcttttgtatataaatgccttactgggatcttctctgtaacctgaaagtcaaatcattaaataattaaaataatacaccaaggaggtaaccccttaactctcgcatatttcattgcgccacgggctaatcttcctctagctataaatacaaagaaggcacactctagcccacccccaatatttgtaagaactttaaactgatgtgcttataacttgaaatttaaagagttaaatacttatttgacccatatttaaaagaatacttaatatttttaaagttcatgttgtcagtctttaacttaaagccaattaaaggatacaattaatgtttttctcaccaacaaaagcagtaatgtaaccaaattttatttttaactctttggtggccctttcaaatgcttgataaaaatgaagtaccctaaataaaaaatcgcctagctctgcatggcaagttctaacataacaaccgtgattaactgtcacaacaaaatgaaggttccaagctcctcttttaatttacaggaagcttcaaaaataagtacctttgataacttagcagtatgaagcacctgtaattccagcattctgagaggctcaggcgggcagatcacttgagcttaggagttcaagaccagcctgggcaacatggtgagaccttgtcactattttaaaaaggaaaaaaaaaggctgggcacagtggctcatgcctgtaatcccagcactttgggacgccgagacagtggatcacctgaggtcaagagttggcgaccagcctggcctacgtggtgaaaccccatctctattaaaaatacaaaaattagccaggtgtggtagtgtgtgcctctagtccgagctacttgagagactgaagcaaggagaatcgcttgaacccaggacgcggaggttgcagtgagcctaggtcgcaccacggcaatccagcctagggaacagagtgagactgtctccacaaacaaacaaacaaatcataaaattgcatttaccttcatctcaaaacacactttgccttttgacacaccataggatgctcttcctccagcccaaagaaaagcaaaactctccattgtaagggaagaagcactgagacgatctcttgatattttaaaatgtagatcacaattatctgtaattatatcaaatactgtgttacttttgacatccaatgtaaacatatctgctatgtagacaaaacttggttacttaatttttgcatgtacttcttaatgctgcacaacttttctccacatcatgctgttgttccaattttcagtttaaagccccactcccaccaagtcactcctgttaaattatgtactgaaaagtaaactgcctgtgaaactaataccaaggtttaacatgtatattttaagtatttaaaataatcaagacaatgtgacattaatacatacctgctctgctctttaccttgatttagaggcaagcagtagaggatagcaggaaatcaaagtgaagcatgccagaaccaggtagatttaccagtgccacattaaaactgaagggaggccacgaccaaattattttaaaataggagtatgagctgctgttgatcctgcaccagggctctagctcctaaattctttttctaaaacttgtgaagaagacagcctaaaactatgaagtacaaacctggccgtctaatgctgttaatagtgcagcattttaggtcctctttacccaggactgcctgttcaacaattagggattaattgcttcccggattatccaaatccaaagtgtctttaacccagctacctatgggtcactggctcattaacatgcacttcctcagacttctcacttgaacagctaaagtcaagctggaactcattttctttttactgatcagagaaaaataaatctacagtttggaatttttcttaaattagagttattctaatcaacagaatttaattcaacagattgtttgaattcaacattgtacttatattgacatattcctgatttgctaaaaaatctaacaattacattacctgtgtgagtcaccacttcactaccttgccaattcctagcaacttatttatacaacccagaatttcactaaaactttcacatcaactaactcctttttcacctgcagttttttcttttaaaaaggctcagatgactatctcaaccttctgtaaaggatattccagtaagaaagagttttacattgacactcttacaaatctgaataaagccaatttgtacaagaaaacatgagaagctaagctccaatgccttccatctaacacagcaggctgacaccatagctgatacttttgaaacagttatttttatcctttggtctatttatcacacccagagttgtacattctcatcactaaaccaactacgtttttttgtaacaaaaaaaaaaaaaaaaaaaacaagtctgacagtcaaagcccacttagaggtttgcaatactttctcactcaattgcaacccaactgggtaaagtagcagtatttacagtgctgcactgccattgataccattcgctgctgaagaaagctagtggcccagtgatagcccactgctgctgcctcaggtctttggaagaaatcaacttatgtttaaagcagcagctactgaactggaattgagaacaaaagagcagttattgaaaaagtaatattacaatcttttaaaatagggaatatacttgtgtgctaatgggagaagtcattagtaaatatttaactagcccaaatagctcacttaatataattccacaaaaaaatgaattactttattgtagaagcctgtaaggctaaattataggtagtgttacaagtttccgttagctagtcaaaaactggcattaattttacatttcctaagaatgagaactttcaagtcataaaaatacgaaactcctagagcctgtaaaataatccacttaatacaactgatgacgtgctaaatattaaactactaggttctgaatgtaaaccattatcttcctgcttttaaaaaaactaacccaagttttgctgcacttaagcattaagacttctaaaaaaaaaaaaaaaaaaaccaccatcaccgcatttcataattggggagaaacagcttcacttacaagtatcaagacaaaccactgtgtcatcgaagtgttcatcttcttcttcaacaggtggctgaggagatttggctctgaaagacagaattgtctcctgatacagctttccgatcaacgaacgaataagggatgagtaaaactaggtgagcatcctatacctgctatacttgttctcttcaatgtactcaaaatatccacggccatgatcttctcgtggtcttttaacacccctctttttatctccgcctttctgttctgttttgccgtcccctaaaacacacacgagccccataaaggccaagcctctaaacaacaaaaaaacgcttttccgttccgagaaccaaagcagctcgactttatcctgctttttaactgaggttttaaccgaggactcaaatgtgaattcaaagaacaatcaactacgaattcgattggcgctagtgacgcagtctaaagacattactaattttgccagtctcctcgatgattcgagaaagccaaagaaaaactgcgcggcccaggcccgaagcccacgtgtatcccgaagagagcgcagagagggggaggggccgagcccggcgcggcggcgctcccctcccccgcgggcccgcgctccccgcggccgcattgtactgatcttccgccccccgccccgccccgcccggctcctcccgccggaagtgacgtcacgccgagcccctgcgctccttgcacaatacagcggcgaggagccgccaaagcgcgcccgccccgggacctggggcctctcccctccccccgagacatgtgcccgcaccgcgcgcacgcagcgcgacggcgccaccgcgggccgaccgggctccctcccgccgcccgcccgcggctcctccccctacagcggcagctgcagctccccccggctctcgagccacataatggaggcgctgccaccgccgacacacacacacacacacacacacacgcgcgcgcgcacacacacgccccgagcccgaggcctctcggctaatctgggattccccgcgccccctcccccaccctcaccgcggcgccctcccgcccggggctccctccccctgcggggctccggcaggcctggggcacggtccccaccccgcgcgggcctcccgccgcgcgcaacgtacaacgcagcactcacccgccgccggagccccggggcgaccgccgcctccgccgccttccgccttcttcttacctcccgcctgctgctggccctgcctcgccccgggcggcgccaccgtcaccgcgaacagcgaggtggggccgctgctcttccccgcggcctccttggcggccccgcgctgctgttggggctgttgctgctgcgtcgccggcggttgaggctgctgctccccgtgcccgttctcgtcgcccgcgccttcctcttcgtccccgagctcatcttccccttcctggaaaccctgatcgtcgccgttctcgtcttccgaggcggcctcctcctcctccatcgggcccgagtcggccgcccccgcggccccgttctcctctcctagctccatctggtcgccgtccagagcggagattccttcctcctcctcttcctcttcctcctcctcttcatcgccgccggccgcggcctcctgctcgaggcctgctcccgagcgcccagcggaatccccgcccaggtctaggctgccgttcccgggctccatggcggggcggcccccggcctcctcgtcgtccagcgcagcctggagtcgctccatgagctcggccttgagacccttgtcagaaaggcgtcgcttcttgagctcctctttcagctccgacaccttcagcttttttacattaacaggcgaggaactcatggtgagggccccgattcaccgctaggcgctgcctcaaactcggctccgctcactcggccactggtggcggctgctgcggctgctcctcggcccgggcggcggctgcggctgcggctggagatgggttcgtgctgcagagcggatccgcctggtgtcgaacggcgccaattcctttcaccgagttcgcgagggagacgcggagactcgcctggcgcgag

SEQ ID NO: 2237 - DNA, 14227 bp, Homo sapiens; identical to SEQ ID NO: 2236

SEQ ID NO: 2238 - DNA, 9722 bp, Homo sapiens
tagaaatggcggttggggcggagcagggggctggcgcgggaagcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaaggtaacctgggggtcggcggggcgcgcgccgcgggtgggcggtgggtaaggacgttctccgcggagctcctaggcccggagcacgtgtcactggcttctctgccacccatgggcttgaaactattttaactgttcctagtccttatcccaagcctccaacattttaatctaagtggccgggacaaaattgaccaaaactagggggaggaggggaccagtagtactaatgacttactacaggtcattatgaaataagctaacaatactgaatctttggcgagaaaattttgctgctaagggcactgcactgtaatttgttagtaaaggctaatagtagagattaaagctccgttgaggacaggtgccttgtctttaacacgttgtattcatcacatttaacataggagtaattgctgagggatgacttgattgtactacgatgagatgaagggttaagatttcttccccatcaccagtagcctccctagctggtgtccctgtctccatactctcctgaatccaccttccactattgtccgctggccctttccagcctgtaaactggacagttttcattcctctgcctaacatccagtcgtagcagcccatcctatctctttaaggataaaacccaaattcttggtatagtaaagctaaaccaagcgctctccctggaagggctcctgtgtttcaccaaagctgacttacgtactttccccatcttcccaggcatcttgtacgtcgttacatttatcatattggaaggtaataaatgatcttgttttcctcttttcctgggctccttattaagagcagggaacctaatttatatcctcagggcagaacaggtattcagaaaagaataatgcaagaggaaaaaagtttaatataaactagggagatcgtaacattggctaatcacgagcaaatatttatagaagacccactgtgtgctaaatggctcctaatatatacttaagatattctcccagcttggaaattctgctcacttcttgctcttgcttgcttctctggtgggcttccatccaaatttggccatgacatcagatcatatggttaatattaacaaatattgtataaattgttttcatacttaatatccaacaggttgtcagtttacgtactactggtgccttatctgtttttactgtcccatacactgcccatctggaataagcttagtgtttaaaaaaaaaaaaagatctttgcatacacacagtaaatcctagattcagttttgtgataaacactggaatcctgaatgggacttttggtaggagataactgctgtttttaaaggtcataaaggtggtttaatccattggaaattaaaaaaaaaaaacttaaaagaggatcaacattgacctatttaactggcccatcagtaagtagcaaaacaatactgtagttgttgaaatgaagatagttataagcctcaaaccgagcacagtcagaggtgggaggccaaaaaaacaaaaattgctcatgaaacagtagtacctatcagagcccatcaaaaagctaattaaattaatagaagctatgatgaattaacagcccaaggtgctgtcagaaaggaagcctgcggttattttttttaaaagaatttgtcagtgatcattccagcacaacccagggaggattattttattataagaattagcaaacctaaagtaaaaatgggagttaccaagctggcataccttgatagaactagcccctaaaaactgtcctctgccacattcttgtcctttaagaaactttaaaatgtgaaatttggtacatacaggtaaattcacattcaggtaaattcttaattcacccattcaaaaaatatttagagtacctactgagtattagacactgaacgaggtactagactgatcaagacaggaaaaatccctttaaggagctgacattctactggaggaatcaataagcaagacttctactgagccagtcatgcaaagatccaggagaaaggcagcatgtgttcgttcggtaataaccatctcggcttgttagaatggcaaggccactgtacctggactagtggacaagagtaggatatgaaagagcatgggatcatgtagggcctttggagcaatggtaaggattctgagcataatcggaggctacagaggacttattatagtcatctgatacacatttttatgagtagaatcaagatctgaaaggtactgttgatagatggtaatttgataggacaggttgagcttcccaattcaaaaaaaaaattgtcttttgatgtatcagtttcagatttgggatgctcaacctgtattagcaatgaagttggtgggcagtggtctggctcaggatgtatttagaatgtggatccttccagacttgctaatatatttgatgtggatttgatgaaggaatcaaggatgactcttagtttttgggtctgaaaattggttgagtagtgtgccattaagaggaaggtttggaggtgaaaatatattttgcaaatacgaggttcaaggtgctttttatacataaaagtgtcattcattaagcagatgaatgaggctgaagcttgggagagattagggtttgatttagaaatctggagtcatcatataatggcatttaattgaaagccttgggatacctaggaagagactagattccaaaggagttaagagtggcacttcagaatcaggtctgtagaggagggaacagcaacaaaaatgtcaatgaaatagaaaaccaggagacgtatttgaagccaagtaaaagtaaaaaagtttcaaaaacaaatgataatttgtgccacatatgctgagatgcggatttagactgcagtggatgtcttttagaggtcttgactggtgtcaagtgaagttcagtggatagatgcctcactcaagtgagttaaagggagaatgggaggttttaagtagaaaagcacacctacactcagaagttttgccccaaaaggatggtggtttaggtggctgatgagaggagaggggtgtatagaggatttttgggttttttttttgagatggagtcttcttgctctgttgcccaggctggagtgcagtggtgccatcttggctcactgcaacctccgcctcctgggctcaagcgattctgcctcagcctcccgagtagctgggattacaggcatgtgctaccattcctggctaatttttgtacttttagtagagacagggttttgccatgttggccaggctggtctcgaacttccgacctcaagtgatccacccactttggcctcccaaagtgctgggatgacgggtgagccactgcacctggccaagagggctgatagtaaattattgcaagtgaaaaaactaacgatgcaaatgaaaggggtagctatagaagccaagcccttgagtatgcaagaggggaatcaagtgcccaagtgggaagactagcattagataggaatagggccaattcatcctttgcaaccagaggaaagaaatacgggcactgaagcagatttagtggtggaaaatcaactgtctctaatttgatcagatctatttctatacattattgacattctggcttggaaatctcttgagctttccttagattgatcagggtgagctggtaaagctgcttttctaaatctaagcttaaaaaatgtctgacatttccttaatttatttttaagggttcccgtttgttagtggcaaagagttaaatcttaagtatgcaggctacttaaggaatagaagagaaatgttaaaggcatgtatattatgaacagaatatttccgtatataaatagaatacttcaaagggagttatgcccgggatcctttattcatctccacttctgagcattttacagttcagtgtacttaactgtaaaggtatacaggctcaagtcgttgcatattcttcctgttttgatagaaattgcagggatttatgtactgaatcttattactccttagatatgtgacaactggaaagctccccaccaaaccctccagccttggttacttcttaatgatgtggtttggcacaatgaaaatgtcataggctttgtggtgaaactgacttctgcctccactcctgccaacacttattattagcctcttaagtccccgagcctgtttcagaggtaatctcacacaaaggctagagaattaaaaaacatgtagagagcctggcactaatacctacctcccccaccagcagctcttaattatgagatcaaccactattattttagaccagagttttgttggggattgggtttgtttcagaaggcactattttaaataagatgtgtagcttctatttagatatttgcctttaaagtcagctgagctattttcctattgtttgcaaatttacttttatttaaaaaaataaaatttcctaaagcagtgtttccccaatatgacagtcatcagaaaaaaccacctagagttttctaaacatagattccagtgattgtaaatcagaatctgagagtgggactagaaaatacttaattctatcctgtggtacaagctggtctcacacttgcatctttgcacctaagactagatcaaactggtactaatcctctggccccagcatcccatccttggggaaatagtctagtttagaggtagtcctggactggagcgctaagtccagcattcctcacctgcataacactacccacatgatcatatgtcccctgggctctcaagctgataggaaaaagtcgtcttgctaaatgaaatcccccaacctcttggtaatgtgaagaactgtactgcaaagctttgaagcaatcctatgttaggcatgcgggtgggaacggggccagacagagggaaaaaatggaatagaatgatccgagagtaaataattcttgctttattatgaaccaagtcacattttgtctcttccaacagatgcttgagccaaaaaagcaaacataggcagaaatacaattgagaatatcttcatgtttcaacctttaatctgacttgccttttactatcctttccccatttcttctaatctcttttgccttacaatatattaccttctaggtatcacctcatcctatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtatgtttgctaagtattcaagaacatccatgattatagtaggttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttccatttatacatgaatttctacagtgagctatttaaggtggtagaaatcattttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaa

SEQ ID NO: 2239 - DNA, 25704 bp, Homo sapiens
cttcttatttaaaatattttaatttctaaaaagcttaaatcatattaaaatttaaacaatttcattgtacagtacttgacaatacatttcaacaaactgaaaggcaaaccagtaaatcagttttgcttactttctaagcttaataatgtacagactcttgctcttcaagaagatgcaaaaatcagcaacagtacaagtgaaatatttaaataggaatctgaaacaaaacgaattcaatctgatcaaatccacaattaattgaagttttcattttattcaattgtgaataaaatagcagacactgtttcatccaataagccaatgatatcagcttaggagaaatgatctgcctggcttgtgcaagacaagaacagttaccttctgctgaaaggatgtgagttttcaaatttggttttcatgtcatagtttccaaataaatgaaccgctccaccaaaaacgacagtctagttgctacctatcttccagggtttcatcatacagccatttataagcacaatctttggaacgctctatagtttcaaaaagtgttttgaagtcttgagggtgcatgttaactactttctcatcctcctgttttcctatttgcatcaatatatctctcgcatcaagtggagtcaatgaactgcaaaagaaatacaaagtaaatgtacttaattctttctcatgcatctatcagttcacggtgacagaaatggcttctaagttgaattcaaaatgtctaacttaggcatacagagtgctataatggacacgggagaatcagcagggaagaggatgggaggagggtgaaggatgggaggagggtgaaggataaaaagctacctactgggtacaatgtacactatttgggcatgggtacactaaaagcccagacttcaacaatccatccatgaaaccaaaaaaatcacttgtattcctaaggctattgaaataagaagaaaaaaaaaagcctaacttattatatataagcaatcttatttagtttaagagcttccagtaactttatgcttatttctaaagtttcatagctaacctataatgaaaatattaatagcaggtttaggctttcacatactctaatcaatttttacaccgaattctagtttaatcactgccgtttgaaaaaattattatgcctacctctttcatccttttcctttctgcaaaaaatattcttaacttcttttggttcatgtcaaagttcagtaactataaacagcagaagttgctgtttggcagtttacaaagagggaatcatttttcacattttgatgtaaccatcattggtaaatacattataaagccgcaaacttccttatacagtcatgcattgcttaatgatggaggtatgtcctgagaaatgcactgttaggtgatttcattgttgcttgaacatcttacagagtacttaacccaaacctatgtgatatagcctattacagacttaggatatatggcatagcctattgctccaaggatacaaacctgcacagcatgttactgtactgaatactgtaggcaactgtaacacaatggtaagtaatagaaaagatacagtaaaagatacagcatctttataatcttatgggaccactattgtacatttggtccactactgactgaaacgaggtataacgaacacgcctcattatgaggtattatatatataaggtatattatataatatatatacaatatataatcaatgaggtatattatataccataatatgaggtacataactgtgtatcagcttagcaacaaaccatcaataagcctccaacaacaacaattgtaaaaaaatattttgggctgggtgcggtggctcctacctgttatcccagcactttggggggctaggtgggaggatcatttgagcccaagagttcaagactatcctgagcaacatagtgagaccccatctctacaaaaatcgtaaaaagttagctgggcatagtggtgggcatagtagtcccagctactcagggaagaggctgaggcaggatcacttgagcaaggggtttgtggttgcagtgagctatgattgtgccactgtactccagactgggcaacagagtgagactctctgtctgttcaattccaatactttttgatattgaatagaatcttggtaacatgtttctagtccactgagattaccaggagcatttttaatattttgcactatgatttacaacatttattccttatttccctattttcttgatattttcattcaaaatagccacaaggtggcaagatgaaaaataatagattgccttttattagtctattgccttttactagtctattaccacttttttttttttttttttttagagatagagtcttgctctgtcacccaggctcatctcaaagtcttgttggcgctctctgcctcccaattttttttttttttttttttttagagacaaggtcagcttgctctgtgtcccacactgcaatgcagtggtgagtttatggctcactacagcctccaatccccggcctcctcaagtgatcctcccaccttggcctcacaaaaatgctcggattacaggcatgaaccactgcacccaggctattgccacttttaacatttatttttagataaatattgtctagtcaacagctcattcagagttaaatattaaatgatcaaatttgttaaaataattattttaacattttacccatcctctggcgagactttgaatgactatgggctgctgattacaaggcataatgcacaacttacagggacgtatgcatcagccctacatacaaattacatggatttatgtacaaattacacagatggctgggcgcgggagctcatgcctgtaaccccaacactacttacagagatgtatgcatcatccctacatacaaattacatagatggccaggcgcagtggctcatgctggtaacctgagctgtacttacagaagtgtgggcatcaggcctacacacaaattacatggatggccaggcatggtggctcccgcctgtaaccccagcactacttacagaggtgtgtgcatcagccctacatacaaattacatggatggccaggtgcagtggctcatgcctgtaaccccagcactttgggaggccaagcaaggtggattgcttgaggccaggaatttgagaccagcctgggcaaggtggcaaaaccccatctctacaaaaattggcatacaatttataaacacaaaatataaatataaaaattttatatttttacaaatataaaaattagccgggcgtggtggtgcatgcttgtagtcccagctactcaggaggctgaggtgggaggatcacttgagcctgggaggacaaggctgcagtgagctgagactgtgccactacacttcagcctggacaacacagcgagaccctgtctctaacaacaacaaaaaaatgtttttcacttatatagacataaagcaagtagtgttacttacaagctattatttttacaaagctttgggtaaaaacaaaatttgatccagagcaagggaaccagggtggtataattatctatccctactctggttaaggaacagaaccactgaagacaagcaatgagaggtaagtgtgggcacgcctccagtaatgctgatttctctccaccccactagtggtaggcagctagtgcttcctgtaagataaagctaagcccatactctcaaaaagattaaacaatctgggcatttttttaaagaaggaaaaataaatgaaactcaatgagagattatgggaaaaatatattttcctcaaaatgtacaccagggagaacaaattattttgaagaaatatgagggaaaacatggtacctcactctgtcaatcaagatataaaaatagatctctagcatgaaagaataatttgtgcatcgttgctactttatacttgcttttattctttttactcaccgtaagtggtctattacagtggcgctgcgcctcccaaaacagtgctttaacaagtgaaaaaatatattatagttcataggtgttaagttcttggtaaataaattttgacgaggaatcatttgaataagatacagcttttgttgtaattggtctaataattcctggagagaagaaaaaatgaattgcattagtcacaaaatattgccagagtaagacattgctcacttcttccttcaagctatctgctgaaagacacaatcaccacaggccctgagtgtcttcacattctctttttctttcttggagatagagtctcactctgtcgcccaggctggagtacaacggcgtgatctccactcactgaaagctccatctcccgggttcatgccattctcctgcctcagcctcccgagtagctgggactacaggcgcccaccaccacgcctggctaattttttgtatttttagtagagatggggtttcaccgtgttagccaggatggtctcgatctcctgacctcgtgatccgcccgcctcggcctccccaaagtgctgggattacaggcgtgagccaccgtgcccggcccacattttcttattgtgtacaccaagaacacaaagccctaattggtctttaccaatgaattgggccatttctcagagttgtttgtgatgagtaaccttgagggaggagataacgtctctctccaggacaaagagcaggcctgtggctgggtgcagtggctcatgcccatgatcccagcactttgggaggccaaggcgtggatcactcgaggtcaggagttcaagaccagcctggacaacgtggcaaaaccccatctctataaaaaataaattagctgggtgtggtggtgtgtgcctgtagtcccagctactcgggaggctgaggtgggaggatggcttgagcccaggaggtggaggctgagagcatgccactgcactcaaggctggttgacagagccaggccttctcttaaaaaaacaaaagggcaggcttgcttaatgtttgctatgaaggaggaggattcattgggaggctgaggtgggcagatcgcttgagcccaggagttcaagactagcctggacaacatggcgaaaccctgtctctacaaacagtacaaaaattggcagggtatggtggtgcatgcctgtagccccagctacttaggaggctcagatgggaggatgcttgagactgctgcgtggagtttgcagtgagccgagattacgccattgcactccagcccgggtgacagagcaagaccctgattcgaaaaaaaaaaaaaaaaaaaaaagacctagattcccccagctctgtacttctcagctgcaaagcaagtccactaaatgcaaggcacccaactgagccacctcacatcactccatgggaagagaggcacagaacatcctctgtctgatccaggagtcttaggccaacatccgagaaacagtaacatttattaacatgtaagtagggtaaaatcaaatcccagacatgaggccgggttgctcacacctacaatccaacactttgggaggccgaggcaggaggatcgctggagcccaagagttagcgaccagcctgggcaacacagggagactccttctttacaaacaaacaaactagctgggcgtgggatgcacatctgtggtcccagctatttgggaggttgaggtgggaggatcacttgagtcccgggagtttgaggctgcagtaagccgtgattatgccactgcactccagcctgggagaagagtgagacactgtcttttaaaaaaagaaaaaaaaataggctgggcgtggcggctcacgcctgtaatcccagcactttgggaagccaaggtaggcggatcacctgaggtcaggagtttgagaccagcctggccaacgtggttgaaaccccatctttactaaaaatacaaaaattagccctgcgtggtggagcatgcctgtaatcccagcattcgggagggtgaggcaggagaaacacttgaactcgggaggtaggggttgcaatgagccaagatcatgccatcgcactccagcctgggtgacagaatgagactttgcctcaaaaaaataaataaataaaaaataaaaaaaggaaaaaaaaaaaaacccaaacatggcattaacatatattgagtccttgctatattcaagataaaacatcaccatcggatccaaaggacaaaaaaagttattgactaaaatttttaatcggatatttaaaaagtaggtctcaaacaaaacttggatagaaatgacaggccctaaaaacctgttaaatgtctcaaactgcttccatagcaatatgagcaccttgatatcaaagacacatgtgaaatatctaaaataaattctgtcataaaatatgacatttgcttatttcatcttcatccctaaaagtttatatatgtatatatacacacacacacacacattttttttttttttttttgagacaaagtctcactctgttatccaggctggagtgcaatggcatagtctcagctcactgcaaactctgcctcccaggttcaactgattctcccacctcagcctcctgagtagctgggactacaggcgcacgccaccacacccagctaattcttgtatttttagcagagatggggtttcagcacgttggccaggctggtctcagactcttgacctcgtgatccacccacctcggcctcccaaagtgctgggattacaggtgtgagccaccacgtccggccaagtttatatttttaagttggccaaaaaaacttaagcttttcagcttcttgctgaaaaactgagaaagtatattatatacaggattgttcatttgtggaatatttggataagtccccaatagtatccaaatgtactgtattagacaaaatgcattattcctattctgttttttgggactacataaatatgctgtataaatagtcaaacagaactaaaagcacaatgatgactgatcactctaaaatcacaacattgaaagaaaactgataattttctttttcctttagtggcaagtgtgagaaaaaaacataagtaagcaaacaaacaagatcttcagactaagctgttatgctgagattaggccattgttagcatttaattcgttttttttttttttaagccccaaaccttaaagacaggcatctaattctaaagtgaaacttctgaattgagtcaaaaaattgttttgtgaaactttagctactttattagaatttcacaactagccctgagataaactaaatggaggactataacattgtcactttggttcttacgtacaaagattaaaaaatgaacaaaaataaaggcctaactcctgggtaaaaatcaagaagtacctatcagtgaattcaaccatgtaataagagtagtaatatcacaatttttttttttttttttttgagacagagtctcgctctgttgtcaggctagagtgcagtggcacgatcttggctcactgcaacctctgtctgccaggttcaagtgattcttctgcttcagcgtcctgaatagctggaattacaggcatgcgccaccacacccagctaagttttgtatttttaatagaggcggggtttcaccatgttggccagggtggtcccgatctcttgaccttgaatatcacaaatttctaatcgattaatacgtcataaaattttgtttctaattaatcgaattagataaatattaaaatgattttattttccaaatttgaaatgtaccttcatttcaaaagatataagaagagaactcagattctgtttttaagcctattactatgctagcatccattgtataacagctgataactcttccaaaatacttttgattcattaaaagtagtaagatatgtttaaagaatgtttctagatattttaaaattaaaaagttaaatacagactaccaaatagtcctaaaaaaataaaataaaaaatacgtcacgtagggagaaaaaggaaaaggtattattttattcttaccctacgctttgggttttccagcggccctttccgggtgtatatatcaaatgatgaccaaggctcctggggaagaaaaacaaagcaaaacaacatcttttatttctctttggtcaaagtgccccagttattacttccttaaaaaacaccttgcctaaataagagaatggtcagtctaattggatttaaaagaaacatgttatagctaaataatacacatctctctccttaatttttttaaagaggaggaggatcaaaagtctacccaaatactagtacctcttttccttattaaacatgacttcgcctgttatgcaattacgcaaataagtatttgttataatttttaccactcaatatttccatatcacagtcagaatcagcagtttaagggatattagattaatgctgaggatttctttttgccctacttcagtggaaaagcctactaatcaaactatttgaatatgttagaacatatatggaaataaacaaataaagatactagtgtcgaccaggtgctgtggttcatgcctataatcccagcactttgggaggccaaagtgggagggttgcttgagcctgggagctggagtttgcagtaagccactgtactccagcctgggaaacagagtgagaccctatccaaaaacaacaataacaaaaacctagtgtcaattttaaaatggatcactatttttcggtatctatcttttgtaagagaattttgtgcataaggcaattttaagagatgatccggtcaggcacagtggctcatgcctgtaatcccagcactttgggaggctgagggaggaggaccgcttgagctcaggggttcaaggccagcctgggcaacatggtgaaaccctgtctcttcaacaaatacaaaaattagctgggtgtggtggtgtatgcctgcagtcccagctctttgggaggctgaggcgggaggattgcttaagcctgggaggcggaggttgcagtgagccgggattgtgctggtgcactccaacctgggctgacagagtgagatcgtgtctcaaaataaaaaaccgacccacctgaaaaagtattctctattaaaaaaactatacatacccataaccatattaaattccaaaataagagtgggttaaaatagatctgacataggcttaaaagactaaacaatattgaacacaaggtctgaaaggctactgtcaagtaacaatttattattaactgcaggggcaatgagagtggctaaaacatataattgtggccaaattgtgaaattcctagcagttccaggaatgtcactttaagtgggggaagaaaagcaccatcagccgtgcacaatgagtactgccacttcccacacgcctggtcgagcctcaacagctttcccctcatcaagcacagtggaggaaaacctgcaagacactgggaattgacttcaacaacttactctacagatgtagacacacagtggagcaagtgctgagaaacgttaggtccagaaagacctttcctttctggagtttagtaaatggcaaaacctaacacgggacctttgaaagcaaatactaagggaacaagaagacgaaaacattctgcaagctaaagtcctcagagggcctctctgaagaaactagctgaaagctaccaggacagaagacttgagatgaaagtcaacagaatgagacaagatcagtgggtaaggaagaattttagagaaaccaagaactatagtactgagagtacaatatacagtgcaggcagaaagcagaatcagtgatgtgaagactaagtgtgaagagattctgggaatggagaaaaatgatgagagcatgacagacacgaaagacaaggatcagagatccaacctaagaacctcaaatgtttttgaggggaaaaaaaaagaattggaacaaaagctaaaatcaaatgagataacattcctgagcttaaaaaaaaaatacagcaaggtgcagactgaagacctcagcatattctcaggcggaagcagtgacgagaacacgtgaagatccacattgtaaatatttaaaaattagagccagggccaggcgcagtggctcacgcctgtaatcccagcactttaagaggctgaggcgggtagatcacctgaggtcaggagctcaaggccagcctggccaatgtggtgaaacctgtctctaccgaaaatacaaaaattagcaaggtgtggcggtgcacgcctgtagtcccagctactcgggaggccgaggcaggggaattgcttgaatacaggatgtagaggttgcagtgagccgagatcgaaccactgctccccagcctgggtgacttgagtgagactccatctcaaaaaataaaaaaataaaaaatagagccaggtgcagtgggtcatgcctgtaatcccagtgatctgggaggctaaggcagaaggatcacttgaggccaggagttcaagaccaggctgggcaatattcttaaacattttaaaacttagccaggcatggtggcgcctggctgtagtcccagctactccagaggctaaggtgagaggatcacttgagtccagtagttcaaggctgcagcaagctatgattgtgccactgcactccagcctgggcaacataatgagaccctgtcgctaaagaaaaacgtttttaaacagaaggattttactcaccatgtgcagaaccttaatctcacaagctaattgccagataacacttaatacatgatacaagtctggatttccgggatctgccattagtttctagtaaaaggaaaataaaaattacatgttatacacatctataatcaattaaaaacaaatgctgactcttaataggactatcttaatggcatctagacatttaagaaaagaaaactagaattagatgcaaaaagccgggtgcagcggtgcacgcctgtagtcccagctactcgaaaggctgaggcaaggggactgcttgagcccaggcatttgggcgttccgtgtgagatgatcgtgcctgtgaatagccacagcactccggcaggggcaacggcagggcacgcggggtcacgcttgtaattccagcactttgggaggccaaggtgggaggatgcttgagcctagaagttcaagaccagcctgggcaacatagtgagaccgcatctcttaaaaaacaacaacacacaagtgttaaggctgacttgaaaggacgaggttacctcaacgaatgggaaggcactccgcagacaagaaaccacatgtgaaaaggtccacggcaaaagaggcatgggccagtggaatataaccctagcagcaggaatctaacacagcacttcctattcttctccttgtctttcctttgttgaatagcgtatgcacagccccaaggtcctgaggccctcgctgtctttccatggctagcaaatatgtatttactaaatgggtctgggggagcaaatcatcccttcattttttgccccactatcctaatccatagcaatacaaataagcattataaaaatcttaatcttctttgagtcttaatagtactatcttaatagcatctagaaatttaagcagagaaaactagaattagatacaaaaagctgggtgcagtggtgtgcacatgtagtcccagctactcgaaaggctgaggcaaggggactgcttgagtctaggagtttgggggttcagtgtgagatgaccgtgcctgtgaaaagccatagcactccagcatgggcaacacagcaagacaaacaagcatttcccgtcaaactggattaacagatcaataacatgaaacattctgggcagaaaagaaagatgacactcatagcgagatcaaggttgtcaggaagaccttccattacagagaattgaactagagtctcaaatcttaggctcggtgtaatggctcacaactgtaatcctagcactttgggaggccgaggcaggagaatcacttgaagacaggagttcaagaccaccctgaacaacacagcatgaccctgtcactacaaaaataaactacctgggtgtggtggtgtgcacaggtggtcccagctacagggaggctgaggcaggagtgtcacttgagcccaggagtttgaggctgcagtgagctatgaacataccacgacattcaagcctgggcaacagagcaagaccctgtctctaaaaaaatttcttttaatgttttaaagttaaaaaaaataattataataccccttaaatattaaaaaaaaatcctgttaaaactaataaattcagctgagtatggtagctcacacttgtaatcccagcattttgggaggccgagggaggaggatcacttaagcccaggtgtttgagaccagcctgggcaacaaagtgagacactgtctctatttaaaaacaaagggagggaaaaaaaacctggctgggcgctgtggctcatacctgtaatcccagcactttgggaggctgaggcaggcggatcatgaggtcaccagtttgagactagcctgaccaacatggtgaaaccccatctgtactaaaaatacaaaaaaagtagctgggcatggtggcgcgtgcctgtaatcccagctattcaggaggctgaggcaggagaatcacttaaactgggaggcggaggttgcagtgagccgggattgcgccactgcactccagcctgggcgacagagcaagactccgtctaaaaaaaacaaaacaaaacaaaaaacctaataaattcagcaaagctgcaggatacaaaaatcagttgcatttttatgcactaccaacggacaattcgaaaaacaattccatttacaatagcaccaaaagtaacttaaaagctagtaattaaaaacacaaataaatggaggccaggcacagtggctcacacctgcaatcccagcacctcaggagactgaggtagaaggatcacttgaacccagaagttcaagaccagcctgagcaacgtggtaaaaccatctctacaaaaaagacaataatcagccaggcacgggggtgcacgcctgtagtcccacctactggggaggttgaggtggaagcatcacctgagcctgggaggtcaaggcttcagtgagctgtgatcctgccactgcactccagcctgggcgacagtgagaccctgtgtcaaacaaaaatgaaaacaacaacaacaacaaaacccacaaataaatggaaagacatttcatgttcgtggattggaagatttaatattgaatactgttaagatgccactaccacccaaagcaatctccagattcaacgcaatccctaggaaaatcctaacgcattttggagaaacagaaaaatccagcctaaaatccatatagaatctcgaggaaactcaaatagcctaaacaatcattaaaaagaataaatttggatgaatcagcccctgatttcaaaacttaccaaggtaacagtagcaacacagtgttgtcttggcctaaggacaaatatttagatcaatagaatacaatagagcccagaaataaacgcgtacacatatggtcaaatcatttctgacaccaacgccaaagccatttaatggcagtaaagaacagtctttccacaaacggtgctgggaaaactagatcaaagaatgaagctggacactgaaaccataagcaaaatttactgaaaatggatcaaagacctaaacaagagccaaaactataaaactcttagaagaaaacacaaggaaaccttcacaacactggatttggcaatgatctattagctacgacacaggtccccaatccccgggccacgaactgataccagtccgtgtcctgttagaaactgggccacacagcaggaagtgagcggcaggtgaacaggcgaggcgtcatccgtatttatagccgctccccaccgttcacatcaccgcctgagctccacctcctctcagatcagcagccgccttagattctcataggaacacaatccctattgcgcatgcgaaggatctgggttttgcaagggccttatgagaatctaatcccgatgatctgtcactatctcctgtcacccgcaagtaggaccatctagtttcaggaaaactagctcagtgttcccactgattctacattatggtgagttgtataattatttcattatatattacaatgtaataataatagaaataaagtgcacaataaatgtgatgcacttgaatcatcctgaaaccatccccgccgccatccacgtaaaaactgtcttccacaaaactggtccctggtgccaaagatgttggggaccgcccagctacgtatgataccaaaggcacaggcaacaaaagagaaaaaaagacaaagttgacttcatcaaaatgaaaaactttgggcatcaaaggacacaattaacagggttaaaaggcaacccatagaatgggagaaaatatttgtaaatcatgtatgataagagattaatatccagaatatataaagaactcttaaaactcagcaacaaacaaaataacccattaaaaatgggcaaatgtcttgaacagacatttcttaaaagatatacagtcagtacgtacataaaaatatattcaacatgactaattattaggaaaatgcaaatcaaaagcacaatgaaataccacttcataccattaggagaggtattaccaaaaacccagaaaacgactctcagtaatgctgtggagaaatcggaacccttgtgcactgctggtaggaatatcaaatggtgcatccacgacggataacaaacagtatggcagttcctcaaaaaactaaaaatagactgggtacagtggctcatgcctgtagtcccaacactttaggaggctgaggcaggaggactgcttgagtcccagagttggaggccagcctgagcaacatggcaagaccctatcgctacaaaaagctgggcctggtggtgtgtggctgcagtcccagcttgggggctgaggcgggaagatcgcttgagcccaggaggtccaggttgcagagagctgtgatcatgtcactgcactccagcctgggcaacagggcaagaccctgtctcaaaaaacaaacaaacaatcaaacaaaaaacaaaaaacccacaaaaaactaaaaatagaattactatatgatcctgcaattctacttctagctgtacactcaaaggacttgaagagatattggtaaactcatgttcattgcagcattattcccaacagccaaaaggtaaaagcaaccaaatgtcattgatacatcaacacacaaactgtagtatatatatacaatagattttttttttgagacaaagtcttgctctgttgcccaggctggagtgcaggggcatgatctgggcttatagcaacctcctcctcccaggttcaagtgattctcctgttttagcctcccaagtagctgggattacaggcatgcaccaccacgcctggctaatttttgtatttttagtagagacagggttttgccatgttagccaaactggtctcgaactcctgacctcaagcgatcagcatgccttggcctcccagagtgctgggattacaggagtgagccaccgtgcccggccagaatggaatattattcagccttaaagaggaatgaaattctgacacatgctataacattgatgaaccttgaaaacattatgctaagtgaaatacgccagacacaaagaaatattgtagagtaaacttacatgaggtaaagagaatagtctaattcatagagacagaaagtagaataatgattactaggggacgcaggaagagggaaacgagagtttgtgtttaatgagtacagagttttggtatgggatgatgaaaagttttggagacagatgatggtaatggctgtacaatgggaatgcagttaaaaccactcaactgtacactgaaaaagcaacctgagcataagactgctctgcagaatttaaaaacaatcttagaccctcaaatgtcacgagccctaaattaaaatcgcacagattaagagtactcagagaaaaattacagactcagaacaaaaaataggtatttgttaataacatacctggaattctttttcaccaataaacatatttacttctattcgtccaaatttatatatagaagtacaggaatacaagtcatatgcgagtttccaaagtgcccttttctcacctctacttgggaacattccaactacttttaaagggatgtctgttaggaatataagcaaaaagatttgaataaagttcttagcattttgtcctatgtccatatttttttgagacaaactaagttaacaaactatattaatttcaagtttatttcaattaaaactaagcctcaatatctttccttggcatgaaacttggcttttggggaaataaactgggtacctgtgtccaggtgaggtaaatgccatattcagagtcagagcatctgctcataaactgtattaatataatataaattatacacaaattcggcggggtacggtggctcacatctgtaatcccagcactttgggaggtcgaagcgggcagatcacttgagggctggagtttgagaccagcctggccaacatggtgaaaccccgtctctaccaaaaatacaaaaaaataaccaggtgtggtgacacacacttgtaatcccagctactagggaggctgaagcaggagaatcacatgaacctggaggcagagggtcagtgaaccaggatcgcgccactgcactccagcctgggtgacagagtgagactccatctcagaaaacaaacaaataaataaaacacaaatttcatcaacaaatcagttatactgctagagacacctggcaaattctaggtatttgctttagtaaattccaaaaatgacctgctgtccaaggaactgcttctattcccaaattcttaaagagccctcgagaagacatagcaggtggttttattactccaccacttctaggatctagtttaaagaagtcacagtggatcactcgtagttttccatccagattttttcctaaggactaaagagagacaaagataacacgttaaaaattttcagcattaagtatactttgcagcaattcaaaaaactctacttcaaaaaaccataataaaatgtaaaaataaaaataattcaattacctggggtttttttgttttgttttgttttgtttttgagagacagagtctcgctctgttgccaggctggagtgcagtggcgccatctcggctcactgcaacctctgcctcctgggttcaagtgatcctgtgccagcctcccaagtagctgggactacaggtgcgtgccaccacacccagccagttttttgtatttttagtagagatggggtttcaccatgttggccaggagagcctcaatctcttgacctcatgatacgtccaccttggcctcccaaagtgctgggattacaggcgtgagccaccacgcccggctgaattacctttttacaaaaaatatttctacctccataactatgtaaagaaaatattactaacatacccaaaatttaacagaggaagtaaaaatcaattaatacctgaaaagtggcaaaagtacaatattaccaagaaaaagccccccaaacagaaataaactatcataaatttttctttatctgtttactttttttttttttttgagacaagctgtcaaccaggcaggagtgcagtggcgcaatcccagctgactgcagccttgacctcctgggcttaagtgatccttccacctcagtcccacaagcagctaggactacaggtgcataccatcacgccccaccaatttttggattttttgtagcaacagggttttgccatgttgcccaggttggtctcaaactcctgagctcaagagatctgcccaccttgacctcccaaagtgctgggattacaggtgtgagccactgcacccggccccacttactttctttatcataatggcttcagctattcaaaagcttttcacaccactccctgcctgcttagtagtggttacctgaagcactgggcaaagattctgacaccatggttggcctcttacagagaactgtgagccatctgctttggtcatgggaagaaaaaatgaaagatgtttcacagtaaagaaaaacaattaaaatataaaagtgaaaggcagatggattcaagagaatatctttcttctaggggaatctagtcagctatccaccaaataaatgaacttagctcatctccataattttcatttactttttctaaagacagaagcaactatacaccttgtttgctggaagaggtctaatatatctcagtcttctcactgctctgatttgctcatcttgcagtagtactagagaccttcatagttagggcaagaatcagttatagactccataaacttaattcgaagttacaaaaaaaaaaatcagtaagaaggcattatgtttttaatgtgtacactgatgtttctgtgcacagaaaattctattaatatttattaaggttggaaatgatgtaacttaaagttattaatgcaaacacctattttttcttaagcatttgtattcaacctatattatcctatttctaaatctagtaaaatactttttcttcttattttttattgagatgagtctcactatgtccccaggctggtctccaactcctggccttaagtgatgctcctgtctcagcctcctaagtgtctgggattacaggtgtgtgataccgtgtccagctcaaaatgtagtaaattttggccgggtgcagtggctcacacgtgtaataccagcactttgggaggccaaagagggcggatcacacaaggtcaggagtttgagatgagcacggccaacatggtgaaaccctgtctctactaaaaatacaaaagtaagccaggggtggtggcacacccctgtaactccagctattggggaggtgaagtgggagaaatcgcttgaacccaggaggcaggggttgcagagagctgagattgcaccactgcactctagtcagggtgacagagtgagactccatctccaaagtaaataaacaaacaaatctagtacattttaacaatcactttcaaggggaagttttaaaaagactagaggaagggaaagactgggggtggaaatcatacacatttggtcacattaatttcgagatgcctactatgtgatctaggtagaggtgccaggtaggaagttgcagacctgaataaggtgctcagtggagtggtccagtctgacgatataaatgtgtgggaatttggcttgttgaaggtaatttaagtcaggggtctacactagggagaaacagaggactagccctgaaggtagagtatgtccaaagtctaatgacaagaaactgagaatacaactaaggaggaaaaccagaagagtgtggtgtcatggaagctaaaagaaagagtacctacctaatgcatacgattgtcagtcaacacgcatggcaaggctgtctaacctgtggcctgagggccgcatacagcccaggacggctttgaatgtggcccaacacacatttgtcatctttcttaaaacattatgagatgtatgcatggactttttttttttttaagctcatcagccactgttcttattactgtattttatgtatggcccagacagttgatgtttcagggtggcctaggcaaaccaaaagattggacacccctgatatagcattaacataatctttcaagttatcaaaaaggcagtttaatctttgtaattaaggaaagctaaacagcacaggtgtggtggctcatgcttgtagtcccaggagtttgagaccagcctggacaacatgacaaaaccctgtctctactaataatacaaaaaatcagccaggtgtgggggcgtgtgcctgtaatcccagttgcttgggaggctgaggtgggagaatcacctgagcctgggaagttgagactgtagtgagctgtgactgcagcactgcactccagcctgggcaatgggagtgagaccctgtctcaaaaaagaaaaagaaaatgtataaacaatgaacactttatggcctcaatacacttgtatgttctgagagggcaccatacattcttgctttagcacttgtcagttaacactcaacaattcaaacatgataataatcaaagcttcaggataaataattcaattcatacaacagatcacatttaaaaattcaactggattgcattaggattcaaaaacagaatgggaaaaaacagagaaaaggcaagtaacccttgagtttttactagtcattaagttaggtacttaagttagtcattaagtttgtctcatttactgggtgcagtgggtcaagcctgtaatcctagcactttggaggctgaggcgggcggatcacgaggtcaggagttccagaccagtctggccaacatggtaaaaccacgtctctactaaaaatacaaaaaattcgtcggtcgtggtggcggtcacctgtaatcccagctctcaccactgaaactcctttcagttttcaggaacaaactttaggtggccagaagcattatccgctaagcgcagcactttaagtccctgacttagagccacaagagttctgcttacctattgttacttctcttttcactctggcaaacagattaattcacacaaaattttatttgaatggcttttcaatttatcataacaatggttactaaaaagtgagagaatatgtactaagggttgagtacaagtcagtgctagtagaaaataagagccttaatagagaaaaaactagttctaatcaaagactggatttagtcaatgatgtttatatttttagctgacatttatagcttcagaaacattttgttattgatattcctatcataattattgtttcaaaaattctctagtccctaaccttccttttttcattaaacaattgttttaaaattaaactgttatcttgaaggttttttttttcttttgagactgagttttgctcctgtagcccaggctggagtgtaatggcacgatctcggctcactgcaacctccacctaccgggttcaagtgattctcctgcctcagcctcccaagtaactgggattacaggcatgaaccaccatgcccagctaattttttgtatttttagtagagatggggtttcactatgttggccaggctggtcttgaactcctgacctcaagtgacctgcccgccttggcctcccaaagtgctgggattacaggcatgggcctcggtcctcagccttgaagatcttatagaaaaaagcaactactgtgttacagaataacaaactttaaatagaaacaaagacattttaatacaatcttaattactttgtgaatatgtagattaacctttaaatataggcttttttttttcctcaaatcaggataaaagttatcttctcatttttaatttccaagttgaaactacagatgactatgtttactgaatcacatttcaggatcttaaatcttcggacaattatgtgttttttcttcacatttttggaactccctcagatttaacatcaattaaataacctagctaaaaccttgaactcttttcaaaacagtaagtggtagaataacaataatttcatactcatagttttaaaagaattaaacaactggatttgacagacattttcacaattttttgttgtcatgcaattttggatacagccattctgcatggtttcacaaagttggcatagagaaatataagtttcctaagttgaaacggaagattataaaagagggaaggagaatgagagtaagagactggttaaagacccaaaggatttccacttcttcattgttacgtaaatgtgtctgctttttaagaagcacaatcactgaaaaatctatttggatgatgccttcactctatgcaactgtatctgactacaggctgagcatccttaatccaaaaattctgaaatgctccaaaatgtgaaactttttgagtgtcaacatgaagccaaaagtggaaaatttgacacccgaccttctgtgacaggcttgcagtgaaaatgcaggtatacaacacgaagatgaggtcagtctataaaaatcgaagggagtcatctaagacaaaaaccactgttaataaggcagatgactccatagggaacttttttttttttttgagacaaagagtgtagctcagtcgcccaggctgcagtgcagtggtgtgatctcagctcactgcaatctctgagtcccgggttcaagcgattctcctgcctcagcctcccgagtagctgggactacaggcatgcgccaccacgcccagctaagttttgtatttttagtagagacggggtttcaccatgttggtcaggatggtctcaatctcttaacctagtgatccgcccgcctctgcctcccgaagtgctgggatgacaggtgtgagccaccgcgcccggcccacaggaaacatttttaaaagccggccggcagaatgtctccttagccttgacggacccgcttcctggtccctcagctgcttctgatgtttcttcttaagaaaaaataaaatgtggtgtacagtaacctttcaatgaaaacacagcatcccaggagactgaaagcctgccgctgtgtgtttccactgttcaacagctgacacagggattctgatgctgctgtgctgcttagtttctctgaacacactttttttttttttttttactgtactaatggtatgtcattttttctactgttaagcactcatgtgtgaataagtgtaagaaaatgatggcttatcagaagcatataaattcggagtcaggagctaggcatggtggctcacgcctgtaatcccagcactttgggaggccaaggtgggtggatcacctgaggtcagcagttcaagaccagcctggccaacatggtgaaaccccgtcactactaaaaatacaaaagtcagctgggcatagtggcgggcgcctgtaatcccagctacttgggaggctgaggcaggagaatcgcttaaacttgggaggcagtggttacagtgagccgagatcgcaccattgcactccagcctgggtgacaagagagaaactccatcttaaaaaaaaaaaaaaagtcagggatgatgacgatgtcaaacaaggagattgttcacatgggtgggtgacatagtgacacctttgctttctgatggtccaatgtacacaaattttgtttaatgcacaaaattatttaaaatattatacagaattgcctttaggccttatgaataagatgtatatggaacaaaaaaggaatttttagactcgggtcccatccccaagatatctcattatgtatatgcaaatattgcaaaatatgaaaaaatttgaaatccaaaacagttgtgttcccaagcatttcagataaaatacttaatttgtatgccaacctttcttgcctttcaaaccctaaatatagaggttacacagatccattaacctaatattagcacttattccaattagattccaagctcacagaagaaaggagcacagcgcagcttagtagaaatggggaaacaagcctagggatgccagttatacgctttgttcaaagtcacccaactaggctgtagccgacctagaactagcaaacaagtcttagaactcctcatgtttcagccattcaacagcactgaatattaactgtgttctagtctttgggaataaacaagatatttcagagatggctccctaaaagatattctatgtaaaacactgtgtgcttaattccatttccttaaaccactcacagatagttgaacaaacaataacatacgttgagaaactaaaaatatacctccaaatgtggaataaaagttttgtcactttcgagcgcaaccactttggcaccagcttcaagtaatgcctgagtcaggattccaggacctggcacattaacagaacgaaaagtttatttgtacaagaaacataatctctttcaataccaaactttcattagatgtttcacacgttattacctggtttttaaatctgacagcatccgcaaagtagatgtcactctcctttttacatataaggaaacaggagattatatatacttatttgactccagcgtcaaaagtgatgcagcttggctttgaaatcattgtcagcgactgcaaaacctgcactcttttttttttttttttgagacgaagtctcactctgtcacccaggctggagtgcagtggggcaatctcggctcactgcaacctctgcctcttgggttcaagcgattctcctgcctcagcctcccgagtagctgggattacaggcgcccgccaccacgcccggctaatttttgtattttaagcagagacggagtttcaccatgttggccaggctggtctggaactcctgacctcaagggaaccactcgcctcggcctctgaaagtgctggattacaggcgtgagccaccgcaccaggtcaaaacttgcactcttcatcaccatgattcactacctcttagaagaaaaaagtcacagcaaaatagattgcctctagcctatcacttcctcacggactacacggatgctttaaccatcaaagagattgtcaagcctaaacagaactgactccctgtgatatgaaatggtgctttaaaaaactatcattcaaaaagcctataaatcttgtgttcttagcatcctgctatggtctatagggaatgcacggaagaataagataacatcattttttcagctggcagaggcttgcaactcttttggggagataagatctaagagcatgttttatcaaaatattgtgtaaagtgcaagctgctacagaaatactttgtggtgtcattaacgatacagactctacgcttatgtagtgggcaatctctccaactaaggagcttcaaacaaagacccgtatctggacgggcgcagtggctcacgcctctaatcccagcattttgggagacctaggggggaggatcacgaggtcaagagatcgagaccatcctggccaacacggcgaaatcccgtctctagtaaaaataagaaaattagctgggcgtggtggcgcgcgcctgtagttcttgctactcgggaggctgaggcaggagaatcgcctgaacccggtacgcggaggttgcagggagccgagatcgccccactgcactccagcctggcaacacagcgagactccgtctcaaagcaaaagaacaacaaaaaagaccccccagtatctaaaatagcaccccgaggagggtcaatacgtttgaataaatgatgaacatccaagaaaatgcaattcagctggactcacctggattgcactccagcagtaggtgtggaggtctacttggttttcccaaatagatttgcgccagggtctcagccaatctccgatcggttacgtaacgcttaaagtctaagctggccttagacgccttccttggcggattcctgaaatccggttcgggccacagctgcggagaggagtcagagagcccacagtggttcctcgccggcaaatgctttcgcgtcgccgcttcagaccctaaaatgcaaaagcgaccagcgcccgccaaggcggagagcctcagccgccgaggaagcccgaccactgggatccacatgtccttgtctctcaggcccgctccaagaatcacctagtgcagctactacagtgaaccccacgcagggtatcccacgtggaacattttctggcgtccgggccaggtcaagcggaagtaaacactag

SEQ ID NO: 2240 - DNA, 8250 bp, Homo sapiens
gttatttctaacacttatgatttattctttaacaagaagggaaactttgaaaaggaactttttactttctacagtgtggatgtcagttttcaaatcagttggttcaatgtctgtgacacttcggggatgtgtggtttgagtccactgagctttgcgagcgactgcccaactggcttccaaagtggctgtgtcatgtcacatttccaccagctgtggatgagagtctccggggccccgaatgcccccgcccccagcattgggtgctgtcggtgtcgccagaggagtctccggggccccaggtcccccccccccccagcattgggtgctgtcggtgttgccagaggaggttcaccagccctccatcctgctgccccccacccatgggtccataccatgggtcccatgggtcagggagagcacttttcaccattgtgcatgattttgtttgctgccttctgtctcctcaggatccttctgggttctggccccacatgttctagcctggcccagagcttggaacctgggaggtcctcagtgcatggtacgggctcctccctgggccaggagagcccttggcagctccgtcatccctcctgggtgaagctggtttttgctctggggaagtctccatccctctggttcacttcatctctgctgggaccctgtggcccccataggcttacctgatgccatatcatttcctaaatattatgtgattcctcagtgtccggctcacctccaggtcaatctggtggataggttcagaggacctcttgcccttttctttcatgacctgtagggcatggccaggaggaggaagcagcctcagaacagatggaaggacccctgccccagatggcagtcagcccacagtcagcactcgtggaaggagggaaaaaaggaaggtttccttctgcagaaagctgctttttggcttgtttctgaagccagggagggtcaccagagctgagctcatttggggtgcctatgtcaccgtctgcccaggatatgcttctgaccaccccagccccaccgataagctgggctcgatgttccctccatctggagacctgggctcctgacacagcctggcctgtttgttgtgctctggctgagtatacctcatatttcccagggttctcaggcttggtttcctcaatgtttagcaggactgaccacacccagccccagaccttcaggagaatgcctttgtacactctggcagacaactgatctggtgacacaggccacagggtgacctcagcaaggaccagaccccaaggattctggaagtctctggttttggccccatgattcctcaatacaggtgaggtcaagctgggacagggtctctcctcccagggctgaaagagtgggtcagcactcagagtctgaactctgatctacacctgttccttcaccaggaggcttccctagccctgatctacggtggccccagccctggcatcagattccctcccagcaaggtgacgagcgcacgaatgggcagcaaagctggcgaccaggcctgctgtcgtctgagtaaggacagggtgctacccgctctctaagaggcagatggtgccagcccacagccaagggtgcctgtccccctgactctgcagacagtggttctgcaggcctctccctccccacattaccttcttgctcatcctatatttctgccattctcccagcatcttcagccacttttccatgtgtctcatgtcctgtcacatttgctgtcaaatgaggaatgttggagttagtggagccgccatgcttcccggagtggcccacggatgctgggtcctgggttctggagctctagtgggacccagctggaaggagctagggaagggcagaccctgggggctgagaccctctgagcaaatgagcgccagtgggctggccttgtgaccctgggacgtgccatcctcaggccacagacacaccagtcttaggtcgggtcacagcctctaggtggtatcctgacacaagcgggcagccacccccaagccacgactgttgttctcactttgaaatttcggcaaactgccagagaaacagagacttggggtcaggtccagcagggacagctgcccctcccagtgacagtatgttgctccctcccacccaccaccacccaggcccgctgcctcctctgcctcaccgaacacccactgagtccccatccctggaccagctccccaagcatcagggacaggctcttaccttcacctccagggcattgacagggggcaactctgtctcactggaaggcacctgacagagctgaggacctgcgcagggcctggagccatcccggtccaggagtccacccccagaaaggactggctctgtccccttccatcccaggtctcagctcgggagaagccacagggaagggaggacaagggccctgtggggcagactcccaggaggggcccctggtgtgggggatggtcaggctgcacaatggggctgcccctcctggactggaggtggtgttttctgctggagctcagaaacgtcagctctgagatgggactgctgctgcccagggtgggtggccacgcccggacgggagtctctcagggagtgaccgcatcaccctgctggggtttgggtgcctggcctgagacctgcctggtgcacccggggcccatcccacctgacactcccaaggtcctcgcagagtctgaccacctggagcccacctgcctctccctgcacctgagccacacaccctgctttttccctgatttccgccatcctgtccaacccaaaaactgtgaacgtctctccagccaccctgggtctgctttgactctggtcctgtcagaacccctgagtgagactccccggatctgttctcatgcctgccttgcctgctcgagagatgccaggggtggcctgggtgaccgagggccccacaggcttccaggacagcctcctggccccacctcctgcctcacctggctttcggagccattggctgtcagccctcagcctcctcccagacactgcagcagatggaactcgggacacctggccgttctccccaactatcctgcctgccccaggtcagtcccccgatcaccctctgcccactgtgctgtccaagccaactggaagcagagtccctggaaagccacgtagaatcttggggatggactgactccctctgctgagaagtcccaggtgagctggtgttttcagccccaccccatctattgtcctccccagacaatcagctccattggggtgcatttccgacgtggcacagcccatgggcttattcccatcccacctcccccagggtcctctgtctttccatcctgtgacccctgagggattggctccaggctgggctctcttatctggccccagataccgtcccagtaccagacccagggcctttagccacaagctctgctgcccgcctggccagaatgcctagaatgggggaccctgcccatcttctcccccattcccctaggcccacagccctcactgtccccatggggaagggcatggtccttgggggaaccatggcatggtccatgcggaagggcatggggacagtgagggctttggccctaggggaatggggagaagaagggcaggtgggcccctcagagacctgctggacagctgccccaaggctggaccaggtgccccctcaccctgtggccacaacccttggatctcactaggatagtgtccaagtggacagggccagaccctcaagctgcctgcctcctcttctgctaacttggagacagaactgctgagagcccaggggcctgacctagtcccctctccattcccacctgctccctagatgagcaacactccctagatgaaccacactccctagatgggccacgctccctagatgggccacgctccctagattaaccacattccctagatgagccacactccctagatgaaccacattccctagatgggccacgctccctagatgaaccacactccctagatgggccacgctccttagatgaaccacactccctagatgagccacgctccctagatgaaccacattccctagatgggccacgctccctagatgggccatgctccctagatgaaccacgttccctagatgggccacgctccctagatgaaccatgctccctagatgagccacgctccctagatgggccatgctccctagattaaccacattccctagatgagccacactccctagatgaaccacgctccctagatgggccacgctccctagatgaaacacgctccctagatgggccacgctccctagatgggccacgctccctagatgaaccacgctccctagatgagccacgctccctagatgggccatgctccctagatgggccacgctccctagatgggccatgctccctagatgggccatgctccctagatgaaccacgcgccctagatgagccaccctccctagatgggccacgctccctagatgaaccacattccctagatgggccacgctccctagatgaaccacactccctagatgggccacgctccctagatgaaccacgctccctagatgggccacgctccctagatgggccacgctccctagatgaaccacgctccctagatgggccacgctccctagatgaaccacattccctagatgggccacactccctagatgaaccacactccctagatgggccacgctccctagatgggccacgctccctagctgaaccatgctcccttgatgggccacgctccctagctgaaccacgctccctagatgggccacgctccctagatgaaccacgctccctagatgggccacgctccctagatgaaccacgctccctagatgggccacgctccctagatgaaccacgctccctagatgggccacgctccctagatgaaccacattccctagatgggccacgctccctagatgaaccacgctccctagatgaaccacgctccctagatgagccacactccctagatgggccacactccctagattaaccacattccctagatgggccatgctccctagatgaaccatgctccctagatgggccacgctccctagatgaaccacgctccctagatgggccacgctccctagatgggccacgctccctagatgaaccactctccctagatgagccacgctccctagatgggccacactccccagatgggccacactccttagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccactctccctagatgagccacgctccctagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccacactgcctagatgagccacgctccctagatgagccacactccctagatgaaccacgctccctagatgagccacgctacctagatgaaccacattccctagatgggccacgctccctagatgggccatgctccctagatgaaccacgctccctagatgggccacgctccctagatgaaccacgctccctagatgggccacgctccctagatgggccatgctccctagatgaaccacgctccctagatgagccacactccctagatgggccacgctccctagattaaccacattccctagatgggccacgctccctagatgaaccatgctccctagatgggccacgctccctagatgggccacgctccctagatgaaccacgctccctagatgggccacgctccctagatgaaccacgctccctagatcaaccacgctccctagatgagccacgcacctctggcctaacaacaatcacaggctggacctgcaggggagcccgggaggagttctaccctagaaaagaggtaggcccaagccaaggagacacatcctgcctcagaaagacctttctaaaagcgaaacccatccctgagctgagatttgtgctttagagggtgagaggagcacagagaactcactgcagaatcccaaggcaatcagagatcttgtagatgttaacatgcccaggctatatgtccgctggcagcccagttccacatccctgaaacccagagggagccagggtgaggcatccaaggtaaaaggtgcaagggcctgggggtgttgtcaacttgtcaccacctgtgctcctggggagcccaggaccctttgagcagggcgcactgggagaggcctccgtccagggagcagactgactgtacctgctcatacttggtaatgatgtcccctcattcctgtgccagcagggtatccacattctctcccatgtccatcccatgagacaaatcgtccaaaggtgacactgtacccgagagcttcggagaacacctgagccactcctgccgggctcccagatgctggcggtgtgtgacccccattccatcaccacctccaggtgaaaaggggccagacacagtggcccacacctgcacgggtctctggagtctcaggccccaagcaggagtgcctccttcctaaggacttgagaatagtgggacctggacagagaatcccgttgtccccaaatgccatgaaatgggaacatatctatcccaacagaatgaaaggtgtccacctgccgggggtgaagagcctgtgattccagagatgaggaggcagactggggtcagggaccagaggtctctgtatgatcagcctcttgggatcgctcagaaaccacaaagttgcccagttttctatggacaacaagatatctcctgacttcccaattctactccactcatcacttgggctaccatggcccttcagtctgaccagtgaagccgctttaggaatcatgccagttgagcaggaaggtgtttgctttgggggaagaaaatgatctattgtctccaaagcagcctctgtgctggtggaaaccatgacgctgggggagggacggtggactccacaattctgagctatccatacagggtgtggggggcttcattttcccgggtcactgagaaagaacaggagaactctgggttcttggtcctggagaacaccgagatgaacgattcctcctgggaccactcggggcaaaagggaggcgaggcctctggaggaccaaactgagaaagaaatacttgaagagaatgccagtgcctgtacccctttgaacaggagggaagatagtctccatccaggcagccctccagggctccttcattttccacaactgcccaaaggcagaaggctccccatccactcccagacagggaactgtgtgtgtccagtgggtcccacagagaccatcaggacccagcttagggcacagaggtattctgaggcccctcccctccaccccacccacagtggatccatcccagcagctctgccagggccaagctctgccccattgggatctggaaccctggacacatttgggatttagggcagggaggtcacagggttcaggacttaagtccagcacggcacagggcaggggtgagagcacaacccagggtcacatctggattcttggggttacccagttaccgcctctctgaccccagatgtctcacctgtctaatgggcacatttgggagcagcacccaccctatggagccaccatgaggacgaaggaaacatatcattaaaagatcagaaatacaaaaagagataccattaagagttcctacagatactgaaacggtcattaggtaatagtattaacatttttattctgatattcaacagcagcagtcacttccctccacccatatgtgtatcgtctgcctgggcagcacagaacaggcacctggtgagtgcccagggatgaccctcctcggcagctgcccagaggccagcactacccaccccatagccactgtccccaagtcagcatgaagggaagggagaatgtcacactcacctgattctgatgaattggctgggctgagttatgcctctcatgtagcaaactctcatgaacacagaactgctcacagatagcactgtgcgtg

SEQ ID NO: 2241 - DNA, 201532 bp, Homo sapiens
gtcttagtgaagtaacttttatttattagcaaaactaaatcttattcatgctcgtttaagcaaaatgaattacaggactatggggtctattaatttgctaggtctgctgcaagaaattaccataaaccaggtggcttaaaacaacaggagcttattctgacagtctgcaggccagaagtctgacacccaggtgtcagcaggccgcgctctctcggaaggctcagcggggggtccttgcttggctctctcccagcttctggtggctgcctggcagcccttggcggacctcggcccagcctgtctcagcatcactccaatctctgcctccgcctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgcctctgcctccgtctcctcctctgggtggccctgcctctgcctccgtctcctcctctgggtggccctgcctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtcttcccctttcagaccctgagaagcacacctgccagtggacctagggcctaccctaatccaggagggtctcatctccaaatctttaccttactgacatctacaaagactattccaaataagatcttattctgaggttccaggtggacatatcttttggaggtcaccgttcaacccaccacacagggagggtcatggagctcaagtgaagaaacagcacctgggctcagcagccaccgaaaatagcaattgcggaacccgttggaaaccaagctcattttcttggccctcctctcgccttccaggctgcatggctccttcatctgcttctctctgactggcagcatcaaccacttttctctgcagcctgtgtcagcttaggacagaagagaacccttacacttacatgcgtttagctccagagcacacggacagtggctaacctctgcctcatttctacattcctgagaaaaacaatctcatgggctagttttggttaagcttctgtcatggatcccatcagctgtagttgagacaatggtcaggtaagtaggtgctggaagggaaagacattctcagtttaacaaagtattttaaatgaagtcacaatagtgtaaaagttaataataatgaggtttctaaatactctttccaatgtttttcactaaagttcattaagtactattcaaatagtacttacgtttttaaaactatcccccaaatacttcagagccatctaaaatggttgctgggtttagacttccctgacacctatgatgagtcataatttagttatcaattttagtggtctactcttatcataagggcctgtgaggaaggtcaaggtagtttgcagtggcttttctagaaaatctttcagaaggctccaagctgtattgcctgcaattaggataataggcttggcttctgtcagaaggctcctttcagttctgtaaaagttcctgttggtgagtggtttattgggcctatgagatgtgatctctttcttctggaaagaggtccctatatggcagtaatggaggaatacgtcctggaaatgagagagcatatgtgcttggaagcgaggtggtggtggtggggggtgttaattagcatgacaggaagagaagacctattcagaaaacataatggtgagagagggaaatcagaagcgatatactggttggaaaccaaaaagcctcagggagacagagtcaaatatgatggccataattaaatcaaataatgtactccttttccttgacaaatcagtgagccttcagaagtgtgtgaagcttgagattcagacatgaaatgcgaacatgtgaggatatgagacagcccctgtggcccatcttccaaatctcagaagtgtgtgaagcttgagattcagacatgaaatgtgaacatgtgaggatatgagacagcccctgtggcccgtcttccagatctcagaaggacagaatgaacaacttcagaatcttagtgtcaaatgtaggcatggtgcttgatagcaaaagtgcatcaggttcaaatcttagaaaatagaattggcatggatagggtaaaaaattggtcgctatgagaaaagcagcattgttgatttcatttactaactgttgtaataatgctgtgtgtgtgttaactgaaccaactaggaggaaaatgtaaggaagagtgctcccttgttattgaaatgggcttggaagtcaaagagggaatgtctggtaaaggctatagcataagtaggatgacccaacaatagatttaacagattatatcaattatctggataaacttacataagagtggtactgatatggctattacatgcgagggactaaattgtgtccctacaaaattcatgtggaagccttaacccccagtgtgactgtatttggataccagaattttaggaggtaattaaagttaagtgaggtgataatggtggggtcctaacctgacgggtttggtggccttacgaggaaatgaagagagagagctctcagtctctcacataatttggaggcagaagatccagtctgagggctggtcacgtaggcattcttgggagagggcagtacaggcatgcctcagaaatattgtgagctcagtttcagatcactgcaataaagagaacatttcaataaagtgagtcacaagaagaatttgatttaccagtgcatataaaagctacgtttatactatactgtagtctactaagtgtgcaagacaccacatgtacttttctaatgttctctctctccatgcagatgcacacaggaaaggccatgtgaggacacagcaagaaggctgcctctacaagccaagaaaagagccctcatcaggaactggtctgctggagcttgatctgggaccttcagcctctagaattgtaagaaaataaacttctgttgttttgaccaccagacttacagtattttgttatggaagcctgagaagactagtacatatgaccatagccattttcacaatgtttagcatatgtttacatctcttttatttatgctatgaaattaccctgacataatgctcatatttaaagatattacctactatatttttctttttggatgggtgtagcattttgtgggtagctggattttttgatcagacaaagttcagaatcaaactgccaatataatagttctgtacgagaaaaaaaaaggtaaggaatggaagatagggatactataaagtaggagatatacgacaggaaatccatgccaataactctacatttacctcctaaatgaagatgtagccttgttgatcattggtttcaacaaagtatcaagagaggcactgatgtctgcccataagtgtgcaaacttttaggatgttcttcctgaatgggtataaaaaggctgaggaatagtaggaaactgagatactctgatcaagcaataccccttctgatgtgaaccacgtctgcctatatatttggctaaataaattgggaacttaatctaattttgtcttggttgtctttgtgtagtagttttttcctgctgaattctaagtccaccttaagtaataaactttaaaaatcatttgtcctttctgggttctatgctggggtcgagaaggtgtcattttagtatagataatgtaggcattttttttccaaggagtgaaatatttattgtgaataaaattgaagatattaatttccaaattccccttgttggtaaagacataggaagaaaacagaaatgcccttggcagatgaaagaaggattgctaggcactgcagactcagtacatggggaagtttaaaattaagagacaaaagaacaagtttgtaaagccagctttagaggtttcacaatgaaggagcttaaaagtgaaggctttggacattcagatgctggagcctcggtagaggcaacatgctgggtagtgctgagtacatttatttagaagtcattgaattgtcttttctatttatgatctgtgtattgaagctattcaccagattcttatttgtgcttttcttcatagcatgcattttacttgccattaattgattcaaaattatttttctagcaattattcatgctgatgtgctcaagctttattgttagatctagaaacagtgataggtaagatgtcctgagtacttgcccagggatattcactaaatcttcacagcaattctaggacagagtcaacattaccctgtcacagctggggatgctaggccttagagaagtttaggaacttgtccaaggtcacacacaattagtaaaaatagtagaattggaatttgaacctgggtagttgggctccaggcctcctcctcttatccattttatcaaaccaagtaacactgtacattgtttacgttgttttattggaattatacatagcattctggagtgcaacttagattcaagataccacatgtactttttatgttctgaagttttacatctaatctattcctacaaattaatgtattttaatcataatgtcagtgtagcatctagacataaaaaaatgggtatattaccttgaaccacccaaatttgaccagtaggttgaaaagaagtatggctgcattctgcgcttcctctctgacactctagcacagggcattgaggtataagagaatatcaatattggcacatatccaactcacagatgtttgtcttttcttgatgctccctggtgccttagctttggccacagtgcacataagcaaagtgacagggcaagagagccacaaggagaagaggctggaagtgcaagaaggctgaatgtacgtgagatgtagaccaagggccaggggcccagattcacaatagacatctgcagtgggaggttgctgcagctactagagattgcaagaaggcaactattagaatcgaagtctgtcatgcctgctacatgaactgcaaacataatttggaggcagaagatccagtctgagggctggtcacgtaggcattcttgggagagggcagtacaggcatgcctcagaaatattgtgagttcaatttcagaccactgcaataaagagaacatttcaataaagtgagtcacacgaagactttggtttcccagtgcatataaatctatgtttacactgtactgtagtctattaagtatgcagtagcattattaaaaaatactctacataccttaattaaaaatacttcattgctaaaaatgcaaccaacaatcagagcctccagcaaagtcataatctttttctggtgggaatcttgcctctatgttgatggcttctgacggatcaaggtgttgaatgctgaaggttaaggttgctgtggcaatttcttaacataagacaacagtgaagtttgctgcatcaattgacttttcctttcagacaatatttctttgttgcatatgatgctgcttgatagcatttttgtcatattagaacttctttcaaaattggagttaattctctcaagccctgccactgcttgatcaactaaatttatgtaatactttaaatcttttgttgtcatttcaacaatgtcacagcatcttcaccaggagaagattctgtcccaagaagccactttcttagctgatccataagttgcgattcctcatctgttatagtttgatcatgagattccagcaactcagtcacatcctcatgctccacttctaatttcagttctcttgctagttctacaacatctgcagttactttctccactgaagtcttcaatccctcaatattatctgtgacagttggaaccaacttcttccgaactcctgtgaatgttgacattttgacctcctcccatgaatttcgaatgtcctgaatagcatcccaaatgttaaattctttccagaaggtttccaacttacttttcccagatgcgtcagagcaatcactgtctatggcagctgtggctttatgaaatatatttcacaaataataagacttgaaagttgaaatgactccttgatccatgggctgcagaatagatgttgtgctagcagacatgaaaacaacattaatatctttgtacatctccatcacagctcttaagacaggtacattgtcaaagagcagtaatgttttgaaaagaatcctttttgtttttctgaaaagtagttctcaacagtgggcttaaaatattgagtataccatgctgttaaaagatgtgctgacatcctagcttccctgttccctttacatagcacaagaagagcagatttagcataattcttaagggtcctaggatttttagaatggtaaatgagcattggcttcaacttaaaaagtaacgagctaggttgggtgttgtggctcatgcctgtaatcccagcactttggaatgctgaggtgggaggattgcttgagcccaggagtttgagaccagcctgggcaacatagtgagaccttgtctctagtaaaaatgaaataaaatatttttgaaatttgaaaaaaaaatacagcagttacattagcccttcacaagaaagtcagcctgtcctttgaagctttgaagccatgcattgacttctttccagttatgaaagccttcttaaataggagatgccatttgcctctgatggctcttctttcagtaggagggtgttttgtatagattaaaaatcagttgtttagtgtagctacgttcatcaatgatcttaggtagatcctctggataacttactgcagcttctacgctagtatttgctgcatcacctagcactgttatgttatggagatggcttcttttcttaaacctcatgatccagcctttgctagcttgaaacttttcttctgccaattcctcacctctctcaggcttcatagaattgaatagagttagggccctgtgctggattaagcttcggcttaagaaaatattgtagctggtttgattttctgtgcagaccactcaaactttctttaaatcggcagttaggttgttttgctttcttaccatttgtgtgttcactggagtagcagttttaatatcattcaggaacttttcctttggattcacaacgtgggtaactgcttggtgcaagaggcccagcttttaacctgttttggctttggacattctatccccactaagctgaatcatttctagcttttgatttagggtaagagatgtgtgactcttcctctcacttgaaaacctagaggctactgtggggttattaattggcctaattcccgtcgttgtgtcttaggcctgaggagcgggagagagattggaaaatggctggtcagtggagcagtcggtgctcatgcaacatttctggattaaattctttgtcttacatgggtgcagttcatggtgcctcaagacaattacaatagtaatatcaaaggtcactgatcacagatcatcataagaaacacaataataacgacaatttgaaatcacaagaattaccaaaatgtgacatggtgatatgaagcgggacatgctgggaaaatggcactaatagacttgcttgaggccaggttgccacaaaccttcaatctgtaagaaatgtaatatctgcaaagcacaatagactgacatacaataatatgagctaggcctgtgttatcaaaccagagtttgctttagcaacagggacaccatcttggttagtccaattctcatcttcggagatctggagtgcatctctctgagagtctgtacaatccttgttagaaccctgagttcagagtaataaaaagggatgaaatgattaagggactggacttttgctagacagtagactcctctgtgtgccctaggttgttcttctcctctaacacatcagagtagattgtatcttaaaaaggagtatttgtgttcagagcaactgctgttgtgcctgctcttcaggtgacagatggtaggcttctctctgaaccaaaagcaatgtttgccatcctaaaaatgtggacataatatgttatatgaaagtttttatttgaggccacgtaatatggctttatagttttgtttcctggttattagtcttatcaaagttactgctggaatgcctgtgcagggaacaaaaagaggatgtcaaggaagcagtgaccagcaaatcctgatagaagtttaaattccctgacaatccaataggaataaagacataatcagctgcatattggagcacattattaaaacagccactcaggttttgaaatatccatttaaaatagttcaattaaaacccaattacagaaacgttccacacgaacactgaaacatctattttattatgattctgcatatcagtagcctttaaatcttaaagatgaaccaaaatgtcttttaaaatgagcactaaaaggggagacccacaacatagtctctgctgcttcaaaggggtttctgccttgatttaagaacatgagttccagttgtcccaattaccgtttacagtaaccgaaagaataataaatagaggatgcctgtgagtatctgttgtgatgcaagaaatattcatcttaggcacactaagcaactaaaccacaaaattggactttttgcaactgttcgaaaagttaactaaagatgaatatgcattttatgcatatcagtgcttttatcatatgccatttaattataggttattttaaactattcattcataaaaaattaatttatttagcactttagaatacctaagacatatagtaatataaatgtatgcaagattttcagaaagtcacttcttattttgcatttttggctagagttctctttcggcaaatataggtgtgagccagacctcacaatgtagcaattatgctttttttttttttttttgagacagaatctcactctgtcacccccagggtggagtgcagtggcatgatgtcggctcactgcaacctctgccctctgggttcaagcgatcctcctgcctcagcctccccagtagctgggattacaggtgcatgccaccaagctcagctaatttttgtatttttagtagagacggggtttcaccatcttggtcaggctggtattgaactcctgacctcatgatccacccgcctcggcctcccaaagtgctgggattacaggcgtgagccaccgcgcccatccacaattatgcctttttcccggctcactaaggatttagagattcatattcctcttcttgtcacagccatgaattcctttcagcatccacctgcatgctttgcctggcattgtctgcttgggaaccagagccctgttactgtcttacttgaaaggcaagttttcctaagctatctaccagattactttagatcatagccttctttagatttctctaaattatatgtctttggacctcagatatacatggtcttcttttgagaaatgtctattcaaattttttgctcatttttaaattggattgtttggtttcttcctattgagttgtttcttgtatatttcagatgttaatcccttattaaatgtagggtttgcaaatattttcttctattccacaggttctctcttcacttggatgattgtttcctcagatgtgcagaagcatttaaagttgatataatctcatttgtctatttttttttattttcttgcttgtgcttttgggttcatgtaaaagaaattattgctcagaccaaagttatagagcttttcccccatattttgcttcagcaggtttatagtttcaggccttacatttaggtctttaatctgctttgagtttacttctgtatgtggtgtgagatagcataagacatacaaaaggccagcaagtatacggaaaaagaagacttgcaaataaccaacaggcatatgaagagatgctcagcatcactaatcagcagagaaatgcaaatgaaagccacaacaaaatagcagctcacacctgttagaatggcttttatcaaagagatgaaagttaaatgttggcaaggatgtagaaaagacgaaggccttgcatactgctggtgggaatgtaaattagtacagacgtcatggaaaactgtacagagcttcctcaaaaagtaaaaatagacctaccatatgatccagcaatcccactagtgggtatatatccaaaggaaagtcaatagctctgtatgacaggtatttgcattctcatgtccattgcagcattattcccaatagccaagatatggagtcaaactaagtgtccattaatggttgaatcaataaagaaatgtagtatatatacacaatacaatgctatccaacctttaaaaagaaggatatctggtcatttgtgacaacatggataaacctggaggacattatgttatttgaagtaagccaggcacagaaagaaaaatattgcatgatcttacttacataattgcatattaaattgagagaagctgaactcatagaagtagagagaatggtggctaccagaggtttgggagatgttggacaaaacaaacaaacaagaaaagtaaggatgtaacttcaaaccaaaaataaaggagtaccaacggctttttgactgaatgcccacaaatacggcagctgtcactttgtttacctttgtcatactgattttgtagttggacctgtcatggccattgctggaattaacaaatgagtggaatgattacaaagaaaaattgaagaatctattttgttaatttttatggtaatgtatattgagagattatgggtttctcaagaatgccagtaacggccagatgcagtggctcatgcctgtaatcccagcactttgggaggctgaggcaggcggatcacctgaggtcagaagttcgagaccagcctgaccaacatggagaaaccccctctctactaaaaatacaaaattagccaggcgtggtgatgcatgcctgtaatcccagctactcaggaggctgaggcaggagaatcgcttaaacccgggaggcggaggttgcggtgagcccagattgcgccactgcactccagcctgggcaactagagtgaaactccattaaaaagagagagaggagagagagagagagaaagagaaggaaggaaggagaaaggaaaaaaataataccaataacatacttgtgcatggctcaacaaataatatttttattcaagatatatttacaatataagaatgcacaaacacttcagtgtgtttatacattggcatatcggggttttattattaatgttggcgtatagcttttcatcaggcctcttccttactcaaaaatatgtgaatttccccaattttctgctttatcaatccccagactcctctgtctggttgtcaattctctctccagttccgctccaccgtatgcattcaacaatatattttttgactccccaaggtgcacactctacttaaacttgccccctcttcacctgtgttaactccacccaaacttcaggcaactgtatcacatcagcaacggagcgttctctcaaatacctcagcccttacacactcagctccccaactgagcacttacttgaggacttaggtgtacatttatatcaatttgtggtatgacacccttttatcattttctacttgtcactctatctccctgcaactgctctgtaagcacaagcatctacatagtgaatagccaacaatgaagttcagactagcaaagtattgacaatgccattttctaggtcagtttctgagtgggctgagatgactgaaagtagaagtcaactccagaagcagctgatttccagcaaaaagagcgatgattactcctctgcttaccagcagttacacctattgatactggagcctccccctaccacgaggtagcttctgctgctattatcttgctgctctgggtgagtccctgagaattcggggttagggaagtaaagaggggagcaacagtctgtaatcaacttaggacatttcattgctataatctcattactcaagagtttttttttaaatatcatagaatataattaagtctggtcccaatttttgcccagatgggaagaaaaggaaaaattcatgaaatataagtctaaggtgactttttaaaaattgtattttctttttggaaataacaaagtctataataaaatgtttatgtaattttaattataagattgtaaataaaatgcatgcatatgaaatgcatttattacaacttttatacaattttgtgaagctaatcatatatatgtgtgtatatatatatatgtgtgtgtgtgtgtgtgtatatatatatatatatacacctctgtctttatatagatttctttgcatggatctatccagacagataccactctttaaagttttatatattttaatctccagtgagaaataccaaagtgaactaggtcatctctttccatggtggagctgatggctgactccaactgtgaccaaatgatctctccttgaggccagataagaaagatgaacatgggattatttttccttatgtgtattttcaagagctcattaataatttcagtttcatgttgatgagagttagctttcagaaacatttattttatacaaaaaaaaaagactaagagctcgttatctcttcatgatgatataacttttctgcagaatttctaaaaatcttaaaggacaattgtgtgtgtttgaggagaaatacagggcctgactcagaatcttccagttacattctctcttgttacgtttataaattctataccctgaaaacaggaaatatgttccaactgttggaaactttcagttacaactgatttgtgtttttctgctatgttcattatttcagtttgttattaccaacgatctctcttttcttaatagaccaaaacataaacaactcaggcttccttaagaaatcttggctcgctgcaacctctgcctccagggttcaagtgattttcctgcctccacctcccgagtagctgggattacaggtttccaccaccacacctggctaatttttgtatttttagtagagatggggtttcaccatgttgtccaagctggtctcgaactcctgacctcaggagatccacccgcctcggcctcccatagtgctgggattacaggtgtgagccactgcaccaggcccataatttctaataattatttatacctactctatgttctgcactgtgccaaattctttgtatggatcatctcatttaatcttcaaagaaactcagtgaggtcaatataattattatcactgttttctgagaagaggactgaagcttaaattgcctaatgatccatgaaaatgcactcatggacatcgacaccccccaccccaccccaacaccattgctgctgccactggtgcaaacacgcatgcagatgctcatggccaagcccccgccaatgaaccacccctgccgctgccagtgcatgcacatgcgggaagaccacagccctgttactgctggtaccccccagaagctaacacgtgtgcacctccccacaacacagctgctggcacacatgagcaagcatggatctcaaagccccaacaaagtgccttggtgggtaccacccaacaaagtgttgtggccagcagactgggaacatctctgcccctccagcacagcagcttccttacctggaacagacagagaacaaagcaggggcctggtaccagctcccagagttagagtacacaccctgggagtgctgagctgagctttggccccctaaaatcttccagaaatgaagccatttgattgaacccaccttataccacaagcaaaaccccaaggtcatcaaaagagataaaagcaaaaaatctccatccaaaagacagcaacttcaaaaactgaagaaacatcaactcacacacatgagaaagaaccagtacaagaactctggcaactcaaaaagtcagtgtcctcttacctccagacaatggcactagtttcccctcaatggttcttaacgtggctgaaatgacagaaatagaatccagactatggatatgaatgatgatcatcgagattcaggacaactttgaaactcaatccaaggaatctaaggaatacaataaaattttccaggagctgaaggatgaaatggccattttaagaaagaatcaaactgatctgatagagctgaaaaactcacttcgagatttcataatatgatggcaaggattaacagcagaattgaccaagctgcagaaataatcttagaactcaaaaaatatatgatttaaaataatcagacaaaaatttaaaaaaagaatcaagaagagtgaacaaaaccttcaagaaatatgggattatgtagatacaccaaatctatgactcattgacatcactgaaagagaggcggagaaagcaaacaatttggaaaacattttggtgatattgtccatgaaaaatttgccaacctcactattgaggccaacattcaagttcaggaaatgcagagaatccttgcaagatactatacaagcttaccatcatcaatacaatagtcattagagtccccaaggtcaaaatgaaagaaaaaatgttaaaggcagccagagagaaggagcagatcacctgcaaaaggaaccccattaggctaacagtggacctttaagcagaaccctacaaaccagaagagattgggagcctatatttagcatcttaaagaaaagaaattctaaccaagatttttatagatagccaaattaagcatcataagcaaaagataaataagattctttccagagaagcaaatactaagggaactcattaccaccagatctgccttataggaggcccttaaggaagtacttaatatggaaaaattactggccaccacaaaagcacacttaagtacatagaccatcaacactgcaaagcaactgcacaatcaagtctgcataataactagctaacaacatgacagaatcagatctgcacatatcaatattaactttgtaattgggtgaaatgccccaattaaaaggcagagagtggcaagttggataaagaagcaagacccaaaggtatgctattttcaagagacccatttcacatgcactgacacctataggctcgaagtaaaagggtggagaaaaatctaccaagcaaatggaaaacagaaaaaagcaggggttgctattctaatttcagtcaaaacagactttaaaccaacaatgatcaaaaatacaaataagagcattacataaggataaagcgttcaattcaacaagaagacctaactatcctaaatacatatgcagccaacacaggaatacccacattcacaaagcaggttcttagagacctacaaagagacctagataaccacacaataatagtgcaagacatcaaaacaccactgacagtattagacagatcattgagacagaaaattaacaaagatattcagtacctgaacttgacacttgaacaaataaaggaagtaatggacatctacagaactttccactcaaaaccaacagaatatacattcttctcatttgtacatggcacataccatatatcagccacacaatgggccatcacataattttcagaaaattaaaaaaaataattgaaatcataccaaccacactcaagaacacagcacaatataaacaaaaatcaacactaacgaaatcactcaaaaccatacaattacatggaaattaaacaacctgctcctgaatgactttggggtaaacaacaatattagggcagaaatcaagaaattctttgaaactaatgagaacaaagatataacatatgataatctctaggacacagctaaagcagtgttgagaggaaggtttatagcactaaatgcccacattcaaaagttaaaaagatcaaagtaatgacctaacattacacctgggagaactagaaaaacaagagtaagccaacctcaaagctatcagaagacaagaaataaccaaaatcaagagcggaactgaaagagattgagacagaaaaaacatatcaaaggtcaacaaatcaagaagttggtaatttcaaagaacaaaaaagattgatagaccactagataggctaatagagaaaaaaggagaagatctaaataaacacagtcagaaatgacaaaggggacagtatcaccaaacttacagaaatacaaaaaactctcagactactactacaaatacctctatgcacagaagctagaaaacctagatgaaatggataaatttctggaaacatacggcctcccaagattgaaccagagggaaattaagtccctgaacagaccaatgattggttctaaaatagaatctgtaataaaaagcttactaacaagaaaaagcccgggaccagacagattcacagctgaattttaccagatgtataaagaagagctggtaccatttacactaaaactattcctaaaaatggagaagagacttctccttaactcattctatgaggccagcatcatcctgatatcaaaacctggcagaaacacaacaaaagaaaacataaagccaataactttgatgaatatcagtgcaaaaatcctcaataaaatactagcaaactgaatccagcagcacatcaaaaagctaatctaccatgatcaagtaggttttattccagggttgcaaggttggttcaacatatgcaaatcagtaaatatgactcatcatataaacagtaataaaaacaaaaaccactcgatcatctcaatagatgcagaaaagacttttgataaaattcagcatcccttcatgttaaaaattctcaacaaattaggcactgaaggaacttacctcaaaataataagagccatctatgacaaacccacagccaacatcatacggaatgggcaaaagctggaagcatttcccttgaaaatcacaacaagacaaggacaccctctctcaccactcctattcaacacagtactagaaagtcctagccggagcaatcaggcaagagaaagaaataaaaggcatccaaataggaagagaggaaatcaaactatctctgttttcagatgatataattctatacctagaaaaccccatagtctctgcccaaaagcccctagatctgataaacaacttcagcaaagtttcaggatataaaatcaatgtacaaaaatccataacatttctctacaccaacagcttccacacttagagccaaatcaagaacacaaccccattcacaatagccacaaaaagaataacatacctaggaatacaactaaccagggtggtgaaagatctctacaatgagaattacaaaccactgctcaaagaaatcagagatgacacaaacaaatggaaaatcattcatgagtggataaaacatactccccgtctttaccttggctttccttcttcatgattctattttgaaactatgtgagctgtggttaggctccttattttgagaaactgctcaagataagacaagttattaaaataaaatattattggcaaaaggatgaaaagctagaaaacagagcaagatagataatgcaacggatagctgagggctttgaaaacatatattatataaagttctgttttcttgttcttaaggaaaagttttttaaccaaaaaacacaagctactactcctagagtggataaaattctcaaatgcattttcagaaccttacaatgtggcttcaaaatgggcattatcaataattactcaaaggcctgatgctatttaatagcagacagaggaaggtcactgtcttttcctgatccagaaagtttttcctattttgactccatttttttcagatgtagtttgactccagtgatcaatacaaattcaaattgaataccgtgcagcaacaaatatgccatagtgccttttcctttctttttggcctttttttgaacaacattaatcgacagaagaaagtcaaatggttatagctaagagaaaaaaataaataaaaaggcttctgagccataaaagtacaaataaaaatgtgaaaataatttttggaaggcttgatgaattttatcttttagatttagtgcattagtttacattatgttgggactttggtttatgtaaaaactggatagtcaaaattattaataataaaataatgtgttctcaagagtaaatctcatgtctttaaatcatatgaatcattcatcatcataggaagccatgaatttccattacatagctgaacagttggagcatcccacaacaatggaaatgtataagtggggatgataatcggagggttcatgtggtagagtacagtctaaccagctggaggttcagtgaggcatgtgtctttccccctgtggtcacacaatgaccatgcagttggcatgacaactcttttttcctaccctacgaacttcaggcactgctactatttgtcagatatctttaaactaagtcaacaagatctatacttaggaatatttaattaattagatgtccttactaaagttaattaatttatgagatatgaaggatactttgtaataagaatagttttttaaaaatatgaaacaatttccaatccagatatggacaataaaattaaactgaatgtgaactgtttggtaaaagacacagtgagatttggatgatatgaaactttttcttggaaaaaagtcttttttgatatgtatgtgaatgaccctatataaatggtaattacatgtactaacacttgaaatgataagtgagcaaaaataagtgagtggttttataatatattttatttcaatagtttaatacacatactttttgataaatcacaataatatattttatccatatgaactaaaaggcaatactttgaatagtagaaaaaattaaatttccctgcattatagggtatctaaccttttcaactaattttttgagctactgagccatgatatttttccttaaaaagcatttttagaagcataaagtaaacgtaggtgataaattaggtgtacacacaggcatgtattaatgacagcacccttctccagaactttaggatgtttcacgagtgggacatcatctctcttaaattactatggagaaattaaggattagtttctcatgatgttaactgatttctttaatcagctaggggttggcatttggcattatggtgtgcatgtgaatcttgggtagaatgcattgtattgttgtaaaatttgaattaatgtggacatatcttcctttctcgctgtcgtatagtaggaaaagttttgagcttacactttgttctccaaaggattcagatgtgtttggtcatgtacaagtgactcaggaagagttcacggcaggagagagagtttctaggtgttcaaattgggtcccaggataataagttgccgtgaaagaccttgcttatgtgcctttctttctccactttgtccctgcctgacccataccagaggcttgtgttggagctcttaaaagggtagacgacagtaaaatatatagaaaaactgtttcactaaaggctctgtgagattttgcagaagttcagggcagcctataccgggtaagcatgctgggttgtataatataatgaaatgcggcccagggattgggtgtcataaaacgataacctttgatcaagctaatatctgaaacaggagtgggactcctgaaccgtgaggcacatcagccgcatcataatcaaattagaaaaagatattatttttgtcacttgcattacctctgaaaaagataccgttggctacattggcctctttctgagttttgttacagatatctgagatagaagcacagccaaggaaacgttgctttatacttatttataaggacatttttaatctgcttaacatatagcctgtacaacataggttgtgtgtgtatacatatatacatacagatgcacacatttatatacgtatatatttgtatacacacacatctgcctggtcttctaattagaggggctgaaacccagtttcaggcataaaaacgatcactgatgtcacagtgctgttcagagagtgtcagtaaagctgaggaataacgccgtgcttacaacgcaaacagggcatcctgtgtggaaaacaaacaaaaattgtcaaatatcaaatatctaaaatattatccttcatacgttgttaattttgttacattaaactttcatcattctatttaattgggtatcgaatcaccttttaaaattcttaaattcttagtatttcaagctcttctggagaaaaaaatgaatgacaagtacagaaataaaatacaatcctcagcaggtgcggtggctcacgccagtaatcccagtactttgggaggctgaggcgggaagaccatgaggtcaggagatcaagatcatcctggctaacagggtgaaaccccatctctactaaaaataaaattagctggacgtggtggcacgtgcctgtagtgccagctactggggatgctgaggcaggaaaattgcttgaacccaggaggcggaggttgcagcaagccgagattacgccactgcactctagcctaggtgagagagtaagactctgtctcaaaataaatgaaagaaggaaagaaagaaagaaagaaagaaagaaagaaagaaagaaagaaagaaagaaagaaagaaagagagaataaaattctcaaatgaatcagcattctaatccattttcgattttagtagaagttgagaagatgtcccttttcaaaacctagcaactcagatattctacactaatagaaaacttagtactaactttgacttctgatagccctaaaaaataatacagctatatcagaggtacgtgggtaacaataaggtaatgttatcaaatacaaagtctttactacgttcaaaactgcactcaagtttcttttatctgttcctttgaacaaagattttgcagtcttttaggaaccaactctacctctataaagtattctgcttctgacctggtactgtattctccttgaagtgtttcacacactgattttgtgttgatttcccccctttcttacacccccaggatttttctcagttagatatgctgagtttataagtcagaaatttcaaggattattcctctaggctatcaaccaataagcacatacagcagaacagagggaagcaattgtttcatcatgaggaccacattgtgagtcctatctgccttcagagctaattgcccttgaactttgccatacttgcttgctatgttcctgttcccattcaaatatccatcttcctgcatcccacaacacctacccacctctgcttacctagtagtaatacagcagggattcacatgaatagggcactggtacatgtgaaaatgcacctggaataaatatagggatgggtctgcggagcctcttgctgctcatcgagcccagggtaagattccttgagctacgtcacacatcaccatcctgcagatatttattataatagaaaccaaaatctcctgttttattgcgtttcaggcaaatgacccattcatccagttgctactgttttaaaacacattcctccatgtttgtgttttccatggccacgagcagattgagtgaagtaataagaaattgtggaaataatttctcatcacatacatcaatctatgtgagttttcttccaggcatgttgctgagcattttggaaaattggttgataattatccatgtagtaaaagagcatctctctgtacatctttgatgggaattatgcaagagaggtcatctcattaaatttgatctagctaaaggtatctcggccttaaaagggtggaagtgaattttgcaaatcaggaaaaatagtgacgatgtatggctcacaggtgcttcattatttgaaaaacaaacacaacaaatgaggtcaaatgttaactactgagcttatagataggatgactatattacatgtgtgaataatgaaataactagtcagaacttctaagctgagataaaatcacagtgtgagaaaagcctgggatttttgtagcatttagttgtggccattcacttgattctaattcaatcgttgtattactcggttttcacgctgctgataaagacatacctgagactgggtaatttataaagaaaaagaggcttaatggactcagttccacatggttggagaggcctcataatcatggcagaaggcgaaaggcacaagccacgtcttacacggcagcagacaagagggaatgagaacgaagcgaaaggggtttcaccttttaaaaccatcagatcttgtaagatttattcgctaccatgagaacagtatgggggaaactgcccccatgagtcaatcgtctcccactgggtccctcccacaacacatgggaattatgagagctacaatttaagatgagattgggggggacacagccgaaccatatcaatcattacattcagaaatatattgaacccatcagttaaatcagttccttagtgtgtgcatacaagacatgggaagatgtcctttttcctctttaagagttttcaggggtcattgcaaacaagagaccctacattgtctctacaaacatggcgtgtggctctttttatctcatttttttccctctaaccataaatacctcttgttttctagggggcctttctagtacacgtgtgtgtttgtggcacagggagaagggtgcgaagagagaggagattatcaattaggctttaaatcttacactaatttaaatttatggatttcatcaactctgaaaaaaatgaatcatttcaaagttgtcagtaaataagtcatgccatgttattactaaagttatgatggcattgcttggatattaagtctatttccggatacaatttaaagagtgatgtgaatttctattttggaaaatatataactgtcttccattgatcactgccattaggtgagcaaggattgccatggacatgggactgcctgggaggctgactaggcaagagtaactggtaactagaagtgggtaactctccctcctttcctatatcactactcttttccctccactcctgtctccctaagtttacactccctaacaaaagagtagcatatgccaacacaacctttgctttatggggacccaaattaagacaatggcactaaaatttattttgcaccttgcacttgggttcacagccaaagtgcattgaaaaaaacatagcaaaattttgatgtgataattaaactctcctctgtgttactgaagactttcttatctgggtcatggtaaagctgcatcataactgcagtcttatgggtcatgttaaaactgcatatatcttctcacagagatggagacatttataacatctgcctggtggcttgcccagccttgattgcaaaagggaataaaagcaccttagagagtaacaaagatgacatgaagttttgaaagagaaaaagagagatgggattgattgagaaataatattctcataaaatctcagtgtcatgaaaaatatcaaggatttcagcaaagccttttacaaatatagactcatttccatggaatcagagcaggctcctataaagccttcagcctttttaggttagaggtggaaaatttgggtgcagaggagaaacccctaactatagagcactgctctggggccttggggatctccatacacatccagagagggtcagaaatttgcgaaagatgaaggcttgcactgtctccatcagcagcttctgttaggaaagagacgagtgagccaggcaagggagagcatcatgaacccagggggcggcttgagccaagcagtccacaaggccaggtggcccataggcatgtgctatgtctattataaaagccaccacagagtccacggtagattccttgagaaataatggctggaatttaaaaccataactatgtcttaaggcacagagatactacggtttttcctccaggaagagcagtataaatctgtgttggcatcatggtaactttaaaatacatgatcacggtcagagaaggttggggccaaaggtttctaaaacaattccttgtgactccttgctgctgggaatgcaggaaaatgtgctatctgtccagagtaggcttagttcttagagtaacattctgaagtttcaaaaaaaaaaaaagtatttgatggttttgaattccagggagtcaaaggaagctcaatgaagttttccatgtagcctcttcattcattctgcagtcagtgcaaatactttgcacaaaggtttctgcaggagaagtggaatgaagaagtcagctgaggatgatcagatacagcagcctcctaaagtagatgccaaactagcaggtgtagggcagcgtgattccgcactcctccgttgcatgcatggatagatatctactattagaaaatgtaaatgatgattgctattttccccttcatatttgtgaaaacaatagccagtagtttgttagatgacagatagatgaggatactttgagacaagaaaagcatggtttgttattatggaactgggttaaaaggctatgctaaaatattgagcaaaatgtaaactttagtgcattacaaactgcccaagccattttaggctttcttatcagtattacaaagataaatggttgttttcacattttccccagtcagatcaatattgtatcaagaatgtattcggtaatgcttagttgccctcaaagggttattgaaaagaataacaaaaatgatggctgtgaaccagttttgtagaaatatgtgtactatactaatgtcggttattgttatttctgttacaataatagttttgattttaacccaatcttaaggggaaaattttagaatatgaattgcagttattctcagtagcctaactacaccttgcgtgttagaggaatcccttttcaatctcattctgctcagtcttgctattaaatacttggtaaattgagttgagagtgtgctaattgaatttgcggacaatccacagccaagagtaaatgctttaggagagaactgaagtataataggactctgataaactgtaggaaataggccaactgtccaccaaatgagatttcctaaagctgtctacaaagctccaaagcatacaataaaataaaatgccaaaaataacaaatgcatttatctctaagcaatattatacacgcacacacacacacagaattttcattcttctacatttttgctaattctaaagtcaagttttctgccgctccattctcctctttgtcttctccatgtttctgagtatttctcctataccatattttctcctttgtgactctccctatttgagttaaaatgtgattctgcatagatcggattagctatagtgaagagcagcattggctatttctggaaaagctgtcacatggttccaagcttagtgccacaagaagatcaccaggaaaaccgtaggcctttccatggatcatgggatcaggagagccccacaccatgagcctgacacactcgggaccaagggagggagaaaccacttagccatcttgttcatctgcacctctaacatcggagacttgattgttgctaggttcacttcttgaatcgtctcaccctttccctacagtccaagatcttcacttacatttcagtttcttgagatattgaaatttttgagtcagtgtaggatgttgccactgaatatttggttataatcgttgactgtcaattcctatagcactaaaacggttttggttttctttttttttttttaattttgtgtgtatctaattttgatctcacaatgtaaccacttttgttattgcttttaagggttatctttcaaggtcttttgataatgatgtctaacacttgcaatagtgaggccacactctcaggcataatcactaaggtgtgtgcaatctctgtctcctttttcactaaatctgacaggctcctcctataattatctaaaactagtactgattgaggtttctttagactaatgtgttttcccgaagagaattttgtttttaaaataaatgagagtgtgtagtagcaaaacaatccaccaccagatcgcccttcaaggaaggctgtaatgccttccctgctgaggtgctgatttgagagatagtctccagctctccgccatctacagggatagacagcttcctgtgtcttacttctggaccagagccagttttcagacttagaaccccttgattgaagaagaatgaggtctccaggaggaaggaccctgtaacaccatggcaagtggttataaggaatgattctctctgtccttccccagaagaacctagggccattaactcagcttacctcacactggagaatggacgttaaaaatggggaatgctggtaacaaagcctgacttgatattaatacctggagacctgaaacagcattagagtccctttgctagtgtgaggcaatatgaggggcagggagaaaatgatattctgttcaacaccagcctcatagtgggtccacatggtctgctaacccactcaagagtaatttttccagccctcaaatatataattggaatagacatatttggtattagttacagtcccacattggatcctttgcctacagaaaaagaacaatgattgtgggaagactaggcgaatgtccctgaaactagtctcctatacagccaaaatagtaaattagtattgcacctcagggtgaggagggggagaacagaaattagtgcccccccatgagatctgaaggataattctcatatctctgtttaactcaacagtctggctcctccagaaaccagaggatcccgaggatgacacatcatcgtctgaattgcagcctccatgcttacatctttaatagaactgacgaataggacctgaagtacatgctatgtgaccttgatttagccaatgattgtttttctatttctatcagaaaagagaatcctaaacagtttgcattcacatgtaacgtacaaaagtgtctatctacagttttgcctgggacaatgttaattcccctccccctgtcataacataatctgcagtgatctgaactgtcaggataacccgcagattatcacatttatccaccatatcacgttagtcagagcggatatgcaagtggctagtatgttggatgccttgtttggacatatgggcttcagagggtgagagatgaaccatgtgaatattcagaattcttttgacatcagtaaaaattttaagcatagtcacaggcatgccatgaaaattaaaagataaattatttcatcttacaccccatgaagaaatttcagtctctttgggttttggaggtcacataatccacacctgagaatactgatcgggcccatttattactgacaagaagggctgccagcttaaagtagacacaggcaagaaacctctgcatcacatccagacttcggtgcatgcagccctgccacttgggccactcagctcaggagaccctatgatattagagttttctgcagtaggaaaatatgccatgtggaatatatggcaagccccgtgaggaaatcacagcacaggcccccagaggtgtgaagcattgccaagccgtctgcagtggagaaggaaaccactgaagaaacaattcctggcatattactgggccctgctacagtaagagaacctgaccatggtacatcaagtgcagcatgtcaactggatcaggtggacccagaaaaaacgccatcatctgatgaaagtgatacattcaggatcgaatatgagcagaaccagcgagtacaagcaaattgcacaaccaggcatcccagatttccatgtttccctcatcacgcagcacctctctctcatgtcatacttatgtccctgtggcgggagagggaaatttcttgtaaatatctgacgggaggaaaaagaaaatccaaggttgaattatagatgagttgactgggagcgtggatgcaacccaaaattagagaagagctacccattacagcatgacttaggcatagccttaaaacactgtggtgaggaaatattcccacagtgggcagagtttcaggcagaaaagtggcccaatggtagattatatacagattcatgaacagtggcggatggcctggccaagctgttcagacacctggaagaagacatctaaattatcaaagacgaagatgtctgagatagaggcatgtaggtggccaaatgggcatgaacactaagtataaagatcacacattaacacctacaagagaacatccacatacaaacgacactagaccccaagtagacagaataacttggttaatggacgtcagtgagcctccgtcagtggccactccagccctggcacaaagagcacaactacaaagtgatcacagtgaaataaacggaggcgatgtatgggcttctgctcagcaagtctggtcaagctatttcttcaccaaacgtccaacttgctagcaacagaggcccacacaaggtacccaagatggcaccatctctgaagatgaccaaatggccacttagagaaaaggatctgttttactatggaaagagaaacaatgcattctcacagaagtagacatatattccatgtttgggtttgcctttcctactccaagggcttacagactgtttgatccactgtcacaggattccacacagcattatatcagataagtggatccacttcatagcaaagggcatttgaaagcaggatggcatgggatccatctttcatattacacaatatgcccctgaaagctgcaggtacagtagaacattagaaggcctgctaacagtaaagcggaagcaccagctcagtggtgacgttttataaagatgagtcacaatcctccagaatgcagcatccacattgcagcaaagactttaaatagcactgtgtcccaaataggaacaatacataggtcagataagccaggagcgaaatcagaagtgaacttgcttaccatcattctctgtaggcactaggagactttgggctttccattctggcgactctaggctctacagggttagagatcctagtcctcaaagggtagcactttcatcagaagacacaagagtcctattcagcaataagttgtgattgctgcttggccactttgggttccaagccactttgggttcactaggaagtagcagccaagcaaaaaaatcaccaactcggcaaatgtaactgacactatcatcaagagaaagtagggcttctgttccacaaaggggcagggaggatggcgtgtgggactcgggtgctctacttgagttctctcttgtccctcagaactgagagagtacagtcactaagctcatgtagtgaaatccgtccatggacaccagctagctctctttagtggcagagatggctgtagcttgagctaagtcatcttgtaaatggtatgtcctggtcataaacaagactagataggaatggaattgcccatctgtcattgaacctaaaaacaaaacatcaaacacaacatacttaaataatgtgccctactaacaacaggagtatttaatcaaccaccaataattccacctcatactgaggcttcttcctaatgtggaaggatgagaacaatatgaggaattccagagcccgaggtatgagatctatgaaattgaaaccctgagctccttctttcacccaaactgtgaaccactctttcctaaagggtttggataatgggagaacacatctatctgttgtaggagagcccgtaaacctcacaaggctggacattcaagacagcactgagcaggaggctgtgagttgctttagctgaagatgggagctgcctgacagctgccaagttatctactgccaaaatctctcctggatgcaacagcccagatgttagagaatttgtatttgatcccaaaactgagggtgccttgtaaatttcacatatagttcactaaatccttgcgtgtgtggattgagcgaaagaagcaatgaacttagagtcagagatcatgggcttaagtcttagttctgcacttaagagctggtgaaattcaatatattttttcactgacacacacaaaaattaattaaccaaccaaaaaaattttaaaagaagagttaatggaaaaacaaggaagtaaaactatctattgcagtacctgacagttagtagagctcaatgtctgctagttagttttttaggtgaatttcaattattggtcttaggctgatctctctctctctcaatctctctctctctctccccctccaccccccccattccccaacccctctacaaaacatgctaaatttctacttctaattctctttagtaaatagccatgcacaacctctattgttacctgtgacctcctgatcataaggagctctgctcctgctctccctcatctgcggttgggcgctggtctttaatgagctactgctctgcatgtaaacacaaccgtatctaatagctgaagcgacaagagcatgtggattagaagggttgtgaaaatacagattctttgatgaacttttctagtaatgagtatttcaatttcttatttcgtagtaatatagtttggttaaaaaatgaaaacacagaaatatataaggaggtaaaagaaagaaacctataattctattctccaaaggtgtcatacataccttatgaaatgtttagtatccatttttctattttgccatgcgtatattaatatatttaaacaaaatggtatcatttaataaattctgttccaagttgaactattctatctgtcaatataccttgatagtgaagacgtttatgaatcactcatatcttaaggttcttccattaaaaaaaaaaagaaaaacaagaaattgattccagttacagtaacaagaaaaacactgttaggatattgggtagctcatagaattagtcgaatttgaaaacaggttgaggcaggaaacaacgaagacaaagccagagttggaaccggccctaggaatcctgcccgggacctcgcagccctgcctcccagcccgtgcgactgccctgggccctgaccgcttgtcaggaccttgcctgcacttggaaatgcgatgctgatgagtgaagaggcagcgcttactgtattcgctcacgtaggaaaggagctgtgtcctagatagtagaggtgaattatcttttcatcagtctctcaagtcattttaaggacctctgggccttgagtgcttctcggtttctggcagtttgggggcagcatgaccttcctgcaaaatggccttatgcacgagtgaccctttaagaatcactgttggttttctaggtttatcggtgaagtggaccatgtaatctgtgttctattcttagccgtccctgggcctgaccttgggggtggttcaaggtgtgtgaaactggctcttcacctgaggatgtttcacactgatgagctggggaagacgctctgcagcaactcagaagaaagcacttagttctgagagtcagatatttttctctcaggaccaatttgattctgtgctgttaaaccttatcttcattatcaagtagcactgattaaatgttcaaatgctcatagcgccgctctaggaaccatacaaaaagaattatcctgcccggtaggactttaaaatcaaaatcagagatttattacttacaaggcgtcacttggcaccccgacacggtaagaaggggccttccaatcacctcgacgctgcaggcccttgagaacactggttcagttcgtggaagtcttttccgtttttctcttccatgccatttaatcccacaatttggggacagaactgagtatacggagaaaacacacattagatgtacactatgattttattttgttgatttatttcattttcatagaatataatacaacagaatctttgcttcattggttttgaaccaatgttttcccaggcaagtcgcactgggtagttatatacagcgacagtgactataaaagagtttccgtgggccttgtccattgtcacaatcacagcagtctcacctcgtctttttggctccatgctctttgtaagccattcagagaaaacctggaagcggttcttcaataaacctgcaagcagttcttcaaataaacctggaagcagttcttcaataaacctggaagcagttcttcaataaacctggaagcagttcttcaataaacctggaagcagttcttcaataaacctggaagcagttcttcaataaactgttgccctgtacactacacccacggtgactctgtgctctgaatacaccgacgtgaccctgagttttctgaaatacttttttatattattggccccaaaaactatgatattatcttggaaattccaatattttgatactcaagcctcatctgccaagatttatttttatacttagaagtggcatacacattctttactgaatgatatgtcctcattttggtttagtgctacagattacactatacctttgctatcaatagcttctttctctccctactgccatcacaataaaaacccaaccttcagaaaaatcaatgcaatcaaagcataacagaataggattgacggagttgtggttatccaaggagatttcagatatgtcaaaaataacatgataaggtttcaataattttgtgcccaaagtgaaatgctttgctgtgttgtggatgctccctcggggaggtgttttctttcattttttgttattgtgaaagttcattattcctatgcccagggtgtctgtgtctctgtttcttttttactttttctttctttactttttttttttttttttaagatggagtctcactctgtcacccaggctggagttcagtggcacgatctctgctcactgcaacctctgcctcctgagttcaagtgattctcctgcctcagcctcccatgtagctggaattacaggcacccacgaccacgcctggctaattttttgtatttttagtagagacagggtttcactgtgttagccaggaccgtctccatctcctgacctagtaatccacccgcctcagccccccaaagtgctgggattacaggcgcgagccaccgcagcccgccctctgttccgttttatataatcagtgacaaatagtctgagggttgagatttggggcatttagaataatttttgtctcctccatctccttaggaaagatgtctgcccttttctcctattggagagggacaccgtggggatctttgagcagagtcaggcaaatccatgccgaagaggtgggcccgtgccacctttgcacagcaaagtagaagaaaccattggcagttggtgggcggctgttgcggggaattgagaagtccgcctataacagttttggagctgccatattcttgggcatggtttcagactaagaataataagaataatagccctcaaaatgagggctgtggctcttcatcatactagctctgctgtctggtgtcagggatctgatactgccaccaagcagcccagtgctttatgaataggatgaaactcttcacagtgtgaaagcctcaggcagcactactctccacactgtcctacagaacaatgtcaagattatttatagtcttcaaaggtacagtaagcctttttattccattcttaagataaacaaataaatcacaagcactttggggtttgtgtaaacagatacaaaagcaacataaattacagaccgaaaacttaatttataaataggagctataaatttaataatcgataatcataagtaatttcaaaatgaaataaaaagaaaagccccactagagaatattatgcaaatttttattaaattatctattctattctacctcatttcaggtcttaagaatgtgtttttcttatccataatcataaatagggagataaagggagataaactcatttcctcattttttattaaattcacctttcctccttgggtggaattttatgagcatctagagtgtcagtttttctcccaacacactgaaatgtttatagtatggctatttacttcatcaagctagaacatttttctattaaacacacctcagtttcaaagttatacaaaatatacctctactttgactttttgatgtatttcaaactatggccttatctgaaaacttaaaatagtagtcagctattatttttaagaagtacttaaggtagctgtcaatatttaacaatatataaaccatttaaagagtcacgtacctactcattgcaattttgagcacctaatatgtgctattataaagtatagaatgatgtcagagtaactactatcagaataacctgccgtaaggaaaaaaaaactattttaatactatttttaaaatatttgaagccactggcaaatggccaatgttgggtagacaacggagggaaaacaacccttgaaagaggtggactatactgggtgatatttgcatttgtgtggtttttttttttttgcctcagggcaccaccttgtccacatcatatgggacaaccaggattgaagaagatagccacagtttacaagcttgaaaaatcagacagcagttagaggtctgactttggggctgttataggagcctgaaaataaggtataaaattccagaagagaggagcagcaaaggtgggagcccctcaaatatacatgtgaacttcatctaaacttttctttggctgctctctcaactatgtttatgcacagcatggtgactatcattaacaatactatattgtacatgcctatagtcccaactactcatgagtctgaagtggaaggatcatttgagcctaggaggtcgaggttgcagtgagccatgattgtcactgcactcaggctggatgctgtctctacgtaatactactaataataagaataaaatatacatgactttttaaacaaaaattacagtagtgtttggtggagtttgtaaccaatacaggcatactttagagatattgcaggttcagttccagcccacctcaataagagtatcacaataaagtgagccaaataatttttggtttcctggtgcatataaaagttatctttacactatactgctgtctattatgtgtgtgagagcattatgtctaaaaaacccaatcaatatgtattaatttaaaaatacttaattgctaaaaaatgctaataatcatctgagccttcagagagttgtaatcactttgcttgtgaagggtcttgtctcaatgtcgatggctgctgactgatcagggtggcgattgctgaaggttgcggtggcagtggcaattttaagaaacaagacaacaatgaagtttgccacagcaattcttcctttcatgaaagatttctttgtagcatttgatgctgtttaacagcatttaacctagagtagaacttctttcaaaattggcatcaataatctcatacactgctactgctgtgtcaattaagtttatgtaatattctaaaccctttgctgtcatttcaacaatattcacagcatcatcaccaggagtcatttccatctcaggaaaccactttcttggcttgcgcataacaaacaacttcaagttttatcatcacattgtagcaattcagtcacatcgacttctaattctagttcccttgctattcccaccacatctgcagatactttctccactttagtcttgaacttcaatatcatccatgagtttaggaatcaacttcttccaaactgctattaatgttgataaattgacctcctcccatgaatcatgaatgctcttagtggcatttagaatggtgaatcctttccagaaggttttcaatttacttttcccagatccatcagcggaatcactatctatggcagctatagccttatgaaatgtagttctcaaataataagacttgaaagtcaaattactccttgatccatgggctacagaatggatattgtattagcaggcaagaaaacacattaatctccttgtacatcgctatcagaactctcagatcattaaagtgcccagatggcccaaagcaatatataaatccaattcaattcgtatcaaattaccaatgtcatttttcacagaatttagaaacagatcctaaagttcatatggaacaaaaaagagtcataataaccaaaacagtcctaaacaaaaagaacaaatctagtggcatcacactgtctgacatcaaattataatactagcctatagtaactaaaacagcatgatttttgcataaaatagatacatagagcaatggaatggaatagaaaatgcagaaataaagccacatacctacaattaagtggtctttgacagagttgaaaaaataaacaataaaaaaagacagtaaatggtactgggaaaattggctaaccacatgcagataaataaaactggaccactatctctcaccatatacaataattaactcaagataaattaaagacataaatgtaaaacttaaaactataaaattcctagaagaaaacctaggaaaaactcctctagatgtgggtctaaacaaaaaatttatgacaaagacaccaaagcaaatataacaaaaataaaaaagatagatcagaattaattaaactaaaaagcttctgtacagcaacaaaataatcaacagagtaaactaatatacagtataggagaaaataattgcaaattatgtcttcaacaaaagactaacatccagaatctacaggaaactcaaacaactcaaccagaaaaaacaatcccattaaaaggtgggcaaaggacataaacagacatttctcaaaagaagatatacaagcagctaacaaacacatgaaaaaatgctcaacatcactaatcatcagggaaatgcaaattaaaaccacactgaggtatcactttacaccagtcagaatggctactattaaccagatgcagacaaagggaaaacttgtacactcttagtgagaatgtagattggttcaatctccgtggaaaacaccatggaaatatctcaaggaactaaaaatagagcttccattcaacccagcagtcccaccagtgggtatctacccaaatgaaaaaaaaatatttatataaaaagacagctatacttgtttgtttattgaagcactattcacaatagccaagtcacagaaccaacctaagtgtcccatcaacagatgactagataagttttatatatatatatacacacacacacacacacacacacacacacacaccatggaatactacatagcagtaaaaaatgaaatatgtcttttgcagcaacaaggatggagcccttctgagaactgactgagaagcaaaaaatcaaatattgcatgttcttacttataagtgggagctaaacaatgggtacacatggatatagcaatggaaataacagacagtcggaactccaaaaggagggatggaatagaggggtagaggggtgaggtttgaaagattacctattgaatacaatgttcagtatttgagtgacagttacaccagatgcccaatccccagcattacacaatatacctatataatgaatatgtacatgtattcattaaatctaaaattaaaaagataaataaaatatactggaaaaaagaactcaagttactaggtgctttgtctgtgagcagaaatattttgaaagaaattttttttcctgagcagtaggtctcaacagtgggctgaaaatattcagtaaaccaggctgtaaagagatgtgctgtcatccagactatgctgttccatttataaagcacaggaagagtagctgtagcatgattctaaagggccctaggattttcagaatggtaagtgaacactggcttccactacatttgcccctaccaagagagttagcctgttccttgaagctttgaagccaggcattcgtttctcctcttcactaagaaagtcctagatggcatcttctttcaataggaggttgttttgtctacactgtgaatttgttgtttagtgtggccaccttcatcaatgatcattacaagatcttctggataacttgctacagcttctccactagcacttgctgctttaccttgcactgttatgttatggagatggcttatttccttatctcatgaactgacctctgctagcttcagacttttcttctgcagcttcctcacctctctcagccttcatagaatcgaagacagttaggactttactatggattaggctttggattaaaggaatgttgtgcctggtttgatcttctgtccggaccactaaaacttctaacattaatgaagctgtgtctctttctcatcatttctgtgttccttggagttgaacttttccctcaggaacttttcctttgcattcacaacttcactaactgcttggtgcaagagggccagttttcatcctattttggcttttgacgtgccctcctcattaagcttaatcatgtctagcttttgatttaaaatgagagacatgcaactcttcttctcacgtgaacacttagaggccattgtggggttatcaattggcctgatttcaatattgttctgtttcagggaatagggaggcctgaagagaggaagagagagagagagagatgggggaacagactgtcatcagagcagtcagaacacacacacatcatttattgaccatttgctgtcttatatggatgcagtttgtggtgacccaaaacagttacaatagtaacaccaaagatcactgatcaaagatccccataacagatgataatttaaaagtttgaaatgctatgagaattattaaagtaggacacagagacatgaagtgggcacaaaatgttggaaaaatgtaaccaaatgagttgcttgatgcagggttgccacaaaccttcaatttgtaaaaaatgcagtgtctgtgaagctcaataaagcaaagcacaataaaatgaggtgtgcctgaatatatcatatatagtaacaagaatacaaataccagataaatgcatgtatacagatgcaaaattttcatatattacatgctacagcacaatattaactgcataaactataataatttaagggtgcatatggtaatctctggaataatttccaaaaatatataataacaatgcaaagaattgtagctaaaagaccacaaaacaaaaacaagaaacatgtgggacaaacagaaaccgaacagtaatatagtgaacttaaatccaaccataacaagagttacattaagtataaggtgactaagccttacaattaaagggtatgggttgtcagacagggttgaaaaagaataattttctttttgctttcctgtatggagactaccagttttaattcatagtatttgaattatctttcaatgtttcatacattttaattctcattttgatttattctttgatccataaattaagcagaattgttctgacatttacaatcatatgaaatgttttccttatcttttatgacaatttcaaatttaactgcaatcacataatgtagtctctgtgttacgcattttttgaaatgtattgaagtttactttgtgatttaattaatggtcgcattttgttaatgtacacctgaaataacacatattttctagtagtcagtttcagggtatgatacatttctgttcaaccaaattttggaattgtgtgattcaaatctgctatgtgtttactaatatttttctgttatctatggctaagagaggtatgtcagagtttcccagcaagatggcaaatgtgtccatttctctttgtccatcttccaatatctgctgcatatctgcagagcttgttttcttaggggtctttgagtggaaaattcctcctggtcatttaaattcttcatattcctacatgtaataatgcttttcaccttcaagattatgatattttacttattattaataataatattgctgctcagctttgttttgtctattatggaagcatctgtttgtgtccattctcttcagctgtttagccatgtcttgacaatagtgtatagtggttcttatttaatcctatctaaaaaacctcagattgttcaatttgcttagtccactctcaatttgtgtgatcatcgctatatctgaatttgtttaatacaagctttctttttatcttccacttgtttcacgttttctgtgcttctttttttctcttttgtaacctatttagaagaaggaggtagattctcaaattactcatttgtttttagggttttttttctacctttttatttccttttgtctactggtttggaaataatactcatctttatttctgtggttttacctgaaaattttcctacatacttaactaaataaatcaaagttggtatcttaacccctcccaaacagtgctaagaacttagagcaattaacactgatcagcctcctctcaattaatgttccattgttgtgcatagttttagttctgtttttgttccccatcacaaattaaacctttttgtaactatttcatatgaacgttttgggagtttttgtggtgcaagtttaccagtgtctttgttcaccatttcttctttttggtccttcttttctttagaccttccttctgggaccacagtccaccttctagatatacaatctttagggtttctaaaggtatgttggttgtaaaccctctcacattattttttcactcctgtattctgcatgcctatagccctcaataaataagagagagtcggtgctcaagtcactggaataatgagaatctctccacatccccacatcccacaacacactggaatttccctcagtcttggtgataccacccatagtaaaaggcaatctttttaccagcattaggcctaaggaacccatatggccagattagctattggcttcctccctagggctgggcatctgacctataaattaaacacaccatgtactatagtagcaagaggctgccatgctaatatgcccactttaaagtcataaaggctaatctcaagcaggttaatgatgctcagaaatcatatcacattttcctgatacattccttttcatactcacgagatggctgtttcatgccctccatttgctcatcaaatcttctgtacccttccccatcctacatccatctgatgacctatgccactgataaaacagaagccatcaggagaagccttccacaagctccctccaccacatacttgcatccccagcacctgctttccaatactatgcttgtcccctatttctgaactactcatgctgccgtttacagccacccactacgcaggaacaccaaaatatggcaaaagcactgctccctgcagcccttcccacccttcccatcgcctttcccagctctggcccaggtcattcccctcagcgtgcaaatgtgttgtcatttctcccatgtggaaacaaacccgctatggaccccactttcttctcttggttccaattatctgcccctctgctcagcaaaatccttgaaagctgtccgtccactttccacttccttgacttccttttctctttaacccagtccaatcaggcttatacccccactacaccacaaaaactgtgaagctcacaaatggccgcgccattgctgactcctgtggttattctgcagtctgcatgtcatctatgtcgtttgcagtctccatgacataggtgggcaggtcttcccttcctcactcagtgtctatggtcccaacctcctctagctttcttcctgcctcactggccactctttctgtctcctttgctggttcctctgtgtttctcagactttatatgttttgagtgtctctagtccggtccttgaatttctttcctgtgttttcctctgtgaagatcttattcagccgcatggctttaaaatcatctacatactgatctctctcaaactggtaactccaaccttgtcctctcataagactccaaagtcatttatttaattgcgttcttgtccttgccaccaatacgtatctcaaattcaacaggtccgaaaatgagctcccatgttaccctaatcctcaaaaataggaaaaaataaactgatctcttcggtcttccctgtctcagttgatagcaattccttccttctagttgctttaatccaaaattgtagtctccttgagtcttctaattctctcatatattcaatccgttagcaaacctgctagctctgtcttcaaaacacacccagctattttaatatgcccgtttctacccacgcttgcctctctatggtctattcccatcaccgacagccagagtgtcccctgttacactggccaggtcacatcgcttctctgcccaaagccctgcaggggcttcaggtctccagtgaaaggccaccatggtctgatcccattctgcctctgtgcccggcccgagcttcctgctacccgtcccctcactcctgatccgaccacagccactgccttaccacgctgggtacactccttggggccttggcactgtcgtggtgctctctgcctgttacagtccttgccaatatattcacatctgcacgactagagcctttatagtggtatcaaaatctcaacttcttagtgaggactccatgaccacaaaaattacagttgccccccacccctacttccttcccccactgccacagcacgtgttatagatatcaactattttgtttattgtctgtctgccctaggactttattccagagtcagtgcttgaccacggtttggtgcataataaatattgaatgtggcattatcatttttctgaagtatcatcacacacaatttaccagtattatcatcatggaagcttaatagaaatacaaatacaaaacaaaaataattttcgggaaataagaacaataatgtatttctaaatttctacctctgattctgtaaagctgatgaacaaaaccatcatctatctattcacccatccatccatgcctccatccgtatatttgcatgtaagtagtttcaaatacaattattttagtttacatacagacatttcctacttaggtagtgaaattaattcttgcttaggtgtttataatactcctatgagaaaattctgtttcattagtttacatttaaaattctcatctttataagcattttaaaaaatgttatcatctgcctgggatagagataggcagttgattcttatattcaacttaattgcattttgttgtcttattgtgatgtaaattacatgatattataatgcatctaaatatctgggaattaaatattcattagtgtctgtaaatcagtataaacctgtatctgagtattttgtatcttgaaaatacacctcaaagtaataccaaatatggcactgaatctaatggaacaatagaaaaaaataggagataaatataatgtaaagtatgtatcgtatttgtataattgagtattcaaagtgttttattatgaacatttccagagtcaagttctaaaatgttcattatcactgaatatgttgattgcagaattgaattacataattaataaaagatgataaatttcacaaaatcatataaaagttttcttagtcttttctaggaactaaatgtgttaatggtttcatgtatccaatgagattttttttaataaattgaagaaaatttttgtgttactgatcaattttttcataccttttactttttcagtcattaatttttatttaattatcactgagtcatagaaacaattcacaactattaaaataagtacgtttttcatgatgcctctttattctcactcttgattacttcacaagagtctcaggagagcagcagggaaagtgagaggtaaatgaagccagaatcgcaccacatcttccctcctgttgagcactggacaacagtacttgtgtgccttgttatggtagtcggttacaatttagtactgaaattaatgactaattgtgcctaatatattttcctggagattttagttgaagaaaattgctttgagttccaaaatattttcagggatcacttaacattaggtaactgggaaaagatcctgaaattgtccctgtggttaaaaaacaaaacaaaacaaaacccacctttattttccctaatctatttttaactttatatagcctaaaacactaatgggtaaatatacctttctgaacataaataataatatagaatattcactaaaaatgtaaccatgtgaggtataaattaaaagacattttgattaaaatatgaatcttgtaggagcactgagatattttggttttggatcacttgttttttaaaaatctaattcgatttgatatacatttatggaacaatgtgttcatccatggcattacgttaagtgctgacaagataaagacgacgtagtctctcccctcaataagaacttaaagatacttctctcaagttatgaaattaacctcactgaaaaaaaaatgtgatgaaaagtttacttcagacaagggattttgagggtttgcactacttctccttgagcataaactaatgggttttccttgagtgatccatattctttggccagaaatttacatttgacctgtgagacatatttagcctaagttataagaaatagcttaatctttctgacaaatcaagagcaaatatttgagtaatttttttgcctgaaatatgataggtgaaaaagacactcatctatgagttttcaatcattagataaatttagctgaaatgggcttccaaaattttctctgttagagatagaggaaatggagcagccacaaggaagcaacttcaagtatgataaaatcacttatattttgaaaaccatttttcaaattcttactatggatcagtgataatatggtaaacttgtttattagtaagctccctctacactgcaaaatcataaaatgtaaaattataaataaaacaatacagaatgtgatcttgctatgtttatagtaggaagttcaaaattaataaaacaaagtagctgtattaaggacataacagtaatgaaatatgtataaactacactaaaaagataaccagataggaatggctccttcaaatgtgagaaagtttggacatccaagtataagagctgtgggtttcagtctgtaactggattttcattcaagcaatgataacccttccctggcatccatttcatgactgaatgctaattagataccccaagtttaaaatgtttctttttttttttttaagagatggagtcttgctctgtcaccccaggctgattctccctcctcagcctcttaagtagctaagaacaggcacgcaccaccacaactggctaaattgtataaaaatttttgcagagatatggtcttgctgttttgtccaggctgttcttgaaatcctgccctaaatcaatccttccacctcggcctcccaaagtgctgggattataggcatgagccattacacctggccttcttttgttctttagtctttaatgatttctgaatagcctgcttagatcctctctagccaacacatgcgcacagaccccaaatttatgtaccgtaaaaaatgccaacccctaaatcaatgacctaaattaaaatccttgctatgcccttagccagctatatgaagatgaataaatagaatcagcctctcttggcattccctatctgtaatacaagtttgctgaaaaagttcatctaaaacggtagtcttagccccgggctggtgtgcatatggctctgtgtatttcctcatctgcagtggggccaaaggtgttcatacagctattctcgtgatgctgatgggaaaatttacaacaaaagacttttgaaatggatataaacataaacataaatgtaagttaaaaagttttggttatcatatatgtatataaatttttctaataaatatgagtaactatcattacttataatatggtaattactaatgtttttatatctagaaatcatatataatatgtaattatataacatataatattatgcacattataaattgttactatgagaagatatataagtatggttgtatataatagagttaccacatataaatatatatgttgtatgtaatagagttactatatgtaaaatatatgtttactataaaaataagcaaacagatagctcaatatatagttattcttaaaactcaacgactttgggccgggcacggtggctcatgcctgtaatcccagcactttgggaggccaaggcggatggattacgaggtcaggagttcgagactagcgtggccaacatggtgaaaccccgtctctactaaaaatacaaaaaattacccagatgtggtggcatgcgcctgtagtctcatctactcaggaggctgagccagaagaatgacttgaactcgggaggcagaggttgcagtgagctgagatcgcgccactgcactctcgcctgggagacggagcgagacttcgaaaaatcaaaaacaaaaacaaacaaacaaaaaacttcaacaactttggagaaataaattattttttgaaattctgcttccagaaaatctcttatttgctttacactagcttaattttttgtttctgaacaagaattttaccatgtgggtgctgcctgtttccagcagtgattctctacgagtggattaaaatagccaaccctttggataaagaattatactccatggtttttcatgtgctaatgtgcttagtaacaatgtaatgaggatcaactacaagccacatactgtgtaatgtcaatgacacgaggctaaataagacaacattcctacacttgagccactcatcacctggccctactgaccatgccatcttggaataaaatctccagttcttacaaatttgaaatccatacttgtttattataaatggattataattcaaattaaaacaaaatatgaaattccaccattatttttatagttaactttgtttcatttaaactcaaataattttcagttaacagaaatcacattaattactcaagcaattcctctgaacacttagggaccctgctagactgtggggataaaaccagctatgctcataagccacctctttgaagaaaaaaaatgttcttatatgtggtgtctgcaaattttgtggtataaatactcctactgcagttgatttcaaataaccacaatgtaaccaccagctcacaaaatcctcaaatatttaatgatcatctctcacaagcttgtattagccagctttagcagaccactagataaatcataaatatgttctatggtagtcttcatatcttagtagggagaaacaggaagacatctaacaggatcattattttagtaaaagttctacgggaacccaagaggaaggaatgctagaggccagggaaggctttagagagatggggatatttgaattgtgtcttgagggatgagtaggacttccccagggtgacaatggttctccaggtcgagatggtgtagaaacacgaggatgggatgtcttgacagaaggggcaatgtagtagaggaaagtgtgtagagcatagtatgtttacattttgcaataatatgagatgaccagagagatgggaggggccaggaaagaagaggtacatacagtaagaattggggatgtgaggcagagcggctaagaaggcacttgtgtgtcatattaatgagttaaaggggctttggtaacttccccaattgagtagggcagtgccatgctgggcttttcattttaggaagaacactctagaagcagtatagaggatactttggaggtgagaagaggggtggcaggatgacttaggaggcagctgcagtgcactatgaaaaaataaatgaaagcttgacctgaaatgttaagtttgaggtgcttgtgaagatcctttattatttaaaacaaatctgcccaccctaaagaacaaccaagggggaaatatggttttaatgataacaataatgatgtttaagtacataagcatattctcctcaatctgttttcccttttcattatgggactttgttgtcagcagacaaatcttattgccttccctttcttggtgtaattaagatagtaaattgagtggaatattccttttttgtcatatctctatattatgttgcttcaatcaactgaaaatgtatttgactctagatgtagtaacaaatcagatgagaagataagaacaaaagggcatatttgattcacatgcacattctgaccagtccagcattcatcaaattacatattttatggaaattcaatgatcttgccaaatgtgtaaagaaagtgttaatcttaccttaaggggcaggccatgttttgtacaaaaaacaaaaactgctctttcaaagctaattcagtgcacaaaaaatctgtgtactgttcttatcatacatttatctccccatccaaatctttttccccagttttgaactaacacttgcatatttccaatgtagtgaaaattatttatgctctgtttgaaatctacagtgtcccagcccagtggtgatgtcagcacacataggtttcaaactgatgggtcttagctggcttctagttcttcatggcggttgtagtaaaggttccatgcagaagttttaaacttcaggcacttggaatcttacttccttgtggcatcctgccaaaccccaacagatctactgtttctttaggacatattagcaaaaatattagtgggggcagaatctgaacaccactcatgtatatgcctgcttgtaaagcttcttttctactaaggataaaagcattcattttttattatcagaggagataaagacaaacttttatttgaaggacaaattttaaacccatgtgaaaattattttaagagcatgtttatattagagcaattaaactaacgaagtagtatatcatgatgcagttacaagctggtgattttcaggaaaaattggttccctactgccctttttgggtaaacttaatattaaaaaaaatttttttggtactactgttagataggtaaagccctgtgaaagcccccttcctgccaactggagggtccacctcagaaattcccttcacatgtgctccctgggccgccaggtctttgagttagcgacgctcaggaacagagaagtgcagagacgtatgcgtcgcacaatgctggactggattcagcttttcttttttcttttttgaaactgatgatttctctgtcacccaggcttgagtgcagtacagtggtgcaatctctactcacttcaacctccaccttccgggttcaagcgattctcctgcctcaggctcctgagtagctgggactacaggcacccaccatcacctggctaatgtttgtacttttaatagagatgaggttttgccatcttggtcaggctggtctcaaactcctgacctcaggtgatccacccgcctcggcctcccaaagtactgggattacaggcatgaggcactgtgcccagcctggattcaaatcttaactcttctaattattagttctgtaacctctcagagattcatgtcttcattaatcacatgagaataatattgttcagtttatatagattttgagaaaacttcctaatcaccagtgacaaatgtttgtcatttagtgaatactcaaaatgttactttacttagcaagtataattgctaataaactccagattgaacggaaataattgagttaaactttcttgatattttcaagtagctcacttcttattttgtcttcgcaaccacaacttccttgccctttctctttttgtgtcccttattctattcttttacaaagttacagcagttaaagcatggagattcattctggagaagaatcagttttgtgcattctcctatgttctctgctcgtaatggaaccgtctccaaactgcatgcaacattgcaaacgcacagtgatgctacatatgtgatttcatgggataatatgatagtcaaatttttcaaagcaccaggaggaagagaaaacagttaacctatggtaaaccgtgtcaagataaactgatcttcaaatgacaaaattaatatataggcaaatgttagaaagaagcaattcaaggactgattgagaagctgatggtcattttctatgtatcttgaaaagcattacaaactagtatgatattctttcttcttgctcacaagtggaaacttctcctactgttcctaggctgccaatttttttcttttttccttcgcaaactagagcccattctgcactctctctccctgaggtacatgtgcctttccaaactaatatctctcactttttcccttcggttatattcttgtcctgtcttatttgtcctggtgccttaggggaacctttcaacacacctcataagggccagggagtccaagaacaatactcacttttatttccatacactccatccttcatccaaacagtcagttctaaaatatgttgaacttcaggtttaccagtgctgctggcagggacaggggagaaggaagatttgccagggagatttcagaagcacacagagcaagagggcagggagcgagggagcaccatgtcttggcttctcacctccctgtgtacgttaaacatcatgatgccagtttcttcagctctggctggtgacagtactggttcaaccatcccatgctttccccattctttcccttgtttgtcatcattgttaaccttgactttgggcagagacttcactatacaaaagctctttacaaaggaaatggatacaatgaaagaagagttttatttttttaagcgacgttgtagaagcaaagaaggtctagttttatctcccttccaccttttccgttctcattcttattctcatctctctcaggcaccatagacccatcagactccttccttgctgcctccctcacagggtcatgaagttttccttgtgcctggccccacagcacttcatgtttctctactgagaaacatatctaggacaagatacagtgcttgccttacacatatcgtatcctcaagattggtcaaatctaatcgtgcttttcccacatactagacataaattatttgagggtagggattgaatcttctcatctgtccataactttcagcactgagcacactgccctgagcaaggaaaatgccctatacattttagttgagttaaattgacaaagactgtcgttttttgctttgccagataaggataacgaaaagtccaaatccatcatgtcaatctcttcattaaagttcccatttccttaactaattctaattaaggcattaaggcaagtatagtggtaaaaatccagtctttggagccagaagaaaaaggtgtaaatttcagtattcagtagaggcttaggtctccacatctgtgaaatgaggtaaggccgtcttcatggaaatgctgtgcagaatggaagggtttcatgtactaacgtgtatcccaatcccaggagggtttatgtgtagaagaggaactggaaacagcctagtacattcacaatagaggaacaattcaaagggtgaggtctcattccagaaactcagctggatccctgtctcccacatttaaacacttgatttccctctcatttattttttcttatgtcacttaagatattaattacaaaaagcatgcagtacataatttgttaggatattttctaccaagtgggcctaaaaccagacttaattgaaaatgatccaaggttcattttccatgaaatttttctgagataaagcaagagagcaaagaaagaaagattaaatcatagaaaataaggcaaatctacatcgctccctactctgcttactttttgcataactccaaggttatgagcaatacaatgctgagaacctgcaaatgaacaatttggggtgggtgttcgctctatgtgtaactccaacagggaacatctaacatctttttcaaatacttaagcgaatttaaagaatcatgcccaagggttgactaaagctattttattgtaaagaattatttaagcagctcttattcccactcagtgaagtcaagacattctaaaacataatcttgcaagctaggttgagtcattctgccaagggggctactgacaggatatattcttgaaaatactcctttatcaaccctataggaatgctgtgcaccctttttgattatcacaaatttgtgtttaaaatcttgatatttatgtactatgtactttgaatacatgagcatgatactttaaatttgctaaagtatttgaaaaagatgttacaggtattcactgttaagagttaaacacagagtaaacacccattccaaattgtccattaacagctctcagtattttattgttctttggtattcttgtatataatatgatatatacgaacaggttaaatacattagttctttgcttttgtaagtaactcattacaaatgatttgagaaaattaaggtagacttttacatttaaagcatccttaagagatttttaaagtaaattgacccagaaggtcctttaaatggaaacagttgggattctaaagtaaattgacccagaaggtccttcatatggagatggtggattctaatgcagacactggaaagaatgtcaagggagctgtaatcaaatactatattttggctgttggtaatttactgaacagttgacttttggtaatttatgccaaaggtgctttgatgtataagtaatctattttcttttcacttgcagttcaagtactttgggaaacacattcactatttcagaccattcaggcagcttattgctgcaatacctcagggaacagtttattctttaagaaaatttggtggagtgttcttgaatttttgttttctaaggacctctgtacctataatctaaaattttagtatctctatttttctagaataaaagataccatgcactaaagccaccagttcaaatactcttgtcaccctaagagctcttgaaattgcacctggcggaaagcatttcccagctaactggaaataaggaagagttccctttcccttaccctgtttgttcctgaaatgctcaagaagcttcatttctaccttcagaaaacaattgcaagactgcttgtactttccttagctgttgaagttcctatgtctaaggatgtaaacatttgttttgagacagtatttcttttaattatatatcttagaagagcaaatagcctacctagcatatttaactcaatcccttcagaggtccccagtgagaatttatacacctgagccctaaaagtctggggtcattcagtgtttctgaagggcaggcaggtggatatcaagtccacatctttttaggcattacttttaattactttaaaagtaaacacacttcccatttgagttgtgtttcttccactaatgagataacagagcagtgttcctaggacactggctgctcctcagtgatagcaagtaaactgcacaagctacatctgtaattggttttctgatccagcctcagcaaacacacgtgagtgaagttcatggaagggataaacggatttagttaccttcacgagctaccttcaaacagcagtttaattttgtttccttatagcagcttccctcccccagcccattagagcttcttgatttatgatacagtagttgtagctttcccaatcaagacaggattttctcctgtcagaaaatgtggctccctaggataccgccctgggagagtaaatgagattctaatagttccagattatcactaaaggcagggtcaaggaaataacttttattttctttctattaaccgcacatagcaatgaaaattctcaattaataggttaatttatatgatttatagttcaatatacagaatattaatcatgagacattaaaagaaatgcttcctgttaatatcacttttctatagtatctaagtcgctttataagctacatgatttgttacaattaggcaggcatgttacttatgaaggtcaacataatattggaagggcccaagggccatttgtttttactaatactgtacaattttcacttaatatctagaatttgcttccttggtcttacaaagtcaaattcgtttacaatggaatctgttgctattttttgagtattttgtgtatcagagcctccttgtaagtggtttgctatcaacaaataatcaaacaatgacaagctggaggtcattacccttgaaaaacttcattggtttagaaattcaattcaaattttgtaccttattgttatcaataaaatttatggctaaatagcagtaacattacatgtgggatgtctacttgaactaagcacggaatctgttcccaagatcttaggatctaaaaggggaaaccaacaagaagctagaccatttgcaacacaatgtgaccagcggtgcaagccatgtatgaacatgcgtcctgatagtgccccagctgggagtgtctctttgagtgacctttaggccagcacctcctagatacttggtcattttactgggaactccttaagttcagtcactggttacctgcataattggaaaagagtttttatggatgactttaggagccatagcagagaattagctcctaaagtcattcttgactcttctgcaatcagaaaagcaccatgattaagtaacagtctctatgatgaagccacctagaacaagcagatcttgaagaggagtgagtctagaaagtgaggttagtttttggcctctgtggagaagggaggtgctggcgcaacccttcacctgcaccccagttatgtgtatttccatttctaggtgcaagaatggccctgcagcatgtaaagaaagtctacgtagaaaatattttaatttataaatttttaatctaaaaaatgtatgttattctccattacaagttgtagggtgggatatttaatcccacagattttactctattgtgtattagaaaaacggagaaggttaatgccctagatttaattcagatgatttaacatttgaagttcctatcccgtgagttctgttctttgcatgagagagccagtgcacacacacctatgttaatagcagcaatattcacaataggcaagaagtggaagcaacacaaatgttgattgacagaggaatggagcaacaacatgtgatatacacttacaagggaatattactcagccttgacatcatagaaaatcctgtcccatgctgcagcatgagtgtaccttgagaacattatgctaagtgaaataagccagtcacaagttgacaaatactgtacatttcacttatgtaaactatctaaaatagtcaaattcatagaaacagaaagtagaacgctggttaccaggggctaggggaggaggaaaagataaattgttgtttaataggtacagagcatcagatttactagatgaaaaggttctggagatctgtttcacaacaatatgaatacatttgacactactaaactatatacttaaaaatagttaagatagtaaattgtgttatgtgctttttcaacaaagagatagtctactgttttcacattttaaaacattactatgtcagaaatcttgactattgaaatccactatatatatagatgtaggctcgaagaaatatagtaccaagtaagcagtgcatggcacacatttctgtcacgcaactttaacagagggcctgcagaaaaggcagtgaaaatagaccaaatatgatgatttaatcctgacctggaaaatgatttagatgaactcataaggttccctctttctcacttatctgataacaaaattgaaatacccttaaaaaggaaatataagctcaccattgcatataacagatctgttgtttggaaaatcagatctcataattgtatttggggagggaagaagggagggagggaaagaaggaagaaaagaaaggaaagaggaagagaaggaaggaaaggagggaggaagacagggaaggaaggaaggaaagaaaggagggaggaaggaaggaaggaagggatggaagggggagggagggaaggaaggaaggaaagaaagaaaataaagagaggaggggtagagaatagagggcagaaagaaggaaaaaaggtaggaaatgaagcctggatgcaaaacctaattcttaaagaaagctttatgacattctcattattcctacagaacctgccattggaaagacacatattgcaaatgacgtggaacttacaaagaaggaaacaaactttctgagatctaaagtgtagttctagaggcccacgtatttcattctctgcaaatgaaaaccagagtgtttttattcattccgcatttttccctagagatttatttggctccagaggagacctatactatatgcttaaaatgattggtattaatgttgactttcagacagccaaaacgtttgagatgtaacagggaaggactggcaagcttcacacacgtaggcattattctatttgctatcatatttgtgtgagatatgtttattgcaaaatgcagattaccaagtgaaatctgggcaagtgtttcgaggcaatcttgagcatatgcttatggtaccagttaaaacattttagactgagaatgagaagggcttaagagagctactctgctgggcgcggtggctcacgcctggaatcccagcattttgggaggccgagacaggcggatcacaaggtcaggagttcgagaccatcctggctaacatggtgaaaccccatctctactgaaaatacaaaaaaaaaattagctgggtgtggtggagggcgcctgtagtcccagttactcgggaggctgaggcaggagaatggcgtgaatctgggaggcagggcttgcagtgagccaagatctcgccactgcagcactccagcctgggagacacagcgagactccgtctcaaaaaaaaaaaaaaaaagcgagagctactccaagaataatgactgtgaatatcagaaggacatatttaggcatgtttcattctaccagtgaccaagaagtgattatcctttacatggtcatttcactgagaaagacaacaaagaaaatggctgagaaaaaagatggttgataataaatagaatggaatgttggcacccacagaaaacaaatctagaattggaagactatgaatgtgcacatttttagattgaggtgagtgagactgtggggaaagcaaatgcctttcttgagtttgtgagtttgaatatctctttgcctctctgtactctattgtcttttaatctattaaagaaaatagtttcattatactttctccttttaaaaccaagaatagttgttcttttctttcctgatggaagaaatctgtcaaatgatagtttggatgtgtttgctgttttgatataaagactcgtcatgactagatgacaaaacagagcagcaatttcacattctcctatgaaagacttaagcagttgttttctgttgccaaaaacacccatacagacttaaaagcagatcataactttcgtagttacgggctttaataatggaaggggtgtggctatatctgaggaaaatatattttttatcttatctttatgatgcaggttaactcttttagtgaactttgcctgaattattatgctttttacttgattgcactgtatttgaagatataatttgtatttcaaatagcactcagcaaatgtatgttaaacattcagttctggcctggggtgatgtctcacacctgcaatcccagcactttgggaggccaaagcgggcggatcacgaggtcaagagatcgagaccagcctagtgaacatggtgaaaccctgtgtctactaataatacaaaaattagttgggcatggtggtgggcacctgtagtcccagctactcgggaggctgaggcaggagaatcacttgaatccagcaggcggaggttgcagtgagccgagatcacaccattgcactccagcctgggcgacagagcgagactccatctcaaaaaaacaaaaacaaaaacaacaaacaaacattcagttctataatatttgttgaaagctaacactatagggaaggatgttttgtttttgaaattttctctcactttctattttttaattgctaggaaattacctgactgacagaacactttctagtgttttttcttagaattacataaattacagaattgaattatttccgttcaatacaagctaatgtaaatcttgactccactcaggaagttaagtagcagtgttctaggtatttacgcttcatcgtgctatctggagagtaactcatacctgtcctgaacagaaaaaaaatagtggtgatacaaataagatgttgtataccacttttaacttttcacagttttttcttgtgtgacttttaattctcacaacagtggtgtaaattaacttgggtgtacagtgaaaatcaaagtgtttaaatgcctgagcttgcacacatatgtagtcactatggaatccaggattttgtatttaaatgggaatatgtactcagctaaggctcagggaaaaacaaaggaaagctgatatacaccaggcgcacatacacactgacacccaggcacacacacacacacagacgcccaggcccgcacacacgctgacacccaggcctacacacacgctgacgcccgggcgcgcatacacactgatgcccaggcaaacacacactgacgcccaggcccacacacacacggacgcccaggcgcacacacacactgacgcccaggcgtgcacacgcactgacgcccaggcacacatgcactgacgcccaggcgcacacacgcactgacgcccaggcccacacaaaccctgacgcccagacacacaaacgcccaagagatttcgcatgtaatttgcaatctggctgtgtctgttctcagtttggagtttgcatatatccatacttatgtttgtaatcccatgatagactttatctttttcccattactcttctcaattctttacccttcttggatgcgtaccctttgccatttgactagtgacagagcagacttgcctgctttggtgcggctgggcatggccgtgtgtttggctcggcacatggtcagtggatgggtgttagtcacagtgtgccagctctgagcatcagcgctgggaggcattgcaagccacagagctgtccctattcttctggtcttgggtagcctgctggtccaaggagaatgaaagacaagtggagcgtaactacatctaatatgaagcttggagccagcctggctgactcagtccaggtcagctggctcccagatgaccccagacacatggaaagagtgccaagtgtggttttaagatgctaagttgtgggttgtttgtttcctggcactattgttacactagctaatatcctacgtattatgtactatcagcagccatgaaatatgttctaattcatacatgattgtgaatcctcatgcaaaaaagctctttttcttttctattcttagggtatagtaaagtagcctcttggatccaaataaagtgagctcaataatattcattgttacataacaaatagccacgctaagaatgtgccatcataatttaatcacactatactgatcatcaggattcttctttacaaaacagagaagataataccttttcattccaccccttggaattcatttgttcatttactagcttattcaattattagctgttgagaacctcttattttcctaggatataccatggaataagataaagcccttaatgacacaggcttctaatctattcggtgacatagcaaaaggaatggctacttttcaatacaatgaacacgataatgaagctaagttcttggtagtgtaggcagacagtggagaatattttaggcagggaaagcaatatttgagttaagccttagaggactggaggaggggaggacatacaaacttatattctcataagcttaataagtacaattagaaaaaaaataacttgacactagacaatctgtttaaacaattttaaccaaataatcaaggttaatttaactaatagtgagacaaatgaacgtcttctacctcctgatccgaagcactgagaacacagtattacttatgcagtgctttttgctaaaaatgcataacctgaatctaatcgtgaggaagtagctgacaaatctgaattgacagacattctacaaaataactggcctgtacccttttaaaatgtcagtgtcatggaagacaaaggaacacggtggaactgttccgcattagaggagacttaacagcacgatatcttaatgagtttgcagcataggacgtcattgggacaattggcaaaatatgaataaaatctatagggtgtataatagtattatataaatgttgattttctaattttgatatttgtactatggttaagaaacagaatattcttgttttgaaataaacactgaagtatttaggagtaaaggggaaaaatctgcgtgtatgtatcagaaaaaccaacacttcttcttcccttgcacagtcaacacaacagaacgttctgtgaccaaagtgtggtggatttctccaagccaacaactcattgtccagcagacaccaactgggtgtcctgcaagttatctggatcctgacactcgccggagtcagtgcagaacccacaggggaagagcccagtcttgtaagatgccctcacttcagcagcccatcgcaagtcccacgtggcgaccttgtgacctgtgcttctgactgcccagctatccacagggttttctggaccctctcctcaggtttaatagtttgtgagaacagctcatagaactcaggaaaatatttaacttatatttacctacttattatgaaggatacagatgaacagccagacggaagagatgcacaggacaagacgtgggaaggggcagagcttccatgtgtctccgggtgcagcaacctccaggcacctccgcgtgttcagcaatccagaagctgaatcccaaccccacagtgcaggggtttttattaaggcttcatcacataggagtgatgggtcatcaacgccatctccagcccctctccccacttcctggaggatgggtgatggggcttaaagttctaaacttctaattctggcttgttctttctaggggccagtgcacctcacccccagaaaccccccaagatttgttgcattcaaataaaagtgctcctgttactcaggaaattgcaagggatgagaaactctgcatcagaaacctgggtcaaagaacaatgattagaaaacaaaatgcacctaccacccccatggctcaaaaaaatcaaagggttttaggatctctgtgccagaaaacagaggacagagaccaaatatttattttgtattgtaccacaacatcactgtgtgtgtgtgtgcagatggataaagaggaagaagtgtggatagagcaaatgtggcaaaatgcaaatatttgaggaatctgggtaaatgatatgtgtgggaatttcttgtataattcttgcaacttttatgtgattctgaaattatgtcaaaataaaaattaaagtaaaacaagacaaaaggatggggaaaagggttgatcctagggtaaaatgatgacagaattaaaggtaccagaaatagtatgtatcaagtcgtgggtacatgcccaaacttgacatggaaaaataaagactaacggctctctcttttctgcatttagatgcagcattttactgtactaacttttctacatgaaaataaaactcacaaaatcagaatgggctctgaaggttgtaccaatgtcaatttcctggttttgatattgtgccataattacataagctgttaccattgggggatactgggtgaagggtacacaggacctcctagacatttctttgcaacttcctgtgaatctataattacttgaaaatgaaggtttgggttttttaaaaatacttttctaactcccccatacaaaggaaaatttattttgttaacctcatattgatgtgaataacttcgtgtactgagacttttacctctaaacaggactaagatttttcacatttatgttagtaaaaaaaattagtaaattttaaatttagtataaaatttccaagacccatttatttaatattccattttaggatggcagagattctctccttgactgaaatccagccagcctcctctgagctctcttctccactagggcccgaccttggcctatcaagacttgaacaaacactagcacagtttcccacagctgaaggccgcaaccctcaggtgaccccagtcccccataagtgcctgcctgagcaaactcaaggctgccaaaagaatttactgtttgttccagcccacacctgaagctggagcccctgcttcccagcctctgtgtgagggtaggagcctaacgttaactcatgtccagctttggcaaagagtacattttatttttatttgctctgtcactagggcatccacattagccatagtgctgcaggatttcacatttcagaaaatctcaagcaaaatgtaatcatagctcctgtgaattgtgcatctgctgtgacccagacattgtgctttcctttactcccacccattcctcatcacagccctgcaaaaagaaaacaacagcaacaccgtgcacaggccaagtggcttggtgatagggctagtacacggtggcggagactgcggacccagcgtggcacatcacgggatgtatcattctgctcagctcgtcaggctggcctgcaccagtgagcgctttgtgtgctaccaactgtcataattattgagctaaggagctcgataattatcagtggagaaaattccaaggctgatcatattagagctttacttaatttttgatacctgattgccgacagttttgaagcctgacctctccctcctcctctttgctcacatctgcgcaagctgatgagaatgtgtgggctgctgtcttttggcacccacaggaaggctctgccccaccagggaaccctcaccccagccccaccttcaagccaccacaccagtctcctttcctggctcgttcaagacatttttggatctgcctgggaattgctccctgatctccccaaaagctctcattatgtgagaaataaagcttttcctgttctcttggtgtatgtgtggaatcaccagtcttgacctctcaatcaaattttgtgtggggagtctcttgtacttcttcagagtggccacaaaaggatgaaccactgaaatgtttaaatataaagaaatctgtattttcaattcagttaatcttcaggccatagaatataacttgtctctcatatggagcttaaagttagcatttagttgacataaatgctccaaaattcacggtacacgttgatgctaatacctcgcacaccgtccagtaactaggcacatttcaactttcattctcaaagatgcaaagatttctggtttgtaaaagcagcttggaatgttctttctgtgaaaataacacatttacgaaaacacacttggtgtgcatttcttctgaagggaatatatatttctttatggagcttagaattgcttatgaaaacaatataaaacctgtccgtattctattatggccctatttataccttcattcctaataaatattttgcattcattactgacttttgactttgggtgtaatataaagaaaacataaaagcatgaaatggtggttacaattttcagttttaaaaagtcatcttaatgtttctttggaaaaacatgtctcctcatgaaaagaaatagtcaacaagttcatattttttagaaaaagttaaaagcacatactgccagaaaaactaaattctctcaaattatattaagcaaagacaaataaacttttatacattccttgctttagcattcccacaaatgcatacttgctgttttaaagaaaaatgatcagagagcacaagaaagttagtagaaagtaaaattttatacagaagtgtagctgcacatttcagtattaacagaagtcctgtaatagaattaccatgccatatttcaatattaataccaataaaaagaaataccagttttcagaagcagtataacagccctctgctgtaattgggccctccttagtgggagacagttttgactccctgttcttgatacacacaaagctgtaaatatggccacttccctgttcaaacccagaatggaaaagcccctgataagaaagtctcgcttagcatgaatttttaaattattatcctccagctatacttttcacctccatgcacagtatctatatcaaacaagctaaacagattcaatttctttcctccaagaatttgttcaggccatactcaaatgtataggctttaagtggggtgggtcagcaagagaacagccaacccaacatgggtaaatcttgtttatgagggtggaaagttttaatgctttacttgattcattgctagacaacctttccatccaagaggccactatttttacaggtagcttcaaagtatatcaaatataaaagaaacagaaataatataaagaaaataagaagccataaataatttcaatgtacttatttaaaattttattaagtagtcatcattaatttcttagatgtttgagagcaaaccgtgcataacgtgcctgagcgtaagaaactagcagtacagaagaggagatagaaatctgaatgcaaaataaataaaaataaataaaagaaatctgaatgcacgccggcaacagggtgtgatgagttcaattacagaattctctaccagacacagtagaactcgttagctttgccttaactacttacggtcaccaaagcagacattttagttggacatagaagaaaaggagtcagggagggcagggagagggtaaggaaaagggggtgggacactttttaggagtaaatggcctgtccgaagcacagaaatacggaagaccttgatagattctagacagtgtaataagagcaaactgttggcaagaggactgcgagataagactgccgggctgacggaatccatatacagagactggtgatggaggtccctggaaggccaattttctgtataagcaatggggaagtgtatcagtcagatttttttttttttcagagtcttgctcatcacccaggctgcagtgcaatagtagcatctcagctcactgcaatctatgcctcccaggattaagtgattctcctgcctcagcctcccgagtagctgggactacaggtgcgcgccaccacgcccagctaatttttgtagttttagtagagatggggtttcaccatgttggccaggatggtctcgatctcctgaccttgtgatccgcccgccttggcctcccaaagtgctgggattacaggcgtgagccaccgcacctggcccagtcagggttttctacaagaatcacaaacaattccagtcattttaagtggaaagacatgtaacacacaaagtaaaatattttcaggatctgtagaaggtctaaggagtaggtctgagattagcctcttggaatcgcattacacttcaaacaacacagactggagtaatagagctattctctctgaggccaccacactggaactatgctggaaataaggggttaaaactggcatctctgccaccaccacctgtcaatattcaggagcctatgtaacagacgctggctggctgctggaggaacatcatatttccatggactttcttataaacggcaccctccaaaactttcacagagacggactctgctcactcctgcattccaaatatctcatgagttcatcaatacagaattctagcatcaaaagaatctaggaagtgtaactgaactttccaatcttcccaaagagagaaaagatgcaagggagactgagtgaaccaacataaataatacagcagaaataccattaacaatgctatgcaaaaaaattgtatatttgaaatcttctaatatttcttatctgtcaatatagaaatatggatgtcatagaaaaggcataaattagaatagaagttttgcatatatatttctaacctgagtgcttatttataatatggaaatcggtttctaggacaaggaagaaaagagaaatcgctcttttatttaatcaggaaagtttatgaaaggcaggagattctgagacctctccataaaggaaaaggaagcttctttgcaaacaaagaataatgattcacttcagctctagagaaatgtatgaaggaagggaggaaaagagttgaaattcagaataagagtgtgattccattacctgaagaggcaaaagagcaggaggaaattggacaatctagggtgggtgaactccacagtatgcagaagctggtgttcttgcctgtgagggtgaggttatttaaagtagttcatcaggggaagacacagggtatctcccaggtccacgggaactggggtgtggaaatagtgtcaacactgttcattgaaataatgtgtcagctggaggggaatggtcagcctggaaaagcagaagtaaagttggtgggagttcagcaccatctgagcagaagtgaacccagaggcctccctaaagcagaattctttcagtacagcaggattgttgcagtgagcttacccaacaccaccttgatgacattcacactcatcacttttcccctcttgctataaaaagctaatacacagtcagtgacacagtgtttgacctttcagttacctgaacatcaggaagcacatgttgtgggtggggtgagaaggagacaagccctattgtgcatatgcatgtctatattatcttctatacataccttttcatgatgtcaaaagatctttcatctacagctacataatgttgaagtgtacagaaaaggaagctgagattgaaatactggagtgtgatgaatgaaacccagagaccaatgtcccaaacatagcccagtctgcatctcccacatgaaggaacccaaggaatgggtaggaatattgtgatactccttaaatcatagttaggtaaattattccaacacctgctacctaagtagcatttacccatgcctttcataggaaagagagtctgccaactatctattggaatagaaagtgaggcaggtggaagaatcttatttgtcagtgttagattcctttgcaatgacaaaaacacatctatacaggaagaaagctattttatcccaaatactgaatgcaactttgttttccttttgtcttattagtcacgtttccatatatccccacttaagtgacatgagatggatgggtttccacaaggatcagctggaggagtttcacatccatctggcaaagctgcatgaagataagcctcgtgttttccagggaactgcattgctctacagaggcaatgccgaattattcaattgctttatgaatatttcctcccattaacctctctctgaaaatttgctgatacgcattaagtgtctcttaaccaaaatgcttggaaccgggagtgttttgaattttttcagattttggaatatttgcatagacataatgagaactcttagggatgggacccaagtctaaacgcaaaattcattactgtttcatatgtatcctatacatatagcctcaaagtaattttataaaatattttaaataatattgtgcataaaacaaagttttgactgtatgttgactgtgatccgtcatgtgaaatcaggtgtggaattgtccacttgtgttatcatgttggtgctcaaaaatttcatatcttggagcacttcacatttcagatttttggattaggaatgctaaacctatattgccctgtgtcatgggtccctaacacaatccatttactctttacttatttatttatttattttaaaaatgtttactgaattcacactatgagcaagacattgtttggtacaaaagaccaaatttggtaaaacaaacaaacaaaaaacatgctcttatggctaagaaaaataagcgaggaataaaatggatcttaagatgaggaggatgatgaatgacaaatgtcacaattaatatatagaaggtactgtcacttcacctagggaaactgagaaagcttccttagctttggagccatgaaggatggctaacatttacacaggcataggtatgagtctcagtagagagccaagaagagcaggagcctgttgtgaaaagcagtgaattacttatttggctagtgggtaggaggcaggaaaagtaaacctgaagcctttggggatgtttgcaggtagctgtatctattgctgtttggtgcccagagtatatgactgtgtggcgtcatttaataatgctttagtggaacatttcaaagtagccccgcataaaatcgttcagcgtaagccagataatcctacctagtttgagaggcatttccaaactagactcctgggccaatttgccatattgctacattgtgctggggctaggatctgggccaatatgaatctagctttctttaaaccagttattatatctttgcatagtatgtgttgcatcctgggctgaaactgagccttggagggagcctaaaagagagtgaagaatagcaaggtctctaaagtcagactgcctaacatttcagttctggctggagactccagaataagtcaccaactttatgcaaatatcacctgtaaaaacaggacaataacagcacctgtctcatggagtcattattagaaatcactgaagtgagagctcaatagatattacctgtgatgatgacatttgagatgctcatggagttagtctgttctcaacattgctataaagacatactggagactgggtaatttataaagaaaagaggtttaatcagctcatagttctgcaggctgtacaggcttctgtttctgggtaggcctcaggaaacttacaatcatggcagaagttgaaagggaagcaagcccatcttcatatggctggcaggaagtgtggggaaggtgcctttaaacacacttttaaacaagcagatataaggaaaattctatcacaagaacagcaagggggaggtccacccccatgattcgatcacctcccactgggcccctcctgcaacactgggaattacaatttgatatgagatttggatgggaacacagagtcagaccatatcatgatgtaaggtgctggtagtttggctgacatttcaaacaaatctggctcaggcctagggtttgcagagtcacatgggcctacttgggaaattacaatagcagagcaaaccttctaaatacatttcacttccagaagctgcacttggatgaaatactgtctcctgaagctctgaaagtcccttttctgtgctgctcaaggaagctctaaagacaggttggttctgtgctactccaaatagctccaaagacaggtttggaacaatgacccataaaatgtccatacattttaggatactaatgaagagcaatactggtccaaagttcagtggtcagagtatgggtgtgtttgttttatttcagaacatctgtatagcattttcattgcttatacaatagcaggtatcttcagtattatttaaattgaacttctaaaccttctttgacaacataccacgtatccatttatacatacacactaaaaataagagggtgcatccttaattttaaatcagttgcatagatttcattgtatagatataattagtaattttcctgtttattggcatctcagttatttccaggcttctactagcaatattatcatgaataaattgtatgtatgttaaaaaataataagctcattcttagtccttgttgaaaaaattttgtgttacttttatgagcaggatgcaagactcagacaaacaaggcctaggtagctcatactttattctttttgcaacaacttttgaaaggcttggaatattctggttatagatgaaagatgctgttatttgctatttctcttcttctccaagtgaagttctaatgaaaccatgtgtggaagaaataaatcattggaaggtcaagaagcttcaaaaacaaagtttgaacaagttcctggtattgttgctgagtgttaaatattctcaacttatcatttgctcttctagctgcagttttgcacaaggaagacaagtgggagcaattaaatcctgcaccactcctcttgaattcaaggctgagccatttggacaaagaaaattggggaacaggagcaaagaccctcactgactgtgttcttttttccatgaattagaaggaaatttaagaaaatcactttgatcctttttctacctgtaatgttaaaaactgtaaatattttctttcattgagaattctgggatacagtagcagacttggtaaattttaaaccgaaaaatttatcagcgtttattgcacggacaaagcaataaaaaattgcatcatctaagatgccaagaaaccacatgtgatacagtccaaggacatccagaattcccatggtcctatgcagtagcttacaaacttaactctttttggaaaatatggacatacaatatgctgacgggcttcccattcattttaagtgtttttagtgcaagtctctccactctatgatttcttgataagttcctcataatgaaaattcttttgtcattatataccttgttagttctgattcttgtccttgggaatcaaagaatattagggttataggtgcaacatcactcagtcatttaggcaaaagcctttcattttaaagattaagaaagtaatctctgagcacacgaaaagacagtggagcattgcactttcatcttcatttcactcttttgcttgcaaactccttgagggtaggaatttgttttactcatcaataaatctgcagtaatacaacgtggagaatgcagttggtgcacaaacaatattgaaagattgtagatatctctgtccaaagtcacacagctgccagaaccagtggctcactgggatgagtcttgtgtctactgatcacccgttaaggatgttgcctctgaattattcctccaagggtttttttccccctgggatgaagaataaatatctgttgttttccttatcatgtaaaaaaagtgtatatgtttctgcaaatactagccaaagcatcctactttaaaacttctctttaaaattccggggagtgtcaccttgacaacaggcacagaatcttccaactgcaatagaaaattgacaaaattttttaaactcagtgaaaaaaataaaccccactaccagtaattaaataaacaaaatgaaacaattccttgccataaatttcagaagggcaggggaatgagaggagaaaataataataattttttaaaaaggcaaggaaagaagtagaagattgaggcttagctctgggaatctcgtaacctagtctccactctttgacaggtggtactgaggatatcaacagaattaagaaggaacatccaagactttacactaaataagtattcaagttgaagatgaattatcaccaggggaatagagtaattcatggtagagaatattcaacaaaatcgcagaaaagagtaaaaaacaggttcagtaaagatctactcttagtttagctttccccttcttacttgtgcctttcatagcctcactatatagaaatctatggctcagaagaaaaggtaaacaggtccagataagaagataaagatgttggggtttccagtttcatctcagacatgtaaataacctggaagtcattattcctgttcttacaacaataaaacacagaattaactgaaaataaatgacttctttgacccatcataaaattgaggttgcatggcgaaactccaccccgaaatctagaagacaggtaaatacagaaaatcatagtcaagatcagtttacccggagtggaagcccctgaagccatgcctggcatgcacattgagaagtgaccgggcaaattgctggaggctgagtgtggactgcatgagactgaaaaactctcggaactcatagtctcagggacaccccactgcccctgccacgcttttgtgattagacctccaaaaaaactctctctcctctctcttcccaacctaggttcttaaagtaaaaacgaaacaaaaatcctttcatgtttctgacaggaggagaggaaaagtatgtattttgaaatacgtccaaagcgttctgtataacaacacctactccatagaggaaaacttgaccatagccttatctgacttgtgaaaagggcaactaagcaactccagctactctagccttcttgtctcttctaaaggaaggttgggcgaaaaagctaagaaatacttttaagtcagagaccagggaacagattagggaacaagactaagatataattgtagagtacagaatgcttctgtagtcccgaaccttatcaccacctcagcagggcttccaagtaataacagtgggctgtaactgaaagagaggcaagatgcagactccagttaaggagggaagcagggtctaaagaagcccaaagacatcaggagagacaaaaataaaaacattagacatatttgaagcctctggaacctgaagctaaagtaaacagtaaacataagcaggattcctaggcagaacaacaaaacttcacactgaaggtctacttacctcagtttcaattctccaatacattaagtccagcttttcacaaaaaattttatgacatgttaaaaaggcaggaaaaaaacacagcctgaaaagacaaagcaaatgtaagaactaggctcagatataacacacactgtggaattgtcagataggaaattaactgtgatcaacatgttaatagttctaataaaaaaagtagacaaaaaacaaatgggaagtataaacagagagatggaacccctgtgaaactaccaaaaataacctgttagaaataaaaaattatccaataaagatgaaaaattcatttgacgagattatcaataaactggatttggcccaggaaaaattaatgagcttgaagatatgtcaacagaaactattcaagctgaaatacaaacagaaaagatttttaaaaagaacaaaattgtggaacaatttcaaatgtataacatgtatagttggaatatcagaaatagaagcaagagaaaacagatcagaagaaatatatgaagtaatagtggctgagaatttcccaaagttaatgacagaaacaaccagctacaaagccaagaatctcagaaaatactgaggggaataaatatatatttaaaattctattgggcatattatattcacatgatacaaaataaatcacaaaatcaaaaatgaaaaaggccagggaatgaaacattaaaaatattttaaaatatatgtctaaattacccacagaggaaagaatttcaaaagaaattacaaatattttgaagtaaatgaaaatgaaaatacagcttgtcaaaatctgtgagatgcagaaaaagcagagcttacagggaaatttaaaacattaagtacatatattaagaaagacagaatgtaacattaataatttgagcttccatgttagcaaactagataaagaatagtttaattctaaatcaagcaatgtaaataaaattagagcagagataatgaaacttaaaatagaaaacaaaacccagaaaatcagtaacccaaaaattgatctttgacaagatcaataaaattcataaacctctgactaggataactaagataaacacagaaaaaaaaagagtatcaataaggattcacccagtatataaatgcaagtagaacttctggctcaagctgccaaattttaaggtctctgaccttaaaagtatttcttagctttttcacccaaccttcttttagatgagacaagaagactagagtagctggagttgcttcattgcccttctcacaagccagataaggctatggtcaagtttttccctaaggagtaggtctcgttatagagaatgctttggacatatttcaaaatacatatttttcttctcccccgattagaaacatgagaggatttttctttcctttttactctgagaacctaggttgggaagggagagtagagagagtttacttggaggtctaatcacaaaagcgtggcaggggcagaaggggcatccctgagactatcagttctgagagtttctcaagtctcatgcagtccacactcagcctccagcgatttgcccaatcaccttctcaatgtgcatgccagtcatggcttcaggggcttccactgcaggtaaactgatcttgactatgattttctgtattagaaaggtgagaaaaagaaaaactatttgacaatttttcaaatataccaaagcagattttttttggagattagaaaagaatggagtatgcaaaatacacacactcctgtctggaagagtgaataaccagggaagagaagagcatcctgcaagacagtgtaataattaaaggaaataagaagcatgcaagttcaatcaaatacgttctgaaaggtaaaatcccaatgaaatgaagaggaatattggaaagctatcatcataaaacaaggaagaacaaaactatttttattaccaaataaattgggatgaaaggcaaaatgggcatagataagactaagtgatcaagtaaaaggaattttatagattagagaatacaaaataaaaacacaaattaaatcaattagagagtatttaatagagaggattagggcacaggctgaggcatggaaatagaagtggaattggtggccccgaagtaaagacaataaccacataaactttaaaaaaatgtaaagatatatttgagtagttttctttgagatgattgaatctgaagaacaaaaaatatatcacattgatttctaggaaaaactgatatagaaactgatatgcattcacctagtttttaaagtttaatattaaagtaaagaaaaaactttacagaaacccaggcataatatgtaagcaactgacacggaattttttcttttactgacttatactgaaaaatcttctaagtcaatagctaatgtccctagtgaaggatttgtaaccttcctttacacaggcagcctcattatagttcagacataaaggcagtagtcagacattctcaaatatgagagaacttagcattaggagaccaaaaaagtagtgaaaataaagaattaaagaaaacagaaatcatcccaaaagtctgataaataagaaacattcctattaaaaaacagaagcagaactagataaccaagatgattttggttataaaacagaatgccaccaatttataataccagtttagaccattctatatcacagactatagatacaataatataaataatttttcaaaagaactgtatttttaaacatataaaactttaaatttatattttaaaagcataaataataaaatttagcaattagataaaataatttcatcatctatccatgggtagtgaataagattcaaatatatttttaagtgattccattattatttttataattttacatagaaatttacaagaatctttaatggcttatatttttataattatacaattttaaaattttttccttttttaaaatttggtcatgtattcattattcactcagtcaaaataatattgagttttaaactgaacatagcatgtatagtaaagtcttctaacaattgatgattttcaactataacacacaactacaaaacctcagtggcaaacaacaaaaaagacctaagcttacgagtctgtgggttcagctgatacagtacaggttcagctcagctgagctcagtggctcaccctgcaggcagctgtgaattgcctaagagctctgctgacttctgctgggcttccttatgtctaggggctggcttactgctctgatatagaaaggtctcaaccagtatgactgggcaactccattctattccatgtgtctccttcttcagcagcccagcccagcctattcttgcggtgactgcagacgggaaagagcaagccagcctattcaagtaaacactgttcaagttttccgtgtgtcatgtttgcttatattcaattggctgcagcaaatcacaaggctgaggccatagtcacagggcaggtcagaccagtgttacatggtgaaagggcctaaatatagggaaagataaagaatggagaccagggccaggcacggtggctcatgcctgtaatcccagttctttgggaggctgaggcaggcagatcgcctgaggtcaggagtccaagaccagcctggtcaatatgatgaaaccttgtctctactaaaaatacaaaaagttagcctggcatggtggcgtgcgcctgtaatcgcagctactcgggaggctgaggcatgagaattgcttgtacattaggggacagaggttgcagtgagctgaggtcatgccactgcactccagcctggacaatagagtgagactctgtctcaaaaacaaaacaaacaaaaagagaattaggccatttaaaactctacatatttttttctctcactgagtacctattcatttaacaagctcctatctagctatctatctatatgcatattgagataaataaaatattctcagaagattgagtaacctaatataagtaataattcctaaacaaatacatttatatattgaagatacattaaatcatattttgacatccaggcaaccattatttaaagtcagaattggccaagtgtggtagctcacacctgtacgcccagcactttggaaagctgaggcgggcggatcacgaggtcaggagttcgagaccagcctgaccaacatggtgaaacctcctctctactaaaaatacaaaattagcagggcatggtggtgcacgcctgtaatcccagctacttgggaggctgaggcaggagaatcacttgaatccaggaggcagaggttgcagtgagccaaggtcatgcaattgcactctagcctgtgcaacaagagtgaaactctgtcacaaaaaaataaaaaataaaaacaataaagtcagtgttaaattcagattggagatccaattccagaattgtggcaagaaggactccacagacccactagtcttgccataattggtgaaagtctttttttttttaaagaagtttgttggttttttcttttttctttttaaaaataatttcaacttttatgttagattgagaaggtccatgtataggtgtgctgtattagtcagggttctcttagaaggacagaactaataggatatatatatatatatatatatatatatatatatatatatatataatatatgtaaaggggagttaatattaagtattaactcacatgatcacaaggtcccacaataggccatctgcaagctgagaagcaagaagagccaatatgagtcccaaaactgaagaacctggagtccgatgttcgagggcaggaagcatccagtatgggacaaagatgtaggctgggaggctaggtctgtcttgctgcttcatatttttctgcctgctttatatttgctggcagctgattagatggtgtccacccgattaagggtgggtctgtctttcccagcccattgactcaactattaatctcctttggcaacaccctcacagacacacccaggaccaatattgcatcctttaatccactgaagttgtaactcagtattaaccatcacatgtgctatgtgagtatattgtgtgatgctgatgtttgggatataattgatccagtcaccaggtagtgatcatagtacccaatggttagtttttcaatccttgccccctcgcttctcccgagtagttcttagtttctattgttgctatctatctttatgccacatgtccccaatgtttagttcccacttataagtgaaaacatgtggtacttgaaaaccaacaatttaaagtttttgaaaattgtcctaaagatatatagcaaatggagaaacttttttttatttttttattttattttattttgttttgagacagagtcttactctgtagcccaggatggagggcagtggggagattttggctcactgcaacctttgcttcccaggttcaagcgattctcatgcctcagtctttcgagtacctaggattacaggtgcatgttgtcacacccagctaatttttgtatttttttgtagagatggggtttttccatgttagccaggctggtctcgaactcctgacctcagatgatctgcccaccttggcctcccaaagtgctgggattacaggtatgagccactgggcccagccaaatgaagaaacatttattcaaggatgtctactcatcttggtaggaatagcaagagtctgacactgggtccacaacctactcttatctttctcacccccagcttagcatgacagaagctccactccaggtagacgtgatcaaaaaaaaaaaaaagaaagaaaaaagacagagtttctctctcctctaccttcaaactccataggaagagatatggtatcttcctgggagagtcaggagccagcatttcttagctccatctccctccctactttcagccctctattgcagaaggtaaatttcaagcaagtttggctaaaggttgggggctaccttgcttcatccagcccttattcgtaggacaaaggctctacaccaggtgtggcaggcccagaatattggaaccataactgcctacctccctgatcaatcatagggtggaggttgcatattgggagagacaagtcaagaagaccaaccaggggagtgaggagggctgccaccaccaaccaggagagtgaggagggtctgtggatggaaaattattaaaaggaacttgattaggggtacagggattcttgctcaacttgcttagcaagattccttattaaaactgttcttggcaagccagaggaaggtagcagactaagtttgaggcctagctgggaaaagggcctagaggagggtgactcaagtttggtcaaggaatgagtccttattagttgagagtaatatctggagacatcaataccccactttgaaaaatgaatgaataataatgcagaagaacaacaaagaaacagaatgcttgaataagattgtaaaccaatcacacctaagagataactacaggaattccagccaacaacagcagaatacatgttctcaagcacacatggaacatttgctaggatagatctatgccataaaataagcctcaataaatgtaaaaggtttgaaaccatagtttcttctccaaccatgatttttttctctaattttgaaattgggcattaaaaacagaaagaaatgagagaaagccataaatatgcagaaattaacatgtttctaaataattaataggtcaagaaaatcacaagagaaattaatatgaatattaatataaattaaaatacacaacacaccaaaatttatgatctactgctaaaatcttgcttagaagaaatttgtggatataaatatctttttttaaaaaaagatcattaatcaagaatctcaattttactgtaagacattggtagaagagcaaatgaaaccaaaaacaagcagaataagagactaagaaagatcagagaggaaattaatgacatggaggatagaaaaacaacagagaaaatccacactgccaaaagttggctttgaaaaggtctttgaaaagatcaacaaaattgggaaaaaaaaaaaaaacaccttttaagctcagcaagaaaaaatgagaaacagccaaattatcaaaaccagggataaaagaggatattattactgactttaaaagaaaacaaaaaggattataaggaaatactttggataatggagcaccaacaaattaggtaacttgcatgaaatggagaaattcctataaagatacatactaccaaaactaatgccatctgaagactatacactgtatgattccaattacagcctgtgcttcaaaattcatccctaccctgaccctaaactatggcaaccactgatttgttttactatctgtatagttttgcctcttgccctacaggtgattggttccaggagccctgtgtataccaaaatccatgtgcacttgagtcttgcagtcagcactggagaacctgtgtatctaaagtcaaccctctatatacacaggtttcacatctcatgaatattgtattttccatctgtgtttagttgaaaaaatacacacattagtggacctctgcagttcaaacccatgttgttcaagggtcaactgtatatgacattctggaaaaggcaaaactatagagacagtaaaaaatatcagtgcttgctgggagttggggtgggggtagggatgaattttggagcacagagaatttttagggccataaaaattcttcgtatgatactataataatggatacaagtcattatacattggtccaaacccacagaacatacaataccaagagtgaaccctaatgtgaactatggactttgagtgatttataatgtgtcagtgtaggattatcagttgtaacaaatataccagtcttttaggggatgttgacaatgagactggctatgtgtgagagcaggggaaatatgggaaatctctgtaccatcctcccaattttcctgtgaacctaaaattgctctaaaaaaaagtctttaagaaaaggaaagaaaatggcacatcaatatctcttatgaatacatacacaaaattctcaaccaaatactaggaaaccaaatccagcaacccataaaaatgattatacatcataaatgagaggggtttacatcagggatgcaaagtcagtttaaccttagaaaatcaattaatgtaatacaccatttcaaaggaaataaagggcaaaaaccacataattatctcaatagatgcagaacaagttttgacaaaatctaatttctttatgatgaaagcactcaaccaactagaaacacaagggaacttcctgtacctgataaagagcatctacaaaatcccccagctaaaaacacacaatggtaaaagactgaatgtttccccctgagaaaggaacaagatggtgatgtctacccttgctccattaattcaacattgtactggagactataaccagggaaattaggcaagaaaatgaaacttaaaatgccagaattggaaaggaagaggtaaaattatttccatttgtagatggcgtgatcttgcatatagaaaatcctaatgaatgcactgaaagaaaactattaaaactaataagttcagagtgtttggatatacaacatcaatatagaagaatcaattctattttcacacactagcaataaatattttgaaatgaaattaagaaaacaatttcatttacaataggatacaaaagaataaaatgcttaaaaatattaaaagaagtgcaaaatttgtatgttgaaactataaaacatgattgaaagaaattaaagaaagacatcccatgttcatagatcggaacatgtaatatttttatcatggtcatattccccaaattggtgtacatattcaatgtggtcattaagaagcttaacttaaaattcacaacaaaatgccaggacaaagaatagccaaaactattttcaaaaaagaaaaataaaattggaggacctacacatcctgattttaaaacatagtataaaaccacactagtaaagataatatggtgctggcataagaatagacatacagatcaatggaatcgaaattagagtccaaaaataaacgctcatgcttagggtcaaccgattttcatcaagagtttcaaggccatttatacgggaaacaactgtctttttaacaaatagcaataaacacctggatatctacatgcaaaataataaagttgggctcctccctcacatcatacataagatggatcccaaatggaccaaagacctaaaagtacaagctaaaactataaagctcttagaagtaagcatagaagtaaatcttcataacttcaggttaggcaaagtctactgaaagcataaatgacaaaagaaaaaaataggtaaattggacttcattgaaattaaaaacttttgtactttgaggccatccagaaaatgaaagtacaacccacaaaatgggagaaaatatttgcaaattatatatagaactttatacacacacacacacacacacacacacacacacgacttgtatctagaatatataaagaactcttgcaatttaacaatgaaaaggcaaccaatccaattaaaatatgggcaaagaatctgaatagaaatttctccaaagatgcatagataaccaaaagcatatgaaaagatgtccaacatcaatagtcaccagggaaatgcaaggcaaaagtcacaatgtcattcatgcctactaggatgggtataataaaaacgacagatctaagtgttgaaaaagataaagagaaattggaaccctcatacgacgctggtaaaatgtaaaatgatgcagcaacttagaaaaacatcgggcacttcttcctcaaaaggctaaatacagagttactatctgagccagcaatctcgctcttaggtatatacccaagaggaataaaaacatgtccccacaaaaacatgtacactaatgttcatagtagcattattcatcagaacaagaagtaggaataatacaaaggtcctttaactgattaatgaataaacaaaaggaagtttattcctacaacaaaatactatttggcaatagaaaataatgcaatattgatgtgttacaacatggatgaaccttgaaaacataatgctaagacaaaagtcagtcgcaaaagacaacatattgtataattccatttatatacaatgctcagaatcagcaaatctatagacagaaagtagatgagtggctgcctagggaggccagggtgggatgattgggtgtgatagctaatggctgtaaggtttcttctagaggtgatgacaatatataaaaatgtattgtggtggtagatgcacaactctgaatacactaaggaccatcaaaccgtacacttgcagtgggtgtgttttatggtatttgaactatatctcaacaaagctgttttaaaaacagattataccagtactggaaaacaattttctcaacagaaatcaaacatttgtaaattcatggtcatcagattttcatttacattttaattactaaatataaatcctaaatctaaatatatatccaaacataaacttgtttttctcatttttatgattatttagcttattaattgttcaattttaatttatccctctactgattgctgaaaatcactaaatttttttgaagaataattttagatagatttttaaggtcaataaataccttggaaaaagacactttctttattttgaaatgtaatctttcactgtttcagagtaaatacacatcaagaatgactcacatgtaaataattgcagataaaatccgggaactacatttgagcagagccagactgtcatcctgtagttcttcaaaggctttggaactgccgccagtggttacatattttgccgctctaagtatcttaaaatggaagaatccccctcatactttccataaagattcgcccaccacaaagcatatttgtttggagacctcctcagtgacatttcacaattgtgagcgtgaattatagattcctattacttaagcttttcatcaggcctaactctatgaattttgctagactttttatttttcactgaattctatttcaacctcatatccattgtggataacaggaatttttctctccttccggaaatccttgttttgtgtgtgtgcatttcagaacacatttgtgtgtgtgtatttctcttgaatcaacaaccagtgactgatctctgcagatctactgataaaggacatttattttacatttgtactttataatgtcatgtgataaaagttaagccaaaattctgggtgacaagtcgcctaaggtgtcttaagagctgagaacaagttatgttcagaatgcatggatttctagaatggatatcccaaacagctactatatacattattatggagctgctttctgtttcttgagaacttgcattttcagaaagcaatgtccctaaattaaaaatggcatttgaacctagactcctacataaatctgtagtgggtattacatatgctttggggtctggaattctaaatctagctcccgttctggcatcttcaattagtgccacttggaaaagatggctttagttcttctcacctcagtctcctaacatataaaatgtgtacaatttttacctacttgatagaactgttgagaaaactaactgaggcagcacatgtaaattacttcacacagtgacaaaaacactaaagtttttaatagtagaatttaggttgcacaatgtcttaaatatagaagctagatagtcaatatacattagttttaaaattctgcttccttaactttctaaaactatggagtgtagattatttgtataaatccatgtatatatggcaccacattaatgaactgtatagattaactatcttatattatcctgcttggtttgtgatgaagaggacagcttgctccatctttcagtgtaattttaagacagaaagcctgttataaaaccagtgaatttccaggccatcataataaaatttcctatgataataataatgtgcttttgttcaaaattaaaatatttgaagagatgagagttttaatattagtttcaaagactgacatgacttattaaaattatattaatttacgctcattatatcttttatgataaaaattttaaacctctgaagcaactctgagttcattctagcaataaaataaatatttcaacacctactatgtgccaggaagtttttaagtgcttagactgtatcagggaacaaaacaaagatcttgctttggggaagtttacttttctgaggagggagaccgacaataaactatacacacaaaaataagtcagctgtttagtatgtacaacagataaggagaattaagagttccattgtggtgccattttaaataagatggttagtgtatgtctggttgagaaggattttaagtgaaaccacttaaaagaggtgaggaaattagcagtgctgataattcagaagagtaaccagcagaaggagggccagggcaaaaaggccccagagcttgagtgttcctggcacgtttgaggaacagtaaagggccattgagttggaagaacagttagaaatgtgctcaaaaggtaacagaggagcttcatcaggtggaaacttgtagtccattgtaagtttggggaattttcgtctaagtgaaattagaagagttctgagcagagtggcatgctctgaccgatactcagaaggagcgctccagctcatatgttaagaatagacagcacaggaagaggcacagaaacagggagccgctcagcagggcatcgaggtagaggaaagagaagatggcggctgcagagaggcagaaaggaagccggaagcagtagggatctcgatttcggtatattctgaaagtgaagtcagaatgatttcctgacatagtggagctgggatattaaagaatgagggaaatcaaacgggattccgatgcttttcacctgaacgggaagacagacggagtttcaccaaccaagataggggaagctgtaagcagatcgtttgagggaggtggaaatcgggagttcagtttttggaaacatttagtttgacatgtgtatttgtcacccaaatggagctatcaaggggacagctggatacttaagaccacagttcaggacagtggtcttggctggagattatcaaaggaatgaaagcacgcagagtagacgatcaaggaccgaactcaggttattcaaacattaagaaagagacaaaggagtgacgttggagaaaaaccaaagataatgtaatattctagcagccaagtgtggaaaaaaatgtttagggagaaaggggtatacaactacatcaaatatttctggtaagtcaagaaatatgagagctgatcattgactattggttttagcaatctcgaggttattggtgatctctgacaaagcaattttagaggaatggatgaactgaaagccagatttgaatgccttaagagaataaggaaaggagaatctgagactatgaaaaaagacaatctttagaagagttttactacaagggataataagaaagtgggaattaagaattttaaagattcatgaaataacagtagtaaaggcaataattcagtagagaagggaaggctgatgatgtatgacagagagacaattatctcagaatagacaaagagtaggctgtcctgcataaatagaggggctgcacttacataggatcataaataatttgtggtttcaggcagaaagacagttggtgggtagatggcatgataggattctgcagaactttcttttggtttcctgctttctcaatgaagtaaggagcaagatcatcagatgaaagtgaagatgagggaggaagtattggagatggaggagggaagaagagaagatatgcaactgtcatcaagatgctcggatagattagcaaacataacagggttgctgggaacatcaaggacccacttaataattttggtcataaactgaacatgtgaatttaaagctggaccagtcattgtttttacccaactatgttcagttacatggatgcaagtatggaataagcaggagttggaattaaggttgtgttttcattttaagtactaaaaactgagttgatttgtttcccatagttgtaacaaattgtcacaaatgtggtgacttaaaacaacaggaatttattctctcactgttctggaggccagaagtcaaaatcagtatcaagggctatagacgggttgacagagctgcactccctctaaggctccagaggaaaatcgtttctttcctcttccagcttctggtggctgccgcatttcttggcttgtggctgcatcacaatgagctctgccctcgtggtcacagggccttctcttccatgtgccaactttccctctgcttctctcttagaaggatacatatgactgcacttaaagcccacaccaaaaatccagaataatctctccatctcaagattcttaatttaatcacatttccaaaattcttttttttgccatataaagttacctttgcaggtccagggatcaggacatgaatatctttagtaggggccttacctagcacagcacactgaaaaaaggaaagggagtgagcacatattcaaagtgaggttactatcattggccatgaaatttaagctttgataagttgttttcatagattaagtgagctaaacagaggaggtagtggtcaggaaatgttgacttataaaaccaaaatcatagtgggccagtacatgtcggtaatgacaaggtctagttcatgtctgagatcggatggaagacaaaattatcggaaaagaagaagtcaaattgagaaagcaaacagttggaaataccaccttcaggtagattaaaattgtcaaaaattaagagaaatggatacagagaataaatagaattagtaggtagaaggataaatgaaaatgtgatagatttaaattcatactgttcactctttatatgatatgtatctgtgtgtgaaaaattccaatgtaaatccttctctttccccaggtaactaaattatgccacttgaagttaaaaaattatcaaaattcaattttcattgagagggtttttctaatatatttttatgcctgtgttcttaggtaaatgtagcctgagatatagacatgagtttatcccttgagttggagtgtgtgatgatgctccaggggtcttttgaggtgtctgaaaatgtttacttttactttcgctctagacagctgtgtgttttaaatcttgggtctgctatttatattttctattacctttcttgctgcttagctgtcatctgtcacttacttttgttgtcagtgtgcttttaggcttttgcattccaatttgtagtttataagatgtcttagagagggcaaacagggagaaaagctaattataattgtgttctaaaaatgagaaatgtgactctgaatgagatcctttgcttctaaattaagtttatggactacaaagtctacgaacagatagtctatgttgtatggctatttctcatttttacttgtattacggatgtctgcaaatttgctattaggtgtctattcagataccgtacttatgaacactaataaatctccataaaaattaaaagattgtatatcaaagtttatggacaatatacaaaaatctcattatctccagataatgtgttgttattactgtatttccaaacccatagactctgttccatatccattttctaaaatatgtcggggtcctgtctggaaacagatgactcactcaaatttagcatttttaggagagttttatagatgactatttacaaaactgaaaacaggatttagaaaaaccaaaatgggaggtacaatattccagagctagtaacaggaagctgtttgcaggactaagctgacaggagtttttatcaaaatctggagagatccttgtgttaggagctgctggagaggagctgtggcctcccctggactgataagtcagctggaggatacctggcagggagaaagccagagggataaagaaccgacttccctcttcagccaccgtgacttcctagcgatgcctccctggcccacgctgaacaggaaatcagagctgaagtgagcccactgatttagtttgtgttacctggactttccggggcagaaagcagatacagttgggtgaaaggtgaagggtggctacggaagggcaaatggaagccatccaccatggtacagaaatgaaatttgaacctgaacctccctcagcaaaagaacaacatataaaaaattacatgtagtaattgaaccaatattgttttccatcaatagtattataaatacatgctaatatatttatgatgacatgtcatcccttttggaggttcctgcagataaattatctctaaaacttaggagcagtctcagaaagaagattataacaaatgtcatttcctcattcaaggcaaaaagttagtattattcttttaccatctataaagtcttaaaaaataccagatttagactgacttttctcaagatcaaataatttacttgatgagtcattcttcataggaaatgtatgaagagtttgtaagtatataggcccaaatgagataagggttccctgaggcagcacatgtggtctgtgtttgttggatgctggcaaatgactttgtctcagtccttctagagggaagcacacagttcacttccatcagaaagttagtctgtggagtattatactttcccgtatagcagattcagattcaagttaattttaaaatagaaaaagtctacattctgctctcgacaatatgtttttcctattcatagtttacaggccagatgttattttctgaagtgcaagtaatgaatgcaagaattttaggaacttcatgagagtatttcagagtgaggaatattaatacttagacaataaaagagaataacaaattcgtattaaagtcattaaagaaggtcacatgaaaaaatgttcaaattccagaagtattcagtctaccagcaatcatttgtatttattttctcaatgttatttattttctaaatatttgagagcacagtcaccctgctataatctaactatgggtggttttttttttagaaaaaattttgttgttataatcagagggaaggttctgcattctagtcaactcaatgagagataacacttcagaatgcatgacagaaagacctagagagaatactgcaactgcaggctagaaaaaaagagataaacaaaatctcattatctccagataatgtgctgttattattatatttccaaacccatagactctgttccatatcaattttctaaaattgggcaattttggtaagttttctttttataacattaagtaaaaatagaagcattaatgctaagtgaacctaaatagatgctaatatcccttttagtggttcaactttgcagttcaagaaagacgcctcatattccatctgtggttaggcattgtgttgggcacatcagagtataaaaataaatgcagcaaaattaaccatctgaacatacaacaacttcttaatgcatctactgtgccagacactgtgttaagtgttagaagtattgagaaagaaaaatgcagtcatgtcctaggggaacttcaaccaaataagagggaaacaggcaaactgatcacatagagtgacaactgaaagtgggatttgcactcagtgttttgagagtataaaaaagaagccctcaattttgtctgtgagatggtagatcaaagtagcttattaagaggaggacaacataagtattgaagaatgacttaagcagagggaggggattattcagggtagagggttataaaatgttcagggaaccatagatgattttatatgataaaacgaaccctgaagttgaacagtaattcatcatgattcttagacacagtcagaagttgtcaaataactgaatatgcccttcagcaaggtttctgattttgaaaaaggaaaatatgccttaatttttcttgaacaaagacatcaacaacaattaattggaaaatctttgcctgtaggaggaacgggacacttccccaaattgttttacattctgtttagattggaaatgctgtaagagagaattgttaaaaacatacaaaaactaaacaagttaatattgagtgcagttgaatagaaatattattcaaatatgaacctacatggagttgatgtggggctaaatatacagatttatatatgtttctataatatttaaaataaagttacttttttttttttgagacaggagctcactctgtcacccaggctgcagtgcagtggcacaatcttggctcactgcaacctctgcctcctgggttcaagcgattcttccacctcaacctcccgagcatctgggagtacaggcgcccaccaccatgcctggctaatttctgtatttttagtagagacaggatttcaccatgttagccaggctggtctcgaactcccggcctcaagtgatccacctacctcggcctcccaaaatgctgggattacaggcatgagccaccatgcccagccaatgttgcttttgaattaaagattttattattattgaggctagttgaaagcaaatggcctagctatataaattatcattgcacaggaaagtctcatgtagtaccatgtattgtgtgaatatatttactgtttatatatatacataaatatctacacacatacctttatgtacatatgtatatataaccagtaaatacacatattatcatatttatcattgcacagaaaagtctcatgtagtaccatgcattgtgtgaatatacatttatatttatttactgtttgtatatatacatatctatacacatagattatgtacatattatatatacgcagtaaatatatatgttcacttgtatattttaaaaataaaacaatggtcatctaacaagagacctgcatcaggatatacagaaggatggaaacttcacttgtctgattgcatcttgctttatactgtatttcaaatccatgtaagtattttacataatagaagatcatatccaaaaaacagaatccacaaaattaaaaactatcaagttgtgctttgtgctaccgtcatgtgccaatgactctgaagagtgcaggtggtaaacggctcctccctgctaggaagaccctgcccccgcagcgtgttgctagttagagctactgaatcaattcttacctgaaggcagatcgcccccaggacattttagttgcacaagtcattggagtctcttttctgtataagtaattttgagctgaatttctgtcacttcccactaaaataactttcagtgattcactgaataatagtggagtctacgtggagctgacaataattggaaaaaatagaatcaattaagagggaaagaataggaagaagggatacattcaatcacaggagagtcaggacaaatacgcgggtgaaagacatgacagtttttaaccaaaagcatgtcttgagaaggaattggattagaattgttttaaaaagctacatgattgtcaaatttttaaaagcagcctaatgcatagattgcaacatacaacgtgatatttaaccatgctttggatgattaatgttaacaatagtgatggattgaaactgttgcatagtgctggaatttaagtggtagggataaatttctctttatttttgtatgtagatgcatatgtgtatacacacacacacacacacacacacacacacacacacacacacgtcttggaactcatcaaataaagcagatcttttccaagtaagtccagtaaatgcagggctatgcactcaaagtgaaaaaaattacagaattttaataaaaatcaaagtcatcgtaccatcgtaattctctccccatttcgctgcttctccaaccctgtcttacatacagatgccttaaaaactgcagtgaatcttttttcttgaaaaatgtctttatgccatataatcatggcttccactcaatcttttggcactatccaatattaatatgtttttggaaataaacagaagaaacagtaatggaagaggtactcaatagaaaagtctcttgaggtctaatttgggtggcactggggaaaatgcccagaaggtctgcaaacaagtaatgggcaatctagacagtgttgagaataatacagcagattttaaaaaggaatagcacgtataaaaagacttttccatttagggtgccaaaatcctaaagtaaggacttcaaaaaataatggaaagaaacctctacattgaggctatagcagattttgtttgataagagaagatttagtacatggaagttgtgtttgtcttctgaatagtaaaaatatctcactaaggatatgcaatatctttctactttcatgtgatcattttaaaagggcaggaatatgaattcaactgacaaaagattacttcagtgtttctggtttattttaatgtgcattttttcagtaaaaccttacagtaataaagattttgctgtcatctcatgaacaaataagtgtattactttacaggcaagaaaggcaaactagaataatgaccatagcatcatttatgggtatatagaaattatgtcctttttataaaggagatcttaataagcggtttgggaaattatattacaagccattctgtattgatttattatcttctaatgctcatttctgccatgcactcaaagctccaaagcattaaaattggtatccactgtagtttgatgccagttctgaagttcaaatggcaaataaattctcatattaatggtaatggtgtgaaactgagaatttattgaagttatttgttaaacttcagtaggtacctatagctagttttcatgtgaaaaaacctttagtaagagagcaactttgaaattaactcatgaaattagttaaattttggctttcctgccactctggcagttttgttaactcatgggagtctgttcagggtaataacacatagagaagtatggaccctaataccagtataaggcagaatgaagctgttctctaccacgagaagcaaacaagaacctatcagagccatcagacaatcatgattccagtgggccattgggaaagaatatatgcaggtgttccaggcagatttagctcataggaacagttacaatattttatacacattttacaaaggatattcctaaggatttttttgcactcatttccagatggtgacttctttaaaagtagaaacagtctgacatccacccagaattaagaccaagagagtactgtattaaactaatttaaacgtcaaagcatgttgcttttaatgctgtgaattcacccagactcaccttctcagagccttctttgttgaaagaacataatgaataacctttaagtgttgcttcctgcgagtcagtgccagaacgttctaactggtagaccaagaagcctgtcagcatttccatcataaacctatattatctggagctcataagttggctgtaaaactcaggcagaatctaggcattgaaacctttctggaaaagtgttatatttttaggctgtgtagactacagggtggtaaaaacacaggattttcaggcccaaatatagcagtactttacacaaatttaaacacattaaagtaaaacagaaatgtcctatttctaaattcacaggacacaaaaagaacacataattttaggccactatccaaaccttgtagcctgattttgtccaaagtctgtcttccattatgattatacagaaagtgttgaaggcattggtaagttttcagaaaccgatgaacaaacctaaaaacttgatgttttataaactattcgtctttgaagtgttgcatatgttctaaagtggtcatgtgaaatagctaaagctctttgttattatacccttaaaagtattttttgtagagtactttgcattgtataaaataatttaacatgcagtatttaatttaactctaaaaaaagaatcctgtaatattaccctcattgcacagaaggtaagcttagcacataaaagtattactcagtcatgcacagaagttaagttcaacccaggtcttccgatttcaagttcagtctggtaccactgaaaacacccctatcatgtcaaccctcctaatttctcattcatactgaatctgccgctcactatcattatggcctctcctgctgcgactgctctctgctcccacatcactcaaccttcttcctctttccacagcttcacaggttgacctcttttaaacatacctgtggatgtctcgtaagctcagcgcaactcacctggggcagttttgctttccaggggacatttggcaatgtctggagacatttttggttgtcacaacttcatgtgggagggtagggtactgttggccaatgtccagtggtagagaccagggatgctgctgaacagcctacaacacccagcacagccctgcccaacaaataattatccagtccaaaataacaacagtgcagaggttgagaaaccctgctccggccagaactctagattaacaatttaggattattaacctgcttaattcactcttgaaccccaggtgacacatcttcgactttctttggtttctaaacaatggtatgaaatgtcaaatgctactttgtcgttctagaacttagatctaagctcacagaaaagcaagaatgtgagctctatgaggatttgggatctgctttcttctttcgtttctattgtttagtggctgcctcatagtgggtgctcaagaaggatcagctgaagcaatggcaagtataggcatacgtcttcactggattatagaaatatgtgctgtccatggacatggggaggggaacatcacacactggggcctgtagggggtgggaggctagaggagggagagcattaggagaaatacctaatgtagatgatgggttgatggatgcagcaaaccaccatggcacgtgtatacctgtgtaacaaacctgcacgttctgcacatgtatcccagaacttaaagtataataaattaattaaaataaagaattaagtgctgtctgtgactgaccccttgggcattgccattagtggctcctctaaatcattccctgtcctgaggtcccctccccttcctcctcattcctcctgcgtcttctaggccttcctgaaaacaaggccctatcatttccattattacactctgttagctccatcttcatcactttcaaatacgctgaaaaatcctccttctagaataactctgctaccaacttttctttctgtatttcttttactgctaaacctcttgagtcgtgattggctccaattccttagcatatacagtgagtaaccttttgcaatctgagtggatttcccagcatgctacaaatactgttcatctgaaattcaatcttgattttctgcttacaaaccaagaaaaggcctttgttcttggaagtgcccttgaccttgctagagcctgcaacaattgtgatctccttcatgaaattccttcccatactttctaagagactgcatatttctatcttttcacttttatacttaaaccccagtttttatttttcttagtggcaacttttcatcttctatcctccttaactggatgttttctaagctttgttgttctctgaggttatttttctctttctaagttttctcccttggtccctgcattgacttctctgtgaataactagaaaatctttgctcccaagcattcatcccacatttcaaatcaccagtataacatggctgctgtaacttcaaagtcaacacacttaaacaaaaacaactatttcttccccatccttttttataacttacctcctcatgctctgtggcccccagacacaggaaggttctatttaggggcagaactgacataaaaagccttctttccctgagcctgctccatacttaagccatctctgccattttgccaagttattgacctaagatcctgaaattgatctctcctagctacacgcaactctgtagaattagcaattccactggccattcctgtaagtccacccttcaaagtgacaccacgtgctaaagaaaacaactcttgagaactgtttcataatggtaattggcaacactcacgtggacatgcttatccatactaacttattaataccaccattctatggggtaggttctactcccatacacagttgttacagataaggatccaaggcagcatggcttaagtaactcatttaatgttacactgctaatgaggtagccaggatttgaacaaagctgtgtggctccggtgtccatgcttttattcactatgctctatctcttccttactgcagggcacatatgaaaatggtgattgggtggacattttcacatatgaaaatgaaagtgtgattgggtggacagtgtagaacaaagagccatgcaattttaaaggtgagttcagagggttgaatagcacccctcaaaatgatatgcccaagttctagcctccagaatctgtgaagatgacattatttggaacaaggatcttttccgatgtggttagcttaaggatctccagatgacctcatcctggatttagagtgagcccaaagtccaattattggggtccaaataagaagagaggaggaagctgacaaagaaaaggtgacgtgaagttggtgttagagactggagtgatgtgtcaatcagccaatgcataccgaggattgctgacaatgccgacacctgggagagacgcagcaacaggttctccctcacaaatttcagaggcaatcaactctgctgacccctggaatttagactttgggcctgctgcatagtgaaatgataaagctccattgattatggtgccaacttcgtgtggacttgttagtgcacctctgggaaacaaatgcaatgggagagatcactgtgagctggagcagggagtccaataatggagccctcaggcaagtggcaaatctctaatgaaatgcatctcacaaacagaatgctgccaaagactaaattttcttttagtttttctaacattatttttgttattatactttcagttctgggatacatgtgcagaatgtgcgggtttcttacataggtatacacgtgccatggtggtttgctgcatccatcaacccatcatctatattaggtatttttgctatccctcccctagaccctcaccccatgacaggtcccagtgtgtgatgttcccctccctgtgtccatgtgttctcattgttcaacactcacttatgagtgagaacatgcagtgtttgattttctgttcctgtgttagtttgctgagagtgatggtttccagctacatccatgtccctgcaaaggacatgaactcatccttctttatggctgcatagtattccatggtgtatatgtgccacattttctttatccattgtaccactgatggccatgtgggttggttccaagtctttgctattgtgaacagtgctgcaataaacacacatgtgcatgtaactttatagtagaatgatttataatcctttgggtatatacccagtaatgggaatcctcggtcaaatggtatttttggttctagatcctgcaggaatcaccacactgtcttccacaatggttgaactaatttacattcccaccaacagtgtaaaattgttcctatttttccgcatcatatccagcatctgttgtttcctgacattttaatgatcaccattctaactggcgtgagatggtatctcattgtagttttgatttgcatttctctaatgaccactgatgatgagcttttttttcatatgtttgttggctgcataaatgtcttcttttgagaagtgtctgttcatatccttcacccactttttgatggggttgtttttttcttgtaactttaagttctttctagattctggatattagccctttgtcagattgatagattgcaaaaattttctcccattctctaggttgcctgttcactttgatgatagtttcttttgctgtgcagatgctcttcagtttaattagatcccctttgtcaattttggcttttgttgccattgcttttggtgttttagtcatgaagtctttgcccatgcttatgtcctgaatggtattgcctaggtttttttctagggtgtttatggttttaggtcttacatttaagtttttaatccatcttgagttaatttttgtataaggtgtaaggaaggggtccagtttcagttttctgcatatggctagccagttttcccaacaccatttattaaatagggaatcatttccccatttcttgtttttgccaggtttgctggagatcagatggttgtagatgtgtggccttatttctgaggcctctgttgtgttccttgggtctatatatctgttttggtaccacactatgatgttttggttactgtagacttgtagtatagtttgaagtcaggtagcatgatgcctccagctttcttcaatttgcttaggattgtcttggctatacgggctctttttttagttccatatgaaatttaaagtagttttttctaattctgtgaagaaagtcaatgttagcttgctggggatatcattgaatctataaattaccttgggcagtacggccattttcaagatattcattcttcctatccatgagcatggaaggtttttccatttgtttgtgtcctctcttatttccttgagcagtggtttgtagttctccttgaagaggtccttcatatcccttgtaagggatatgcactgtgtctgagagattgttgtgatttacaattgtttgcgtttgcttaggagtgttctacttccaattatgtggctaattttagaataaatgtgatgtggagctgagaagaatgtatattctgttgatttggggcggacagttctgtggatgtctattagttccgcttggtccagaggtgagttcaagtcctgagtatgcttgttaattttctgtctcatttatctgtctaatattgacagtattcctagttattttattctctttgtagcaattgtgaatgggaattcactcatgatttggctctctgtttattactggtgtataggaatgcttgtgattttagcacattgattttgtatcctaagaccttgctgaagttgcttattagcttaaggagattttgggctgagacgatggggttttctaaatgtacaatcatgtcatctgcaaacagaaaatttgactttctctctttctacttgattcccctttatttctttatcttgcctgattaccctggccagaacttccaattctatgttgaataggagtggtgagagagggcatccttgtttataccagttttcaaagtgaatgattccagcttttgccattcagtataatattggctgtgggtttgtcataaatggctcttattattttgagatacattccattaatacctagtttattgagaatttttaccatgaaggggtgttgaatttcatgaagggcgttttctgcatctattgagataatcatgtggttgttgtcattggttctgtttatgtgatggattacgtttattgatttgcatatgttgaaccagtcttgcatcccagggatgaagcctacttgatcgtggtggataagctttttgatgtactgctggattcggtttgccagtattttattgaggattttcacatcaatattcatcagggatattggcctgaaattttcttttttgtgtgtgtgtctctgccaggttgtggtatcaagatgatgatggcttcataaaatgagttagggaggagtccctctttttcttttgtttggaatagtttcagaaggaatggtaccagctcctttttgtaccactggtagacttcgactgtgaatccatctggtcctggactttttttggttggtaggctattaattactgtctaaattcagaacttattattggtctattcagggattcgacttcttcctagtttagtcttgggagtttttatgggtccaggaacttatccatttcttttagattttctagtttatttgcatagaggtgtttatagtattccctggcagcagctttgtatttctgtgggatcagtggtgatatcccctttatcatttcttattgtgtctatttgattcttctctcttttcttctttattaatctggatagcagtctatctattttgttaatcttttcaaaaaaccaactcctggattcattgattttttcaagggttgttcatgtctatctccttcagttctgctctgatcttagttatttcttatcttctgctagcttttgaatttgtttgctcttacttctctagtttttttcattgtgaagttacggtgtggattttagatctttcctgctttctcctgtgggcatttagtgctatacatttccctctaaacgctgctttagctgtgtcccagagattctggtacattgtgtctttattctcattgatttcaaagaaggtatttatttctaccttaattttactaaggttgaaatttaagttatttacccagcagtctttcaggagcagtttgttcagtatccatgtacttgtgtggttttgagtgggtttcttaatcctgagttccaatttgattgcactgtgtctgagagattgtttgttgtgatttacgattgtttgcatttgcttaggagtgttttacttccaatcgtgtggccaattttagaataagtgtgatgtgtagctgagaagaatgtatattctgttgatttggggtggacagttctgtagatgtctattagttccgcttggtccagaggtgagttcaagtcctgagtatccttgttaattttctgtctcatttatctgtctaacattgacagtggggtgttgaaaatctcccactattattgtgtgggagtctaagtctcttcgtaggtctctaagaacttgctttatgaatctgggtgctcctgtattgggtgcatatatatttaggataattagcccttcttgttgcattgatccctttaccattatgtaatgcccttccttgtcttttttgatctttgttggtttaaagtctgttttatcagagactaggattgcaactcctcctctttttttgctttccatttgcttggtaaatatttctccatccctttattttgagcttatgtttgtccttgcatgtgagatgggtctcctgaatacagcacaccaatgggtctacaccaatgggtcttgactctttatccaatttgccagcctgtgtcttttagttggggcatttagcccatttatatttaaggttaatattgttatgtgtgaatttgatcctgtcattatgatgctagctggttattttgcccattagtttgtggagtttcttcatagtgtcaatggtctatacaatttggtatgtttttgccatggctggtactggtttttcctttccatatttagtgcttctttcaggagctcttgtaaggcaggcctggtggtgacaaaatatttcagcatttgctgtctgtaaaggattccatttctccttcacgtatgaagcttagtttggttggatatgaaattctgggttgaaaattcttttctttaataatgttgaatattggcccccactctcttctggcttgtagggtttctgcagtgagctctgctgtaagtctgatgggcttccctttgtgggtaacccgacctttctctctggctgcccttaacattttttccttcatttcaaccttggtgaatctgacaattatgtgtcttggggttgctcttctcaaggagtatctttgtggtgttctctgtatgtcctgaatttgaatgttggcctgccttgctaggttggggatgttctcctggataataccctgaagagtattttccaacttggttccattctccccatcactttcaggtacaaacataggtttggtcttttcacatagtcccatatttctcggaggctttgttcatttcttgtcattcttttttctctaatgttgccttcacacattatttcattaagttgatcttcaatctctgatatcctttcttctgcttgatcaattcagctattgatacttgtgtatgcttcacaaagctcttgtgctgtgtttctcagctccatcaggtcatttatgttcttctctaaactggtttttctagttagcaatttgtctaaactttttccatgttcttagcttccttgccttgggttagaacacgctcctttagctcagaggagtttgttatcatgcatcttctgaagcctacatctgtcaatttgtcaaagtcattctccattcagttttgtggccttgctggcgaggagctatgatcttttggaggagaagaggtgttctggtttttggaattttcagcctttttgctctggtttttccttatcttcacggatttatctgcctttggtctttgatgttggtgacatacagttggggtttctgtgtggacgcccttttcgttgatgttgatgctattcctttctgtttgttagttttccttctaacagtcaggccatctgctgcaggtcagctggaatgtgctggaggtccactccagaccctgtttgcctgggtgtcaccactggcggctgcagaatagcaaagatcgctgcctgttccttcctctggaagcttcgtcccagaggggcacctgccagatgccagctggagctctactatataaggtgtctgtcgatccctgctggggggtgtctcccagttaggaggcacgggggtcagggacccacttgaggaggcagtgagtcccttagcagagctcaagagctgtgctgggagatccactgctctcttcagaggcagcaggcaggaacatttaagtttggtgaagctgcgcccacagccgtcccttcccccaggtgctgtatctcagggagatgggagttttatctataagcccctgaatcgtgctgctgcttttctttcagagatgccccgcccagagagaaggaatctagagaggcagtctggctacagcagctttgctgagctgcggtgggctctgcccagtctgaacttcctggtggctttgatttcactgtgaagggaaaaccaactactcaagcctcagtaatggtggacaccccgccccccaccaagctcgagcgtcccagatcgacttcagactgctgtgttggcagcgagaatttcaagccagtggattttggcttgctggcctccatgggggtgggatccgctgagctagaccacttggctccctggcttcagctacctttttaggggagcgaacggttctgtctcactggtgttccaggtgccactggggtatgaagaaaaactcctgcagccagctgggtgtctgcccaaacggctgcccagttttgtgcttgaaacccagggccctggtggtgtaggcaccccagggaatatcctggtctgccggttgcaaagaccgtgggaaaagcgtagtatctgggccgaatgcaccgtccctcagggcacagtccctcatggcttcccttggctggcggagggacttctctgaccccttgcgcttcctggatgaggcaacaccccaccctgctttggcttgccctccatgtgctgcacgcactgtctaaccagtctcagtgagatgagccaggtacctcagttggaaatgcagaaatcacccaccttctgcattgatctcgctgggaactgcagactgaagcggttcctatttggccaccttgccagcccatctcgagtaagttttcttatctttgcatgtatatccgataagctagatttagtggtcaatagcgatttttggaatgaatgaataaataataaggattgctcttttttttactgcactataaatgtgtagaagtcatgtaatttaaaatttatttgtgttaaaatgttgggtaaaatatttttactctactttaaatatctaagttattaaatataactggctgcatttattttattaaaacttacaaaataatttttataactatacaaattataggatcatctacatattgtgcctattaaaattttacttaaatatgattttagttttttatagacagaagtataaagaatgcttcaaaatcttaatcatttagaactaaaattatgtctggtgtcttgaaatccagatttacgtatgtgttaaagatactggttatttcctcaagtcaaatcatggaattgagaggtagagttgaatacagttttaataaatatgcattggttcctatgtggctattcttgctgtagtagtacactaacactctacaaaaatctgttttacaaaaagaaacctttggaagtaacacttatataaattaatgaaaaaaatgaatgaatatatgtaatgtaataaacattaaatgattaatcagtggagatcctggattataagacaataaaaatattaaacagttttctcagggaaaacattttaggacaactatatatatatatatatatatatatatatatatatatatatatatatatttatttatttcccccctattatttcaggggctatatcgtaaagaagaaataaaacttgaaaataaatgtacattgactaagaatttaactgttgaaactcaaacacctatatctttcatatatatgtacatatgtgaaatatatagctctgatagatatatgcacacacacatacacacatacatatatagtggctaaagatatctttatttcagatatatattttttcatatatctttcataaatattattgacatacatatttcatatatgtatgtacctatattcacatacacatagccctgattttatcttagcacatacatttattattatcttactttggaaatattggaaataaagtattaggtgttttttagcacatgtagagctcagctaaaagcaaaagcaatggaaacattttcaaggacaaatttactaagtatcgtagcaatgccacttatttccatgtaacaaaaagtattatttatacatttactatttgggttaattaaattttttgccctgatgaagacctgaagcaatttcaggatagaatttttagaatgaagaggaaccacgaaaagttgatatgcataaacagagaagcttgctaattctagacactttcatatttagatattggttgtatctgtgtctatgtacaagatacccaatctttcttttttttattctttttttgagacagagtctccctctgttgcccagtctggagtgcagtggctcaatctctgctcactgcaacctctgccccccaggttcaagtgaatctcctgcctcagcctcctgggtagctgggattacaagcatgtgccaccatgcctggctattttttgtatttttagcagagacagggtttcagcatgttggtcaggctggtctccaactcctgacctcgtgatcctcccacctcagcctcccaaagtgatgggattagaggcgtgagccaccatgcctggccgatacccaacctttcaaagcctggatttccatacacaaaatatacctaaagatgcctactgtatttggtggggaagtcaatgtgaaaattagtgtaaatgctacacagtagatagaggttgatggcctcttggtcttttcataatcattatcacaggaaacacaatgcttacattgctttacctaattctacttgttccatacaagaaaattagagctggtcactggattaaattgtatttgttaccttcctattctaagtatccttaaaataataggaaggtaacaaacataatttaatagatatatagataacatctataagacatatctttaatagacatgtagataacaactcaaagagatctggcagcttctcttctaagtaattaacctgcacacatatggtttacctagacaatataacattttttgagtatggggagatttgaagcacaagacttgatgggtatgagcttataagtattattattctattgaatattgttttttggtttgaagtaaaatgttaattgaattggtaatggttttggtaataaaaagatgcttctgcaagaacataatgaaatttgattgattcactaagcttggtcttaagtactcgcatcaatgcttttagcttttaaaataaattgtatcaattattgcttaaatttaacattgatgaaaaacatttctagcccctggttaccattaatgtctatatagttaacaaagacatggggagttagctgcaccattatgtgaaggctctttaaattaggtttactgtaataaacacacacaagttatttctacagctctgaaaatcggaaaaggaaatagaagatgtttagggtcactgtcagttctgtctaagcctagattccttttctgtaaaatgaggatgataataatgatatgcccctttgtgttttttagaataacagaataaatgatcaataaattttagcaatgattattattatgcacacacaggcactgtgctatcctctataaaactgtaggatggatgagatgtaataattatccttgtataagtttcctattgctgctgaaacagattaccacaaatgtaggctaggcttagaacactaatttattatcttacaggtttgtatctcaaaagtctgttgctggtctcacgaggctaacgtcaaggtctatatgctggagctcctttcaggagcctcgccaagagaatctgtttccttgctcattgaggttgttggcagaattaatttatctgcagtggcaggatttagattcctgtgttcttgctggctgtaaactctgggtcattattaacttcctgaggctgccacattgctggctttctgacttcttcctctatcttcaaaatcagcaatgatggatggagtctctcccatgtcaaatctccctgacccaccagtcaaagttcttagctgttaagaattcatgtgattacagtggacccacctgtgataatccaggatcctctccccatcggaaaggtggtaccatctgcaaagggccatctgcaaagtcccttttactgtgtgacataacacattcacggatcccaggaactggggcataacctctttgggagaagcattatcccgcctaccacaaaccccaagcttttatatatctgggaaagtaaataaaacaagtatataaataacagccacataaggccgaatgtgcatcttgctttaagaaactataaattcattgttcaatatctaattagaagggagtaatataactcttccttttatcatatatcattataaagcttttatactaggatcttcccctgtataagggattgttttctcttatcttggtctcctcgttcctcatcgattgttgttcctgcagcaattaccgagcagcgaaaatgcagtggaatggccactttacaggagggaagccgtttccaatactcacgaagtacaactcctaacctggtgggcttgggcatcctgggtatttgttcagataatcaactttaaggcttttaaaaacatgttattttgtgaaatatttgtatagaaatgctcctgttccttctttatttacccttaagagattatgatcagaggttagttatgtgacattggttctctcctctgtggctgaattcttgagaacattgccaatattagcagaccgtattgtatttctcatatcttatttttttccttttcatatctgtcattatcatctgatgcccttcatcataacctaattctattcttcaactcaatcactgcagaatggtgtttttttccttgacctttatctagctgtacagagtttttcattctttaagtataaaaatatttcctcccactacttgagtattctacttctagaccttcccaatttaagcacctatatgtatcttcatctcttcctttctgatggagtttcacagaaaaaaaaatagtaaaaaattctgacctagatcagactggttaatagctagctggtttcatatgagcaaaacgacagcttgtaaagtgctaagcttgtgtcctaaaaaagacatgaagcgcttcctttagcataacataagataaagccaaggtaaaatagaacattgtagaataggatttaatgaattaataaaaaagaaagagtaagtcatacagacagaggacataaggaatggtgtgtgagtacatgggcttgggaatcagacgacctgagcttggacaccagctctaccacctgctacttgttgagcctggacaggtaacttactgcaaagcacagatttccttataggataaaaggctataaaaatatccatcttggatagtagtcatgaagagatgatatacataaaaacttggcatatgctaattgctcaataactgagagtttaatatttcctcagacatcatctaaaaggactggacctacatctgcagttaactgcacaatggaagaaacggcctctcctgggcagcctcatggatggggtgaagagacaaagcttgggagtgtagcatgttgagcacatctgctcagaggtaacatttaagcagtaagtcttgtgttttaaatcatgttatcagcctacatgcattatctcttttagtcatcatcataactctgtaatataaatactgtaaaatattttatagaggagaaaaaactcctatgtagtaagaagagagataacttgtcctagtacacactgctagttggaaataaaccaaacaaatgaacccaagttttgcccccagaacctatatgttcatatttcaaactaaacaaccatctttcctggaaagcaatctcttctccagacatctctatttctctcaatagaatgaacttcttagtgatttattttttaaagttaaatgtcataaaataggcatatgttgtagatataaccaaattgaagtagcatgtttatgtattagagcacaacttcaaaatggagagatttaaacagctgtttcatcagctcttgtcagggctcagctgcgtgcctcttctgctgctcacatgtgtagtttctcatgcagttaccatcagattgggctgaagctgccgtggctccaggtctaactccctcatgttcctccccaggggcttcactctatgttgctgttttaaataatcttactttttaagaacagttttcgacatacagaaaacttgggcaatactacagagggttcacacataccccacacccagttttctctgttactaacatcttatatcagtgatgtacaagtgttacaattaatatgcccatattgatgcattgttattaactaaagtccagatttttttcagtttttttttattttttttattttttattttttttagtttttacaaaatgtccttttctgttccaagatctcatctggataccatgtcatatttagttgtcatgtctccttgggctcctcttggctgtgacaactgtggccttgctctttatgtgttgtcttatcctccaggaccacacacacacatgcgggcacgcacacacacacacacacacacacacacacacacacacacacggtagtttggacttcttacttactggccaaaggctctgagatgagggaaggagaagctgtcacattctaaggcctgggctccaaaatcccagaacagcaattcctctgcttcatcttggtccaaccagtcacaggcccagcctagattcaaaggggaagacataagtcccatctcttgatgggcagagaggcctgtgtgtgcaggaagcatgagcagaatagtgagattgtcaagggtcattttagggtcaagccacacacagatgcccggaaaataccaccatttgcttagttgattttaagcagagaatgacgaaatcattttaaaaaattgagaacaaaatggcatattgatattgaatccaaattcctgtttaagctatgtacctccaaatcagtggttgccatagggtatcacattgtaacacaaatacctatttctcatgcaattgaatcactcataaaaatgttgaatgtgccatgtaataaatgtagtaatttgttttctttagtaaatataacaaatgtgtatatttaaaataaaattagccttccattgccatagaattcggaactgtggctttttttttttaagtttaggttgtctccaagcataaaaatggaaatactgatcctgtgacaacacagcctgaattttctgctttgcagatgccagatttatttttaaatggtgtgaatcaaatctgtgctgagaggccaacttcaaaatataaaagaaaaattggcaatgggaggattgtgctggtttggctgaaatgaagtgctctacggcatttcattctagtggagcgtctgactgtgaaaatccttccaattgtaattttctttggcttgtcaaaagaggattatgaactaaagtcagtgttgcaggaaatgtcacctgtcctttgaaagaaaataataaatcaaaatggcttttgttcatcatgtttaaaatgaaaaaaaaaaaaaagttgatccacttggagtcttctctcatttcttgacaaggcagttaaataaataaaacggaattttttgtaattgttacttcttgctcatctcaaaaggggaaaagggaaatcttcattcaatacatattcatacagagaaaatagaagagcagagacagagacagaaagagaaatgagatgaagagtgaaacaagaccctggtagagttcctcaagtcagatgttaagaaaggtatctttaaattataatttgtttctttgatagatactatattacaaattcaaaaatgtgaggtaaataaaaacaaaaggagtagataactattcctgaaaaattctaagtgcttgtatattttgctttaagcaaataaagacaaaattaccaaacatataacagagcttgaaattatctgaattcttttgccttgacaatttttttcagttattttagcaataaacattgcctgtgatgagtacataccacttcagagaaagaaagtgatatttctggcttatcgtatggacatcatggccatgctgacaccatttctttaaaaaagtaattgttaatgctactttgtatgtattaatctgaaaatatagaagagcattttaatagttgatgccaccaccataaactccgtttcttgttgctgttgttataatcatgtactaatgataacatctggaatgttaatgtggtgacaaatttagaaacagccatagattgcaaagctggaagataatggcttacgacatttgctctctaatgttgcaatgatatgatttcagatgtgtaataagccagtatgtcaaagaagccaataagcccatcataaaagctatatagaattttgatagagcattatatcatcgctgtgcattttctagtatggtttggtttggtatagtacaggcaaattttaaagtgtggttttaaaattaagaaatattgcagccaggcgttgtggctcacgcctgtaatcccagcactttgggaggccgaggcggacagattacgaggtcaggagatcaggaccatcctggctaacacagtgaaaccccgtctctactaaaaatacaaaaaattaactgggcgtggtggtgggcgcctgtagtcccagctactcaggaggctgaggcaggagaatagcgtgaacccgggaggcggagcttgcagtgaccagagatctcgccactgccctctagtgtgggcaacagagtgagaccctgtctcaaaaaaaaaaaaaaaaaggaaaaaaagaaatattgcatattatttgattttacttattgattttaactgtataaaactataagtcaaatataactggaaattttcatgtgagcaatgtagaaaaagaaaacgaacattctctttatcaagccaggtttaatatgatgactctcaaacaaataccaacactagggtatatgacacagcctcagagtctttttctgtcctttttctggcactgaagattagagtaccttctttacgattgtactgtgagcatattgaggtaaaccacaaaacaggtatcaggttaggagaaaattagcattctatttaaattctgattttgaatcaaagaaaattaatagatggaaagataaatagatgaatatatagatagaacccttagcaaacatttgcatggtttcacagtgctagtatgtctttatttcttccttatttcagatttcctggtataaagagcaattgtttttttaaaacaatttaatggccatgttaattttaatttttactttttaaattttttattattgagttttagggactatttaaattgtgtattagctattaactatgggtcagcttctcacttgtcatcctatctgaattttcactgacatcaaaaggactctttcctttgtagaagcattagtagatcatcttctccaaaccggatacatgtttcagagtttttcaacacttgtgcatataatctactcacagcacccagtaaaagtccaataagtcagtgttgactgactgcttcctatctagttcaaaagtggggagaaaattaaacatgttttcggtacatttcccagcttcaatattttaacttctcaaaggagctaaatgtgcttggaaatggtgtacgacattttaattatgctaccagaagaatccgagaagagtgaacatattgagaaacagggcagaatggaagaagaaagtggcactgctttaaagccaaattatctgatgtttacatctttcaacactttggcccaagttcaagacattaagcctagtttttcaaatgcaattatgtatggaaagcaacaagtatagtcatgcctgatgatagcaggggtcaggctgagggacacaccattctttggtcaaaacatgaaagttaatttcaaaatccaccaggccaaaaagaaatattaaacaaagtttttgaaatagaacattttgatgtcagtatgtttcttttatcttaaaaaacccaatcattttgaaattctctgagtattattcaggtaaagaaaaaacatgctttctcacaattaggaaacaccaggccttgatggatatttagacacagcttgcatgacatttttagctatcacactagcaggtgacatgacagaatatggaagaaccgtagctccttgtgacgtgatttctgtggtcctccctgtttgaagcaatctaaacttaaaaagtatatgactttgccaaaatgaggtgaaaacctttttaaagtgaaagattgcattaaatcagtaatttgacatcacacttgagaagaatgaacatgaataattttttattctgatgaaattcacttgtttaggcagatgtaatgaacacttgtttgttaacaagttattaatctttatgaagagctactaacatttctgctatgattgaacaaaatattatagacatttgggggtcactttcttccagttctctccattctcttgccctttttcttcccggtttcctccaattcacttcccacccatcctcaagagcctataaattggcatcataactctagactaaaatagcgttctgagaactgaaagctcatccttcacccattttctcatactgtttgccaaatacggtttttggcatctgaaattaacattccaacattaacagaaattgctgaatatttaataacatgtttagaactgtgcttgcaatcccttgaagccatgaatgagtaccagccccagatgaaattgtccagcctcatgtgaatcgacggcttccatcagagctgtgccgcccattctcatggctaatcttcccatgaatacttagactgccctgctagttaaagtatggcgcattggcatcacctgggagtgtgttagaaatgcagaactactgaatcagaatctgtattttcataagaccacaggtgacacacgtgcaaatgagagagtgagaagcattggcctggatctatccaccctcctgaaaaatagaccaatgctgtccccaacccactgctctctttctgatgcttgtccgaatggcctccttcacatcttctgtccttttcccctgctcagtcccttctcttttctaggcagcacaaagaggccagttgcacaccccatgggcgtggagagacacctgcctctatcccatgcccctttgtgagtaccacactcacaagactaataatgtttaaggattacttcaataatctaaaaagaaaaattgattttctttccccattttgaaactcatcattttctacatagctaaaatagttgaaattcactattaaacatttgtaatatgcagatttttttacaaatattaccacattgtcttcatgccattgtgtccggaattggtgggttcttggtctcactgacttcaagaatgaagcctcggaccctcgcggtgagtgttacagctcttaaggtggcgcgtctggagtctgtcccttctgatgttcagatgtgttcggagtttcttccttctggtgggttcgtggtctcgctggctcaggagtgaagctgctgaccttcgcggtgagtgttacagctcataaaagcagcgtggacccaaagagtgagcagtagcaatatttattgcaaagagggaaagaacaaagcttccacagtgtggaaggggacccgagcgggttaccaatgctggctcgtgcagcctgcttttattctcttatctggccccacccacatcctgctgattggtagagctgagtggcctgttttgtcagggcctgattggtgcgtttacaattcctgagctagatacaaaggttctccaggtccccatcagattagctagatacagagtttcgacacacaggtttctccaaggccccaccagagcagctagatacagagtgtcgattggtgcattcacaaaccttgagctaaacacagggtgctgattggtgtgtttacaaaccttgagctagatacagagtgccgattggtgtatttacaatccttgagctagacataaaggttctccacgtcctcaccagagcagctagatacagagtgtcgattggtgcattcacaaaccttgtgctaaacacagggtgctgattggtgtatttacaaaccttgagctagatacagagtgccgattggtgtatttacaatccttgagctagacattaaaaggttctccacgtcctcaccagagcagctagatacagagtgtcaattggtgcactcacaaaccttgagctaaacacagggtgctgattggtgtgtttataaaccttgagctagatacagagtgccgattggtgtatttacaatccctgagctagatataaagattcttcatttccccaccagactcaagagcccagctggcttcacctagtggatcccacactggggctgcaggtggagctgcctgccagtcctgcaccctgtgctcgcattcctcagcccttgggtggtcaatgggactgggcgccatggagcagggggtggtgctcgtcggggaggctcgggctgcacaggagcccatggagtgggtgggaggctcaggcatggcaggctgcaggtcccgagccctgccccgtgggaaggcagctaaggcccggcaagaaatcgagctgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggggcggtggcgggcgcctgtagtcccagctactcgggaggctgaggcaggagaatggcgtgaacccgggaagcggagcttgcagtgagccgagattccgccactgcagtccgcagtccggcctgggcgacagaacgagactccgtctcaaaaaaaaaaaaaaaaaaaaagaaatcgagctgagcgccggtgggccggcactgctgggggactcagtacaccctccgcagccactggcccgggtgctaagtcccccattgcccggggccagtagggctggctggctggctgctccgagtgcggggcccgccaagcccacgcccacccagaactccagctggcccgcaagcgctgtgtgcagccccaattcctgcttgcgcctctccctccacacctccctgcaagctgagggagccggctctggccttggccagcccagaaaggggctcccacagtgcagcggcgggccgaaaggctcctcaagtgccgccaaagggggaacccaggcagaggaggcgccgagagcaagcgagggctctgaggactgccagcacgctgtcacctctcaccattgtctttataccattcctatgagagagatcagcagctttatcctgacttacaggtttggagtggactataaataaattgggaaggtatcgtaaattagctttttgaaactggaattagtgtcctgtcttaaagtctgcaggaattacaagactcgaggaagagaatcattggtggtttgggaagctctgacaaacaattaagtagagaatgatttagtacacagctcagttcctgaacattctcattgctgcctctggttacaaaaaaatcttgccaagacaaaaatgttacttctgtataaatccctctcattcgaacttaaacataataactaataatatccagaatgatgacttgaattttataatcagtgttaagtggattttaaatacagaaaatttcatgaactttcatggctttaactaaacatgtttgaatatggtaaggatttttctatgtgtatattactatgcagtgtggctctgactctgattgcattcaatattccatctgattaaaccatgtttactcatttctcccctcactagatgcccttcttgaaaccttccctcaatactcctatgaggaggctttaaatgctctgaatctattacaaagataaataccagggaagtcaattttaacaaaccttgaaataacctaaatgtctattagtaagaaagtaattaaattaaaaatgttgtatactcatgtgatgtaatattttgcagctggaaaaaagtaaaatagaatacagttgtttatttggaaaaatgtccatatatgttgctaatttctaagacaaaaaggaaagtttcagaatgaagtgtataatggttgcacttatgttaaaactctatacacccatagcttcagaaacatgaaggtaaatagattaatatctatagctgtagataggttaaaataaagaaaggtggatggatagatgggtagaaagacagaaaggaagtagacatgaagatattcatgagaatttttgaaaaagaatcaaacgattctgataacaaatgttaatttctggggagttcaaatgaaatgtgagaaaagagactttcactttcttctaaatacttttacagagtgtttgaattttttgtaaatgcgtattacacttaaaatttttaattattaatttttgtaggtatgtgactgagtatcccatttttctaagagatagcttattatttttctctctcttctttttcctctcctccttttcctcacttcttacttagctctttagaaatgcaattatagcctcttatctcccatttaccaggcactccttacagggcaagttcatctccagagcagaaccctcacccatcaggaggttgccttgggagataacagttgattgacaacccagcatatgcctgctagagtttttggctgcatttacagcctgtttctgcccatgaagaagccaactcgaatgcccggtagataaggcaccaaagtaagtacgcagccctcttacctgctcccttccatctcccataggtcccccctttaaaagggcccactctgtgctccaaaagggaagcagtacccttatggtaggaacctgtgcttcttccccaaaggtagctttggaaaaaaaaaaaaaaagtcattttctttataccagacctcactctttttaactggactctgcaagtggcaagggactaaacctgcattttggttccaactacagagtaggtatatacacttatggggtaggtgagatattctgatacaggcatacagtgtgtaatcatcacaaaacagggtatccatcacctcaactatttaactttcgtgttacagacaatccaattatactcttttagttatttttaaatgtacaattaaattattattgactatagtcaccctgttgtgatatcaaacactagatctaatttattctatctttgtacccagtaatacacttaaatttttaccattacatcttttcagagtacctagcatttgctttgtatcccaaatattctgcctgtctcattgctagacatttgcattgactcagtcgcttattccccaactagacatcttagctatttctactcactgcctgttgtctgaaatagcttcctacctcgattttgcctttctttgcattttcaaactctaaagtttacttctcctaggaaataaactggttatataaatgtgggtaatcattcattcccatctactgagcataacttcagacattttccctcttagtccaaagagcaattaactttatttttaaattaaatataggttggtgcaaaaataattgcattttttgccattgaaagtaaatggcaaaaaccgcaatcacttttgcaccaatctaatatttaaattacatgcttccaacatgaggcacacaaccttcaataaagatattttctctaacaaccatgaatacatgttaaagattcaacaatgggaagaaatgtcttggaagaatcatgttataggaaagaatagaactaattaggaatgtaaatataatttagaatacggtctctcaagagaattgatcctggacttagccaattattagcatagtgtcccggctgcttcaggactattattcaacttccaaactcttaccctttgaattaaattggtattttactagtttgcagaggactggcagattccttgaaacttgcgccccatcccactagaaatttcgtcttcaggaaccacttcattgcaggcatgccgcagccgcccccgatcccttcccaccgccccactaggcttatgactttaatagagttgtctgcttctgggttatctgcctcacactgtgatggcctcacttccattccatttgcttagcttctagcactgtcgcgcatagaggtgggcacttaataaatgctgccaaccatgtcaaggtaatgagagcagttaaatgagcagctgaactccatttattcagaagtgcttgttgcatgtttactgtgtacattgtgttatatgttaatgggaggctgtaaaatgattccatttattcatcattgcaatgaggccattgaactggatgatctctacagtaattgcacatctagtactctgtgattctaaacgtaaatttccacatgagagaacaaagtttctttccttgatttaaacttatgtatgcagaaatacaatatttgtatgtaaaaatactagaaaatatgagcaaatatttaagtagtatgaaaagtgctaaaggaatctaaagaatttgagagagatgggtggagaatgctttttggacaaggtaggtctttagcagagtctttaagaatgtgatgaatgggacttaatagagtaaatttgaattaattccaagtagtgagtgattggaggagaaatccaatgttcattcttgtcccttccacacccagaaatgaaaccatgacccctttacttagaggtaggatgatttgcatttacaatcagtgataggcaatgcaacaattgacaaaatataaaggtagagttaccatttagtgaaccctaagaaatgcagtagtgcatctggcacaagcgggaaggctggaatttcagaatggaaagaactggggccgggagcagtggctcacatctgtaatcccagcactttgggaggccgaggcgggcagatcacgaggtcaggagatcaagaccatcctagctaacatggtgaaaccccatctctaataataatacaaaaaaattagccaagcgttgtggcgcacacctgtagttgcagctactcaggaggcggagacaggagagtcgcttgaacccaggaggcagtgcttgcagtgagctgagatcgcaccactgcactccagcctgagtgcagagcgagatagagcgagactccatctcccagaaaaaaaaaaaacaacctggagaggaaaaggcagtggtgtgaagacgaaaagagaggagctctgtgtgaaagctatagacgtccagggaagacctgaacacctccactttacagctctatgcttttgcacaacgctggtagaaaagagatctagaaagaggcatgttaatttctccactctccaactcaactctgcacaactgagatttacaaaagataactcgagttaaaggctgcttaaaatctaggtctcttatgtgtctgcttggtaagaagctggacatggatggaggaaatggtagccagggacttcactggttcaggatagcaaatcaagattatttcctagtcaaaaagacaagagtgaagaaagcaatccaacttccccccaagagcatcctagcagtcctacatgagactaactccaggaacacaaatccagtgaagcagtcacgatcatttaaaaaattttaaaaatccgtaacatctttcaagaaaacactaaatttgttgacccattttcaagactctttctttaatgattgctcataaaattttagaagctgacacaaactaatagaaatatgcacaactcagtataccctattccttactaccactaactgaaaacctgaatgagctacactctcttttttatactggattaaatagacattgttattttctctgactctccagaggcaaaactgaacataagctacaaaaatttacattttcaacagaatgcagttttcttttgtataaaaccttctagatatttattctctagcttcatttgttcacctgcttgcttggaaaaaaatgatttataagaagtctctctggccaggttgcccaatgtagttagcaaactagcaagatgaaacagctgagactatctgttagcttcctaattttccaaagatcaccttacaaaccaattaaagtttatgatgaattatgagcaggactatcatgtgtctagcattagaggtcataatttaagcccccaaaaatctatgatattagacaaattatgaattctgagatttgttagcatcatactctgaaaggaactgcagattctctagttcaaatccttttattaatattacagatgtggaaacagttggattgctctgagtgaaaatcccccccttaattgtgaccttaaaattatacttgatgtatccatcctgccaaatgagtaagagctattatgacaaaaaaatataacagaaaagcagaatatttcttctaaatagccacaatgggtaaaacatttccatgtctactaatctagctgacatgtgacactgttctgggccaagtgaaggctttgctgatgtattttttgtctctgtacttctcatagaaactcatacagagatcatgattgaaaaagtttctttcagctgtgtaatttaatcaacctgacctcctaagcctctcaagactttaagaacaggctggccgggtgcggtggctcacacttgtggtcctagcactttgggaggccgaggtagtagattatgaggtcaggagttcaagaccagcctggccaacacggtgaaaccctgtctctactaaaaatacaaaaaaaaatttagctaggcgtggtggtaggcacctgtaatctcagctactcaggaggctgaggcaggtaattgcttgaacctgtgaggcagaggttgcagtgagccgagatcgtgccactgcactccagcctgtgcaacagagactccatcgcaaaaaaaaaaacaaagaacaggttgatgtaattccttcctagacaagatttcagttgaagaactacttgatacggttcatttggagctgttctttgtcccttaattgtaacagacttagatggagttggcttggcaggttataaaactactacagggacagagtactgtggtggtttttgttgaataaaacctgagaatctacttcctaagattctactgtagagatgtatatctgtgtacgtgtgtgtgtatatatgtatgtgtaaaattataaataatttgtgtgtgtgtgtatgtatacacatatatatatatgtatacatacacacacacattcagagacacttgtctttattctatcactacatgaaaaaacatttttaaagctttcctgccgggcatggcggctcacgcctgtaatcccagcacttttgggggccaaagcaggtggatcacgaggtcaagagatcgagaccaacctggccaatatggtgaaaccctgtctctaataaaaatacaaaaattagcctggcatggtggcgggcacctgtagtcccagctactcaggaggctgaggcaggagaatcacttgaacttgggaggcgaatgttgcagtgagccaagattgcgccactgcactccagcctgatgacagagtaagactccatctccaaaaaaaaaaaaaaaaaaaaaaaaggcttcccatgattaaataacaactttgaattgtcaaagcaaaatactattttgtcttataaatttattcttctatcttaaattttaggtctaaatgactgatcctcaaaccacctactttcacaaatgcttttaaatatgttcacgtttccactcacatatatcatgattatgtaatatattttaattgaagtcctcattccttcttttaatcattcatccaacaaaaggtagaggaccactctgtgctgggcacaggcttgggctctgagggttcatcagaggcacagagcacacatttcactccgcgataagtatcctaacacaccgtaaatgagtaaatagaaatgagtaaacgatatatactatcagaaggtgataagtactatggagaaacatatagtatagtaagtgggaagggggacagaaaatctggggaggttgcagtattaaatagggtggccagctgaagatatcagtgaaaggataacattagaacccaaaaaaatgaatgtagtgagggagtagtgggaaaagtggatttcaagtaaggcaccagcaaatgcagaagtcctgaggcaggagcatgtgaggctggaagccactagacaacctaaggagagatgtcatgcggcctaaaaatggaccaaggacatgagcagctacttttcaaaagaagacatacaaatagccaacaggcatatgtaaaactgttcaacatcactaatcatcagagaaatgcaaattgaaaccacaatgagatagcatctcatgccagctagaatggctattaccaaaaagacataaaataacagattttggagtggatgcagagaaaagggaactcatacactgtcgacaggaatgtaaattagtgcaacctctttggaaaacagtatggtttaacttaaacttgagtagaattactcttgacaactgtgttgtcaacaggctgttctgggataaggctgagagtaggtgagactcgttaggactctaaaaggcatgacagtatgcattatttttgtaaaggctgtgtgttagtccattttgtattgctatcaaggagaacctcaggctggataatttataaagaaaagaggtttaactgattcacggttctgcaggctgtaccagtatggcgccagcatccgcttctggtgaggggctcaggaggcttagaatcatggtagaaggcaaatggggagcaggtgtgtcacatggtgagagggagcaagagtgagaggagggaggtcccagactctttcgaacaaccagatctcaggtgaactcattatcgtgggggcaccaagccgttcatgagggatctgcccccacgacccacactccttccaccaggccctacctcaaactttggggatcccatttcaatatttggaggggacacatatcaaagccatatcaaactggaaggcaggggagacaatcagagattttctctgatttggctcttgccatttaagaaacctcagactgttaaaaaacaagtgtgacgttaaactattcagttatgaagcactgatgatttaaacttagaaatcagtgctggctctagaaagaagttcaagattcttcagggcaggagcgatgacaaagcagacaatgttgagcaggctaaaaatcccttaaatggaccaaaagcttcagattattttaaaaaataaacaaacaatgaaacaatagtgagaaatagcatactgatgaacagctaagactttagagtgagagagacctaaattttgattcatgatacttgcctgttacctgtgagaccccgtgataagttaccttacagctctgaggctcagcttccacacctgctcatgctgatagtaacagcaccaaactcaaagtgttattaaaaggatgaaatacaacaattattaaaaacacttaacacagtatctgttgtgagtgcccaataatgataattattagttctcagctacaataattgaaatgtctcaattatttaaaggcaaaagaaactttatttttggaaactgcacaggatcaaaatacctcatatatattacatgaacttgaaattagttactgtcttagaggttcactaagaacacactgctgacaaaattgcaaagaataagcttacttaatcaacctctagttaattgacccaacaattatctgataatctccacttcctctgttcaacaggactgccctgtcatgctgagaccctgtagctggtcaactctactccatgccactgtgcaattttaccctcataagttggggcctatgcatattaagtgctacgtgtattttttcctaagattgtttattccaatttcacttattactataattatatatgctaattagctgtttaataaagtgatgaaatatgagtacaaaaaaggagagttgcttccacaaaaactaataaaaattattttgaagtcttttcaatataaactgtatcactgttgattacatgtgggtaagacaacgacaacaaaccccaactggcatggggaggaatgttccgtaggattctacatctatattgctggggcggtgttaagttgtcattcagcctgaagaaataatagttctaaaattgtagatgtattatgagtgtggcttatgaaaaaaaagtggatcctcaatctgggaacccacattcaaaaatggatctggtctcctataaaaaattaacaattaaatagctgggtgaataataaaatataaaggtatgtaagcatcacttttttatgactttccaatttctcgtctctaataatcagtcagcaagtagacttgattgaatcaggtaagaggacataactttttatctacttgtattgtggcccttccaggcctccacgtgagtgtcagtggccatggagaagcaagattgacaagctgttcagcttcagaagcatctactcctaggccttcactgttgaaggcattccctagtaaccactttcatagtcgtccctttcttttgctcaaggcctgtggctcacgatgaaagggcaggtaaaaatgggatgagtgaggcatttctctaagagaggaaatgtctcttcagctctaagggaggtatgggggtacagatctctccctctttccaagattgtcagtcttataacaaaagatatgaaaacttagtagtttcttggtagaaacctaagcgaaggggaaaaaaatgcaatcacaatccattacataaagagtagataattttgtaaagctctaatacaagcttgcaaattaccatgtgccaagactcccggggtaagtagaaaacgatatgttttagtcatgttaataatatcagaaaagccatgtaaggagaagagacctgttaaatgtagtcacgtttacaaggatgctttatagtcatcaatgaagacttgtgctaattaatgcttacatgattaactcagtctagttttatttaatttagtccgactacacacacacccaaaactgaactgaagcagggaagacattttgcaaaaagactcgccaaatcattttacaatggattgtggaagaaactttctttgaaagactttgtgtaagttttttgaggctatgtaattacggtattgtttgaccagagtatcatacttcctagcataagcttggatgtaaaatatattggagttttgattgaatatgtggaaataagtgaaaataaaacataaaacagggccactctgccaataacatggatattttaatgtactggattatagttttggtcatgtggacaaaaacattcctgttacttaatctgtgttctataatagtattatatttttgtcaggattactctaattcttgtcaactcaagtatattagattctattatgggtcagcagagcatttttccatatttttccaaacaaactattatttatttatcttattttatattttatttatttattagtgtttttttgagatggagttctcttgtcaccaggctggagtgcagttgcgcgacctctgctcactgcaacttccacctcccaggttcaagtgattctcctgcctcagcctcccgagtagctgggattataggtgcctgccaccacgcccagctaatttttgcatttttagtagagatggggtttcaccatgttggccaggatggtctcggtctcttaaccttgtgatccgcctgcctcagcctctcagagtgctgggattatagctatgagccactgcacccagcctaaactattatttattaattcaataagcacactaataggtgaacaaggatgccaccaagtctaccaagcaaagatggagatttgtcccttcagtgatttagacaggaatgacggcaattccttactagttgacctccctttttctttttccctgccaaataatctgctgtcagattttccttctaaaaacagggctctggggtggtcatcctctgcttaaaactctcaacggctgcccattgctccaagctacagtccagtgctcagcctggccccacagcccgcatcagggagcacttacctactgcgaagctgctccccacttcccacctcttctgttatccctacactccagcaggagcatttacctactgcgaagctgctccccacctcccacctcttcttctgtatccctacactccagcaggagcacttggctactgggaagttgctccccacctcccacctcttcttctgtatccctacactccagcaaagctgttgtggctcacctaagtattttatgttcccccaacttgatcgagatctctcttttctcctccatttccgcgcatccaaattctagaccctatccaaaccccacatcttccaagttctttcctaattccccaaccagaagtaatgtttggattccagcagcattttacttgtatcttcagaggatacacgatcactttctacctgggattagaagttttatgtgcataccttgctctttttactgggatgtggtattcctgagagcaggactgatactgctttatctctttaactcttttaatagttgtcatagtttatatgtttagaaagaaaatcaatattcatggataaggtagcaaggattcatttagaatacaaaagacagaagcttagatcagacaaaatctaatgctaactatataactgagtcaaatatttcaatgtgaaaggatgctaaaagatgatttggtctattcattttaaaaattagaaaattaagaagcagaatattaacagacttttttttgcaattctatattgtgtacccccagataggatgaaattttaaataattttcaaaatgtgatcacttttatttcactgtcttaactcattcccacaaacatatcctaaatcatcagctgaaatgacctcaccagaaccagccctcttgttcttctccttcatgcgcctaaccagcacaatgatctgattgtttttctaattttattttgacccgtatacatggcaacaatatggtgacgtggaaaagaacatgtactttggcatcaggtatctccgggttttattccctgctctgttactttcataatttgtagccctcaggctctctgagcttcagtttgctgatttgtaaatttaggatattgaaaagattacaatagctaatattattgagaccttgctaaatatatactgttctgaatgctttacatttattgtctgaaatctcaaaacaactctatgaagtaggcactattattaaccacacacttatagatgaagtagatactataattatccccatatgatagacggagaagtgacggcttagagaagttagctggcgtctagagtcacacagttactgaagagtggagctagaaccgaaaccccgttcttccgacttgcgagcccatgaacaaatgattattgtgaggatgatttgcaaaggccagtcctactgtttgctataaagagtgtttctcaggactcaggttgaatgctgttattttaagtatgtatgagttaattttactccaattacagaaactctctagttgtggggtttaaggaacaaatgttacattctctatcatgagcactccccatctgttgacattaggaatcttagctaatttttcttttactgttgcaatttcttaaagtatggcaactcttttgagttaaattgatagtgcctgtccattttgccaactgaagaatctcactagtgactgaatgtcctggggtgctatcttcaagtttgatacccagtccttcccccacacccctttctaactgccctcaagcagaggaagaaatatcctaccaggtgcaacaaccaccaggtagttcaatagattttgcaaagcacatttttctgaactattcagtagaagcttctaaacatatctttatatgttctgaaacatataaaacaaagcacatttttcagaattattcagtagaagcttcgaaacataactttctctataaagtttgcttgttcaagcttttatgttaatatcatagtttaaatgaatcatattccttaacattatttttaaaaacaaggctttgatggagaaataagtcacgtgtgaagcacaggacgtctttaaaaattagcaaggagggaacagaattaccaaatgcactcatttactggcattttatttctacagacatcagctcaatttcttctaaaataaaagctaatgaggacaatggcatgtccaaatgcctttactggattatatatgccacaagtatactatgtgagtgagccctgtagcaaattggatataatagtgttgattctgtattgttggtacattgggaaggggtttttatagatttgaattttccaggaagattactagggctataagaagatacatccaaccatgctatttgtccttttgtctataaatttgtctttcatctataaaaaaggtgattgtttgtgtgaggagtccagcagaccttacaactataaaacattgtgaatctgtgatccagagaggtagatggataggacaaaccaatgaatcacctaaatagcatccaggcatctctgtgtgtgctaaactgtgccataaatgaaagtaatcatcttctcttctcttcccccacctctctgtaaagtaacctcctgacagaagcttcacctcttcttgttgtgctcatgtattccagatatcagctgaggtttcccaagctccctaaaatctacagaagttcggctcaaacccctatcccagatgctggagatgaccaagttctccagaaacacgtagcaaattccagggtgggaaggagaatctgagcaaggagacaacgattacattctcatggtcacttgtctcttgagctagtgctttattggaattagtttattctgttaagagtttcccaaatgtcctgtctttatgttacactcacaacaaaacagacataaagcactggcttagcctccagttccacaggagcctcatcaacccatgccttcaactgacgcctaagctgagactaaagaagatggtaaccaagtgaagagatggaggtttggagtgtccaagcagagaaactacatgtggaaatgcatcgaagcaagaaagagcatgacatcttcttagtactgaaagaaaatacgactggacttcaaatattttctcattcgtggggttaagaggtgggtgtttctttactcctccttttcaatacatcccaacaaaacatctgtgcacttctttagacaagaccaaaatgcaaatattttcgttgctgttctttgtactgtcaccaaatcaaaatagtaccttagttttgtataattctttacagttttcaaagcaatttccactatctcatttgaaattctcagaggcccctcaccaccaaagataatcagtgaactatctttttcatggatccatttgtgggtttcaacaaaaattaactatagaacttactgaaacatcaaacattttaagaaatgggaaatattatttttttaaccaaaaagcaaaaagagtggtttttcagacacacttattgcatatagcaaagcagctcatttggtgggtgggggtggggtatggcattttttttgtcttacagccacgagaagcagcattttagaataattatttacaaatttgtaaaactttaaaaagaatagactatataacatgttgaaatagaatcattgttacactttgataaaacattaaacaaaacccaggtctcccttttcacctttctaacctcccctttggtctgatgacagtcatgggggtgagggattcaccgggattcaggtaggggctctgggcctgcctaagccttgccaagaagcagttaccagcttggcagtgcatacctgaagaaggacaattgaacataaggctctgttgacgtgcctgtaaattgttctgttagagttggtctatttaaagcaattatgaatgcatgggtcagtgctattggaaaagagcacttttgtaccctttcacaggcctcagaagcagtgtattctccccatctgaccctccggatggttccaggccaagcgtctctcagggaaggctggtttctctcaacgccccctttctgtctgtgtttcttggttaccagacttgcttactttgtactatcctcagagcccatgacttcctctgcttttttccctatggaaccttccttttctcaaaagtgctcacaaccttctctgtgtcttagtgatcacaagactgagcacatttcctgttcgctgaataagctctattcaatacaaataaattaaagaggaataagcaaattgctttaacgttgtgattgctcattaagactctgaaaaatactcaagagcatagacttgttcccttagaaatacgatcaacaggtcattgaaatctttgaacattaagtaactgctatgtgtagaagtgttatattgacattgttactgtggatctcattttctcgctgttttgataatttttactccacattccattaaaattattattttaaaaaattaacacaaaggctttcccttcctctgtgatgggcaccagaccaaagttgatgtgcaatagaaaggaaatattaatcagagtgcaaagcagtggaaagatccccactgctttgcagattagaaatggatgtcaggaagtttcctgcaggaggccatgttatttctttactctctttgtaaagaaacaatttacaaaaaatgttgagtcttgccctaggaggaaggcggtcctggagacaatggctttgccctgaagaagaccatgctgttgaacaccatataaatgatgtggcagtgagagccgaaggctgtgggatctgagagctggctcagcctcactgcccaccagtcatgggatcttggtgaaatcaccaattcctctgagccccagtttcctcatctgtaacgtggatttcataaaaatcacttcttgtattgtaagcgttgaaagcatgaatatacatataatgtaaataatttctcattggataaatcacatgaaaagtactcaataaataaaacattattgtttgttaattcttgatttagagccatctgagtcttttctgtacccttgtagataccttggtcagctccatggagcagagctgagttgacagttttggtggtagtgaactgctaaggaatagaatgtttgatgaactaatatcccctattccatgagtcaacatatccattcctgcaatgttactgagggaaggccctgggttgtcatcactgtgacaatgctggtgcaataattcaatgaattctttctgcttgttgcacagacaaaacaaattcactgagatggtgacactgcagtaaaaaaaaaaaaaaaaaaaaaaaaaaaaaaaaaaaaaaggtttaattaacacaagactggccatgcaagagaactagagttatcactcaaatcagtccctccaagaactcagaggctagggtttctgtggattctttggtgtgtaggaggctagggaatgggtgctgctgattggttggggatgaaatcacagggtgtggaaaatggtccttgtgcagtgagtacgcctctgggtgggaccacagaaccagtcgtcatgagtcacagctccagcttgggtctgtcagttgccagaatgcaaaaatctgaaaaatatctcaaaaaaccagtcttaagttctacaatagagatgttatctgtcggagcaattggggaagacacaaatcttcggacctctggccacatgattcctgggcagtaagggattacagaaactataattctgctacattttagaattcaggcccctctcatgatcttaaacttatggcctttcattagtttctggtccttgagcaaggatggggttggttttagggaggacctgtcgtcatccttgcttttaagttactaataactgaattcctcccatggttagcttggcctacacctaggaatgagcaaagacaaccagcctattaggctagaagcaagatggagtcaaccatattagatttttctcaccgtcataatctttgcaaagccagggtttcactagcacccggtataatgctagaaacagcatagggcccaattgagatctactaacttgaaatgttctgacatacttggtagtaaatttttttagtagtagaaaatctaaagtttaactgttgcacacaaacgttttttttaatcacataggaataaaattaattctgaatggaaatgaaaaataactaaccaagagcaacagatcatctgcattgttatccagacatattcagttgtttgccaagaaactgtaagttaacctttgagaataagaacagtgtctttgttctgtttattatagatggaacagaaattctgtgaggattccccaatgccatccatggaactgtgtgtgctaacatgaatttttaaaatgttgaaattatatttagaaatgataagaaaaccaaataccccatgttctcacttacaagtgggaactaaacattgggtattcatggacactggggactaataaagggaagaaggaggggacaagggttgaaacactaatgatttggtactatcctcactctctgggtgatgagatcattcatatcccaaacctcaacatcatgcaatatagcatgtaacaaacctgcacgggtacctctgaatctaaaataaaagttgggattttttttaaaagaaatgatacaaatggaacagcatttagagagttcatatgcgaggtgcagaacaatgacacttgttttcttcattttccttttgtattatttacgatgaactggaatcctgttcatttatactgtatcatgaaggttttaccagaaaaattttagatttataaaagagaaatcaagactaacatttaatagtttcatacacttaatatgcaagtctgattaagctaataaaggtaagttttaatgtgtatttttgtttagaaatgcttatttatattcatctttaatagtatgggttgaattagcattttagtcgattggataaatgtgaccttcaacttgctgatctagcttttgcttttcctgtattaatttatgaataatttacatttggcccatgggcattttacaatacacaatgacatggatatcttgataaactgctaattaacaattttatcagcaaactttccccaaaacagagcagatatcgtgctttagtaactttgtgcttttaactatgtctaacatagtgctttgcagggggtagcaaaggataaacattaagaaattattaatttccatgagctactccatgaatatttcaaatgtcatttcaagtacttttcatggaaaactaaaaccttgttcttttcatcgtaaaggattgtattcattgtttattagtctatgcatttggactgtgtgacttagctgctgataactttaagcaaactgaaaatttttcaactaaagacaattttcttgtaatggcaaaataaataaaacacatgtaagaaatgcaactcaagcacaaacctttatagaaaatactcgtaataaagtcaacagaagtttttctttaaattgagacataattttctgttgtccaattagaaaatattttaaaaattaagaaaatccattcgtaggaagagcaaagaaaatgggcatggtcatattcttctcgagcagtgggcagtagcataatcctttagatagtaattgggcattaatgtagtaatcattccaaaattgtgcatattttttgacctaataattacataagtagaaaaatttaaggaagtaactctaaattcagaaaatgctttaaagaaaagtgttcatgaaaatattatttatatagaaaagaatcaaagcctaattctccatcagaaaggaaataattacttgtgatacagccgcatgattgaataatgtggacgcattaaaatgcctacaataatctggaaaaatatttaaaattaaattacataaaaaatacagtataaaactctattcaacaatgttaataatactttctttgaaaattgaattatggatttttttctcttttctaattttatgtatttaatatcttttaactactatatatttgtcttatagtttaagaaaaataaattactgagttcattgcaggaatccttttggagattatgctctgaattactttgtagcccaagaggttatatcatgtgaactcaagatagcaaagtatggttttaagagctctcagatgtaagggggcccattaaagattctttgtctaacccagtcaaaggcagaggggaggtaatctgtggaactcctggtcatgtgcagagatctgtgtgtctgaagaaatcagtatgactacagcttaaacaaaaacagatggaatatccgcagatgaactgaatatatagacaaggaacagatcaaacttgcccatgttcctcctcagggaaatggaaagatttccaaaaagtttgtaaagaaaaatgacaagatccgatttacattctacagagatcattgtgattgtttaaaggacagtggattgaatctaggagaccagttgaggagctatggctatagcagatggacgcagtaatggggcctgaattatgatggggagtggcagtggagatggagggaggtagagatatttgaaacatattgtgaagataaaattagcaagactttgtgatggattgacggtgggaaataaatgaaagtgagacatcaagaaatttactttgatttatagttaagaattttgtgtttttttttaaatcacaagtgagtgctgaatttgattaaatactgttttagcatctataatatgattatatgatgttcttatttctgttagtgtgacatgtcgtatttattgatatttaaatgttaaaccactttcgtattttcaatataaatttcactaggttgtaatgtaattatctttttatatatcactattaaattattcatttatgttttgcttaagaattttttatctatgtttaagagagatactgggctataattttctttacttatcatgtttttcttaaggttgggtatcaactggtgtttgcctcataacagtagtttggaagaatttttttctttttctattctttgggagagtttctataaggctgaggttatttctttcctaaatattcggaaaaattcacagttgatccatttatatctggagttttcttggtgagaatgttttttagtaaaagactcaatttttcaatagataatcacatcttgtatgtatttgtttcaattgtgacatctcaggatgtctgttagcttcagttgtaatgagacttttacagaatcctcttcttgtgacctcatacccttgttacaccttgggtattcactgcagtctcttggtccacggctttcagctgcttatcaagtgctttctgtttcagcatctcccgatcagtgttatgacgcatggctgggttatatattataattttcagggccattataaaaactaaccataccattcttttgcttaatacttgcaaaaattttgccatcttctatcttgctttgacatatttttctgccttttaaggtctagctgtctgcacaggttttgccataccttgtaagaatagagctaaaaagtctttgtaagccactgagtgttgttcttataaagagataacaagcgttgcttcaccagcctttttttgttatcataagtaataatttcactgtgcttgtttaccaggttcagattttggagttctgagagattactggttgaatagacttgggctaactcataatatgcattgctaaggagcttaatgaatataccagtaatttgagatctatatttggtagctattgtactctgacaagtaatagcaaaaaaactatcatcaactttttacatgattctgaagtcaccctcacagagttatcaagaattatcgacagaaatgtagttataattaagcatttatcaggctgccctttgacccatttccttgaaaccgaaactcccgttgcactgggtacggaccacttgcatccccactgttcctacaggtaggatttctgaccttagaatcatagggcttttgcttaagacaggatctctgatattggaatcataaagcttttgcttaagagttgcttaagcagatcctgacttccagcaggacaatagaggttaaccagcttcaaggccccaccgaagacctgaatgagcatgagaagatggtttcttcatctcccagccccatgactttgccctgggcaattcagccagtcagtgatctccacactgcagcccatgccaaaacccttaaaattcccagcaccaaactactcagggagacaaattttgaggtttcctcccatctcctcatttggcagccctacaattaaacttctttctctgctgcaactgggtatatctatgtattgacttgccacactcatggggcaaaacttatgatttcaatccaacatgatatgacgacctgacatggcaagagtgggttcagcttgttcagaaggtaaagtgctcttcagccggtgcaggtcatccctccatgagaggagtaacataaacattgctttgcattgtcgttttctattttacaatgtgcctaggattttgtctttaattcaggtatggtaatgccaatagatcaggagtcaactaccattgaaaagatagttggggccgggcatggtggctcatgcctgtaatcccagcactttgagaggctgaggcaggcagatcacttgaggtcaggagttcaagaccagcctggccaacatggtgaaacgcgtctctactaaaaaatacaaaaattagtcgggtgtggtggcatgtgcctgtcattccagctactcaggaggctgaggcaggagaatcgcttgagtccaggaggcagacgttgcagtgaaccaagatcgcgcaaagagtttgtcactcatgattcccaagagaggggcatgacacactgagggccacaagagaagatacaggggcagtcaggagggaaaaggggaggggaaagtatggaccagagccaatactgtccttgttgaggcagtaaatgatcaaggtagggtagaaaagctgagtgggagtaggattgggtagtttgaataatttcagcagactctgggacatgagggtcatccctagttttctggtaccctgccctggggcgatttagggcaggaggagaatgccctgtactgcaggagactgatgaaggaaagtggatgtgggtatgtatttagaactggttggcttgcatattaaagttgtgctcataggaaacttgttagccatctctaggaaattagctaattagcagtcccccacccccaggttcataagtctccaaatatgtcaaagcatcataaaatacagaaagtagaaaatattattaatacagctccattctctttagagatatccatcatagccatgtcaagagctggaagggcaggcttaaagcatgttgcctgcaaacaaagctggcagaaatcagcatgtattcaggtcagctggtttgtattcatccgcagcttgttatagctcctttaaggatgccaattcctctcaggggctgttttctttccacaaatgcattagttaactgatggcaaagcccatcacaagtactgatgaaaagtgaaacctgtgagaatagtgtttccacgtcaggaacagtaggcatagaagacctcacaaacaaaacagcaagaagcctcaaaaggtgttcctgtacatcaggagccccaagcacaatacccagatgatataagttctttgcaaggaattctctactccagtcaatcagttcacaaagctgagtcatttgcccttgagttgagagctgtggttcactggtcacatattgctttggggcagtcatcattcccagatacaacccaagcggtagaggcagctcaggcaggactaggtggccactctgggaggaaggactgcagcaatttagcaaagggattcaaacatttttgaagagtggataagctgatttgcaagggaaccgaggcaataatcaagattgtgtggcactggcaaaaagataaacctgtagatcagttgaatagaattacagttcattgactttgacaacagtgcccaaaatcaatcaatggggaaaaaatagtgttcaccaaatggttctggaaaaactgaatagacacatgcaaaagaataaatttggacccccttgctcatactgtttgtaaagattaactcaaaatataccatagccctaaatatgagagcaccccaaaagcacaggcaacaacagcaacatatataaattggactacattaaaatttaaaaatttaaaaaatttaaaaatttcttgataccatcaagaaaatgaaaagacaatccagagaatgggaaaaaaagtattcgaaaactcatatatctgacaatgaacttgtatttacccacactatgtaaagaactcttacagctctataataaaaagacaaataatccaattaaaaaatgagtgtagaacctgaacagacatttcgacaaagtagatacacaaatggccaataaacacataaaaagatgttcagcatcattagtcattagaaaaacgcaactcagaaacacaatgaaataccaatccaccctcactagagagattataatcaaagaaacagacaacaacgtgtgttaacaaggacgtggagaaactcgacttcccattccttgctgagaatataaaatagtccacctgctttggaaacattttggcagttcctcaaaatgttaaacccagagttaccatatgacctagcatttcaatcccaggtatatacccaagagaaatgaatacatatgtccatacagaagtttgtacatgaatgttcatagcagtgttatccaaaatagcaaaaagtggaaacagcacaaatgtccttaaactgatgagtggataaataaatatggtctgctcatatgatggattattattcgaatcaaataaatgaaaataaaaggaataaaaatactgatacatgttacaacagggatggaccttgaaaacattacactaagtgaaagaagccagtcacaaaagccacatatttatgtaaagtattcagaataggcaagtttataaagacagaaagcatattaaccctaatatctagggctgaagactgtagggaagaaggattatgaggtgaatgttaatgatgataggatttatttttgagttaatgaaagttttccaaacttggattgtggtcatgccatacaactctatgaatatactaaaaaccattggattgtaaacttcaagtgtcgattttatggtatgtcaattatgcgcttataaaactgctaaaaacggtactcagaaaatgcaataaaaattaccttgaagtttgaaaatacaatgatttaaatttatttaaattatatcagattataatacttaaattttatgtagtaatacttatgtttattttaaagttatcaccacttatttaaatatacaatcatgagcctggcagttggttaccaacccaatttctgtgctttgaccaacatcattgaatttggaaggcaatgtaataaaaggtcatgagggccttccacatttttctaccagaaatcatggtgaacctagttaaagatggtctcttatacagttgacaggaaatcctgatctacctggaaaaatctctcactgatattacaagagcatgtcccttcaaaagtagtaattcattgctagagaagggtaacctaccgttttcatagcacacttttttgagaagtccttgataagactcatttctatatgtgagtcaaaatttttccctataagttcacactctcaattatttagtgcccacagtatagggataatgatacagagctcaatagtaaaaatgtatatggtgtctctcctcctgtggctataggcctgacagtgaagaatggaaaattcagataattaagaatcttcacaatgtgtgataacatttaaagccccaaagaatatgaaactagatagagaataaatctgttgataatttctagttttaagtagctatgggtggcacaaactctgtataattgcatataatcctcaagaaaagcctgtacagatacaaatgaaaagacataaactcagagaggcaaagcatgtagtctacggctacacaattaataagcatatatagactgtaaataaaaattcaaaaaatatcacccgcttatgtcaaacacagtaacaaatgttgacaagaatgggtagaaattggaattctcattccttgttgagaatataaaatggtgcctccactttggaaacatgttggcagttcctcaaaatgttagacatagaatcggcatgtgacccagcatttcaatcccagatacacaccctaaagacatgagaacataagcccatacaaaaattataaataaatatatacataggggtgcatatatgtacacatatttaaccagtagtagagtttcaaaataagagcattaattaatgtttcatgccagtttacaaagtttattcagcaaggctcagagatggtcagtggcttgctacgagttaactagctagttcaattagaaccaagactagactccagtgtcagacttttggtgaaaaagtacttagaaatgtatcaagggattcctgtgatataattccttacctttgatgaatactgagatttctgttctaggtcaaggagctgacatcttttgttaactttttttttttctcttcttggtcctgtttcactttaggagtttgaattgtaaattccattataaatattcactgtaatttttccatcttttacaattttccccctttctatccagaagctgattattaagagctaaatgtgcctattcaaatgaactaggaagctaaataattgtacagtggaatccgagccccagttcttttgggaaggtgataatagtctaacctgaccaaccaacttttaaaaaaatccactgagccaatactattcaactgtacttcatttaagtaatgtagatttggaaccagtcaaaactgcctactttacaaaaacacttcttcttaacttactacttccaaattacaaaaagagcacctttcagaatatgtcttcagtaatgagttctgccaatttaaaagtaagaaagtctagcagaatgtgtgaatgccaaaagaagaataatagatgaaattcaagaaatctttaggacttacggtctttagattcagtatttttcatattcttggtacattagctcatgtctttctctttcttgtttctaaactcccaagcaacataatgatgtattgttaaccaatttggtgatatttttacaatcgttagagtactacaggctatattatgtaaaatatttctttgtgccctgttacttcggcctgctttagttttacttcttttcctttatttttaatgactttagtgtttaactctctcaaaagaaacatggtgctagtgaatactgtcaatttcaggccgttaccttcctgggcacaataactggccagaaatgggcccaaactagacccatttaaagtccctttttacttttgagacttttctaaatggagctggcagaacagtttgtttggactatgattctactgaagcatgactctagctgtgtctctccttcaaatgtcatagttacgacagtgaggaccctctggctcctcctctccatttctggatggttttcccattctcctccataaaaccatctggtttggaatcacatattgtcagaccacctgctaccactttgagttgtaggcatctactggccattggctcactcttctcctttccagattttagttcttggcttaatgacttgctttctaacactatacattcattgttcttggtgatttcaatatccacatagataatcttcctaaaacagaccacttggttctctgacttcctctcaagtacacttgttctccccaatttagcatctcccttccatccttatagcctagactgtcattacttataagaacaaacccttcatgatggaaatttcaagcattgcatcctaccatttattgttctaaaatgctcactctaaaacacaatcctcccacctcctcaaaacaaagaactcaccttttcacgatctaatcccctcttctaactgttctcattacccagctgaaattacgtgatcgatattttataatcagtctctcaaccacactttcaactcctttcttctttttcatgctactgcgctagcaaaacccaaacagatcttatctatctttctgctcgccccaccctagcataggtacaggtaaacaatctggacccattggaccccccaagaccaaatgggtccacattaaaacacaccttcctttggccgggcgcggtggctcatgcctgtaatcccagcatttttggaggccggatcatctgaggtcgggagtttgacaccagcctgaacaacatggtgaaaccctttctctactagcaatacaaaaattagctgggcatggtggcacatgcctgtaatcccagctactcgagaggctgaggcaggagaatcaattgaacccagtaggtggaagctgcagtgagccgagatcttaccactgcactccggcctgggcgacagagggagacactgtctcaaaaacaaaacaaaacaaaacaaaacaagcaaaaatacattttcctgaggagtcatttaaagtgcatgaccattaacctcaagttggccctgaatgcagccaggcaatcagctgagcttcccttgcccttttattcttctcccctcaaacctacaatacatcctcattctgttcactgttatctgatgactttgcattctatttctctgaaaaatatggaaacaaggtgcattaatcagggttctccagagaatcagaatcaaatatatgtgtatgtggaaggatggatagatagatagatagatagataatagaaacagacagaattaaggcaagagttgatactgcagtctcaaatccaaaatgtgcaggttggaactcaggcaaggtttctgtgttgccgtcttagagcactattgcttctcctttgggaaacctcatttttgctcttagggccttcaactaattggatgaggctcacccacattacaaagaggaatctgccttactcagtctattgatttaaatgttaatcacatctaaaaaaatcacagcaacccctagtgttttaccaaacagccaggcagtgtagcctagccaagctgatgtgcaaaattaaccatcatacaatgagaagaaggatttctcaagttcccaccatcacttctactcccacggacgacagtgcccaaatcctctctctttccttatgttgctgtgcgtcaggcttctcagcctcagcactatctgtgttgggaggatccttctcattgtggggaagctgtactctgccttgcaggaagtttagtagcctgtctggcctctatccactagatttcagtagcacccccacttgtgacaactaaaatatgtctccagacattgccaaatgttctaacaaacttcccccagttttaaataaactctctgtgctcctagagtcaggccctcaagttgagcatgagattccaccttctctcaggttgttgctccagcaattctcttctcacttcatgctatccccaatttcatcagttttcccctctttgttggatcattcccactatatacaaatatgctttgttctttccccaaaatatctcatagcccactttactttttatctatcccgtaatttcttttgttctgtttgtagtaaaattccttgcaaatgtttgtacttattaccaattatgttgttctttctcaaattcacttcagagttttcccttgctactccaacaaagcagctctcatcaatgtcaccaatgaccctcacgttgctaaatccaatagttcttctctcacttgtcttatgtgcaatatttgacagtcgatcactttctcccccttgacataatgataaaatgagatcttcctcactgtcttgaccacataaattttgagttccaagataatcagaccttgaacctcttgtctatcacactcactcatttgataatcttatctagtcccttagcatttaatgtcacttacatgctgatgaaacctcaatttatatcttcagcccaagctgctcccatgaactccagactcatacgcccttgcccttagttgtgggactttgcagttccttcgtctggtgacagccccttgatttggggtttgatcacatgactttcgttagctgatgagatgtgatgggaagtcgcagggtgccagttctaagcctaggccttaagaaaaattgacgctcctgtcttccaaattcccatagtggttttacattccatgaagacattctccagttatcctgcttgtccaaagatggtaaaagagacattggagtaactaggacctaaccagcagcttagagttatgaactgtgagctcagccgcactcagccgaaaccaagcagctcagtcaagagcgaatcatggcttttctctgcagtcactcagttttggaatcagtttttgggatgccggaatgctgtgttacgtggcattattatggcaattgtaaatgcaccacaactcctaattttcctcctgcacctgttttgccctcaatgatcctcaattctgtggataataattccagccttctaatttctcaggccaaaacatattagagttattcctgacatcactcttcttctcatagctcacatccaaaccattatacgatcttaccttttgtacctttaaaatatttctaccatactcccatttctcggattctccgtggagacgaaagtgaccccaccttggatgctagtctgccacagtcctgtgaatgcctcctgattcctactttacttactctcccttgtgtaagaacatgccaaccttgatgatgttattgcacaaattacaggctgtgacacacctggcattcttgcctgttctgcagggctgcacttagttgtccatacagaggacatacaccctctctctatggtatacaagccctgggtctggggtttaacagtgtggaaatctacctgacctgctactgcccaagaccatgctgctgttcataagttttccaataaattgccctctaccaacaaaccgagtttatctgcctcgttctttggcttctctgttccttctgtgtttggtggtctttttgcatatatggcccttttatgggacattcattaacccgatgcaagctatcaccatctacaaactggagtgtcacaatgggttgccaaatggattccctgattctatttgccccgttccccatagagttgtttttcaacacagaaacaaattgatcttgctgagtaaaaattatatctatctcctgcccaaaccctccaggatctttctgcctcgctcagagtaaaagctaaggccctaacccaggcacgcaaggcctcattggatctgtggctcccaacatcccttatctctccaatctcatcttctgtccttatctcactcccctgcagccgcacccgccctgcagaagacatgtgcagagcacatgcctggcctgagttcttcatgctgacactgctctctactccaaatagctctataacccgcactcccgctgctctcatgtcctcaccagatgctgccttcatgatgaagctctccgtgtgagtcggctagggctgctgccatcacaaagtaccatgaagcaggtggcttaagctacagaaatatctggtctcattgttctggaggctagaagtccgaagtcaaggtgtcatcgaggttggctccctgtgaggcctgttccaggcccctctccttgtcatgtggatggctgtcttcatgctctcttggggtttgtcctgtatcttcacattgtcttcccttttgtgtccaaatttcccctatttataaggacatcagtcacactggattaaggcccatcctaaggtcctcattttaatttcattacctctgtcaagatcttttctccatccgaggtgctgtgagttgcgatttcaacgtataaattttgaggagaaacaattcaagcccaaacaccttctctaatcatctatgttaaactacatcctcatctgcaccttatgtctaatcatctatgttaaactacatcctgtaaaatgagcatgattccaaaaggtccttttctcctttatactcttctctcactatgaatggaaactgtcaggtgtctcccagaattatgtagatatccttggttttaatttatttacttgacagagagaacttgtagttcagacaatccaaaagaataccaagaaagtaacatataatagccttagaaataccaaaagggagtatttattgctataaatactaaaggctaacactctgcaaatcccagcaccttcaattctgccccgtttgtagacaatagacatagaagggaagcagcttattaacttaaaagggaggaggagctgttaacatcactacaaataatataatattgttaggcagagtataataacaataaatctctagataactttgtggccaatatttgaatgatctttgtatttagagatgacagttactatactgatacacaactatcagtgtgtgcttaccttttatgcaaagaatgaataatattttgtaatatgagcttgaaactatcatcttttgatttgtggctataacattcactgaagatcttagagcaggcgatttaacttcttttttcacctttggcctaaaatattataattccatttaagaacttttggtttttaaagaaaggcatgaagcttatagctcatatcttcctaacactccaaataattaatgaataaacaggtataatgcacaaaggtgtagaacaagctttgcagtatgcaaccttttgccaagaaactagaaaaatgatatttatatctgtatatataaacactaaagcatacaaagaaactcacaaatgtggttattttccatatatatattttatatgctgttttgattttcaaaccatgtcaatacattacctatataaaaaatacaaaacttattattttaccttatcagatataaacaaaacatatagacaagaaaaagagggcttgctttcacctcacttctcctgaagcaaattaacataagaaatgagaatcaaagcttgttcctgtgtattttccaactattgtcttcatttttatgagaataagagtataaaaagagtgatgctattttagccagagtactatgtattgtaaactgaatgtttttagaagagccctttttgtattcactcagaatgaggacttatttttgtccccagctgcttttggaagcatgtgcctataatcggagggctgcagatacccaggcgtctgccaggagtccccggaacaaagccgcagaagctggtgccctctgcttgtttgtgttcatgcttggttctggatgttgcttttcttgaaagaattgacattaagtgcagtgaaataaatccattttgtgtgacattaaatatttttatcggctgtgtaatcatatatataaaatctccattcctgatgaatcctgaaatatgcttataaggatgaccacatttattgtagagcaggaagacagcaatgccagttctataaaagccaagttgaaagaagcaagtttatgcatagtgatctggagtgtccttagtttatttttcatgtacctcactttcatcttggtgaccaatttatctatatttgactaatatatgtatacaaaaataagatctgcataatgcataacacaaacatcaaaactataaaggacattataagtgaggtttcaacttaatgcttcatgatttgttgaccctaaatattgctacagatattagcaaagagatcgtagaataagaattttatttggaataaactactctctatgtaatcggctccaaaacttttaggaaaaaatgagttccaagagaagatgaattgtgaaaatttgttgaatggaaccagtagacacaaaaaattgctaaaaaaaaaaaaaaaaaagtttaagaattaggttttctccatagatgaatgacatttcagtataaaacagtcctcacggaattgctaattaagtaagagttatacaagcaaagactgaattacaatactccacttcagtttatccaccaccttagtgcctaacttgaaattttttcatctattaattcagtgttaacctgattaaaattttaaaataatctgataaaatttaatgaaatggtcatctctctaattttccagaaattcctcatgtctatgcctgtagttctataaaattgtagtctgaaatctggagaagagaaagagagggaataagagtaagttttttttattgtgttatttataacaacaaatggtcttttgagtaccaaatatatagtccttttatgcacagggagacaaaattctagctgtttcagtaaatgctcacttgtagataattcaaacaatggaatattccaataaccattttctttatgtattagcagataatttcacagtgaccttgaatcactgcagcattccaaagtgttctgaattatcagagttacagttatggtcaatttagttttagtgctaagaatatgttattaatatgaactatttgaaattgttacattagactaataatctctatacgttgcttattaatgttagaagttcatagatatccttgctgatcatatgtttgaaatttgctatacttgacatttgaaaataaataataatgataatgctctagagatgttcttttgaagcacaagttttgactctttcagaatgcctttaaaaacctttttatattgaaataaatgatcctgtcatggaggctcctcccctggattctcatgcagcctttttactgcatgttatattgcaatgtttgtcgacatgttcatgcctccactaagacatgaagcatctagagggaagggactgcctgtgcgtgtataatgcatgaacacctgttgcatttaattgcataatatggccatttcccatttcagttttatgggtgcccagacttttattcaacaaacatttattgaactcctgtaatatgattttcagagtgtcaggataagaacaagaaagttaaaagatcaaagatccagagatgtttgttgatctccattcagtgtcatctggtgaatgaagtaactaggccataattacaatgcaagatcaatgctacaggggccgactggaatacagagaatgaagaaccctagtgtgaagaagaggtgatacataaatatcaccctagacattgaactagggttctcatatagtggacagagtggcaaacgcaaagatgtggattcagaagaggtcaatggtgtggactgggaaaagatcagtgggcctggatgacagagtgtatgaggggctgatgggagctgaagcaggaaaaggacacagtgggctttgtgcacctctattcttacactgcaggatgcagatgggaaagcaggagagtcagtgaacggtgtggagtattgactggaagcaaagaggaaatgcagaaaaacaaactttacagctgcttattgaaaacagctaccatttatatagcactagacaatttgctaggctacctgcatatactatttaatgtaatccttgcaatagtcctgtggggagggaccatttccactagtttccatttacaggtgagaaaaataaagctgcatggtgctcagtgacttgcccagctatgaagggagaaaatagtacagtctgttttcaaatccggaggcatatgactccaaagtaaattcatatgatcactgttctatgccttatggccaacgtctgtttccgggaacgtgatcagaggggattacaaaacaaagcaaggtatatgtgccctggccactctcctcaggcgtcttgccattggggccggtggcaagtcagaacgtctgccatggagcagcgagcctcagagtgtgacgattgcagtgagtgtgtgacattgaggtgattaactgtcacacttgttacactaaggcaatttttaaataaaggcacatagtagagagttttccataatctgcacagtttagaattttagcggaacccaaaaaccactaggaacaaaagaaaacgtgactacagtaacaaggcagcctatgcaaatagacccgaggtcaccccgaatatgcacttttgtggtcaactgcctgacatccttgctgttttatgttcactattgtttgaagatccatattattagtttgctctcctttggcctgtgaaattgatcttacgaattttcttttcaatctgtttcagtaggcatcctaatttacattgaaaatatatggccagtgaagaaacagcctggagagatctacactcacatggatcttggtgagtacgaacatgtgtacattgtgtttactaatctttcggcggagggcaaaagggagcccagaagagatggaggcctctcaaccatgacatatttggttatgttttccatcatctgatctgctattgcagtcaaaaagcaaagcattaagtagatgttaaaggcagagatgtatttatttatgcattttctggcagccaaaaagtagagatggattaaatgtgtggtcttagagctggatagctacttgtatctatcatcacatgggtttgattttgtggatgggagtctcaatccacatttaattaaactcccttgctctttcaaatgaaagctcaggaacacataaaaaagtgtttgcttttagtgcagtgcttctgtggcttccagaattggatggatttcatcgcatcctgactgatctatctcaacaggaaaaatttaattgattccatttttgcctgtgccttctcttattttattttagagggatttagaatttgagttgtctgaacgcttttgaaggctcagagctccaatttagtgtgaatttatattgtaaatttgcaaaattctagcaataatatgaatgtgagtaaacaaaatgttgatccaaaacatttgatttcataaaagacatttgcatagtatctaaaaattagtgtcaatattagcgtctttcatgaagctctgaaacttccaatagttaaaagagataaagaatatagagaagattttaataagtaacatttccctcatatccccactacccaatgtaaacccaaatatattatgacctgagtgagatgagattagaaatgtgattgaacacaaataagtggaacatgatatattttataatcaaaatatcataaattctctaatttccatttatacagcattgtccttctgaggatctcaaataattttatatcaattcataagacaaatcaacatattaaaagtagaaattacattgttgttataatatgctctgccttgaaacaagcaaatttgtatatgtcaattaacttttatcataaagaataagtgtagattattactcctatcaattttctctaatactttggtgaaaattaatactttttataaatatatccaaatatctgccttttattgctgtctttcatatctccagtctattagaacaaaatatagtctatttcctgatgattaagaattgtaattataaacgcatatttaaaaataaaaaattgaaataagcagcattcactaaaatttagaaaataagaaaaattaatataatcatgcctgaattattactggtatatgaagaaatcacactaaccaaattttatgatccacatgcgaagaaaattggaatattaggcaaacattttaggtcagagcacacaaactgttttgcgtattatttttgttgctattaatgtgaaaaatacatagtttccaagatgcaaacctttgcagccatatgaatcattcctctgatgtcaactcagcccagagtccatgttagagtcccatcatacatctaattacccaaccagtcagggattttggtttttttttgtttttttgaaacagggtcttgctctgtcgtccagaccgagtgcagtggcacaataatggctcactgcagtctcgaccttcgggctcaagcggtccatcctcccacctcacttcctgagtcgctacgattaaaagtgcatgccaccacacccagctaagttttgtattttttcgtagtgatgggggtctcactaagttgcccagactgatctcaaatgcctgggctcaagcagtcctctctcagtgcagcctctgaaagtgcggggattacagatgtgagccaacacgatcccccaggatttttttttaacaatttttttcaaattagcctagaaatattggaaactaatataatgaatccacaagatacatttatttatttatttaatttatttcgtggttcagccatcctatcaattaagggaaatattgatagggtggctaaaccatgaaataaataaatgtattgtgtggattcattatatacttgccaaaatttttcggtgtaattaattatgcaaatattttgtctagtcttaacaaacattaaaacttgctcaccatacgtgaaacagtttgccagatttggacagcagcaagtcctatgagggcaaagtggccagggcaaaactcgggggatcatctggaagcactgccttcaggacagagcctcatcaagctaagctcataactatgacgtgcagaagacattgccctagtcatggtttgtgcttgggcatcgcatgagacctggcttgccccagggctgttgggttccatcagggaatatttggcctgtgcaaacaggattttgaaggagatttgaatggaaagcgtatttacagaggtatgggcagagctgtgggaacccagggggatactgaagcctcctggtagcagcagaaagccatcaccactcctagactcaaaggatcacagctgtgggagacggatgctgaagagaatctgtggcttttggcagagccccactactggtccattattcagtaggaaaggagtctgggaataaatagtccaatctcattattcttgtgtcctctgacaatctgcctaaatttcccattggttacgcctaatagagaagtctgagaaagggagaccattaatgcaagtcattaaaggtcagcctcccagggcacaaaacaagttggaaaagggtgaagacagaatttggttgaacaaacagatctcaaccagcacaccaggcctgctggaggatggtcaccagggctgtgctaagccatgctggacccaagactaaaggaaatatctgtaatgatgatgctgtcttgcttaaaattttgatattgttgtttatcatagttttttgccattgatcttatttttaagatgtggcattacaatattatttatcctgattactcagtttttttggtaaccccttaaattttgcgctcaagatgaatatctcactccccaaactcgaatctcagcccaggtaattggagtcaatatactgcattttgctttctgatgattacccataattttactgtgtgtttcattatgtgtgtttctttcattaatacattgtgaataactcttttaaaacccaagttctgaaaaactgtgtgcacacctgatgtattttataatatgaagtctggagagcatccctgttttctgaaacaagcaaggttatgtatcctgataaactttctttcccggaaactgctgtgtttggatcctttgtttgtgacctgacccctagagatcagctcatccttgaatgacagctggtaaataaatgaccagcaacattttattctgtggcttctctgccccttgaccctgctagagtcgaagatttatgagggcaaggatagcggtttttgttgttgatgttgttgacctcaccactctagcaatacatactgattaatacaacaaatgaattaatcaacaaccatatcatatgggaaccatggatatcagataacacatctccggctaaaggaaaacaggataaccacctcattaggtgctcctgctaaccttttgtcttcttgtttgtgatgacttagaatcagaacattcaactatggaaaaactgggggatttattacaagtggctggagagccttatgaagctacatacaaatgctagagcattcaatttcttttgcttgggacatatctcctcccagctaatctccattcatccatgggtactatgtactacagaatcaaaaggagagcgtggaggaaatgatgtcatgagcgtctgtgaagctccttacataagtcactacagtaaagttggaattcttgacgctgtcactagaatacaacaatttaacacttgactacataaaattcttaaatatctaaagcactgggattttgaattaaaatacatttattatttagaatgtcacatgctttttattagctgttggtaggtatgttcacagtgaatgagacatgaatcgacgtgagctcaaatgtgaaaactagacatttcaattttggactttgttatttgaaggtatactaaggaaagatctctgacacagcagctgtggacaacagtttacaatgatctaactagctcacattagaatttcccaaatgtgtttctgtgggatgttaataggtgatgtatgagggggtgtgtgtgtgtgtgtgtgtgtgtgtgtgtgtgtgtgcatgcgttgatggtagtgaaggtgattacgtggttgaatacttttgctaagtgctgggctaaacagattctttcaacctactgggagcctaatatgattatttgaatctttaatctttaagaaggatgtgcgacatttgccacaaagtatgtgactacagtacccattttcccatagcatttcacaggattttgaattcccagaaaacattttggaaagtgctggtgtcttcaatagtaatacttttagttctgtattagtttccaattgctgctgcaaaaaaattaccacaacttagatacttgcaaccacacaaattaatttcgctgtagctctggaggtcccaattctgaggtgagttttacacaactaagattgcagtgtccgcaaggccgcgttccttctcgaggctctgcggagcagagacgccctggtcttgccgtttccagctcctcagggctgcccgtgcactctttggccctggcgctccaacttgcaattctgtcataagatctcctttttcctgtaaaatcgtcaaagatgctccaagaatcacgtttgaacaggtctcattcattttaaagtaatctcatgtaatttcaaaagcatgttgagtatccactccggggatgactttcactcatgcgatgtgaggtgttcatcccaatgaaatgcaatctagcccttaaataatgaattatttaattgtagatgtaaaattagttcccaggtatttaaacttcaaagaagaatataaatggcctaaaaacaactcacaaaagtgcttcaggggctgggcgcggcggctcacgcctgtaatcccagcactttgggaggctgaggcgggcggatcacgaggtcaggagttcgagaccaggcgggctaacatggtgaaaccccgtctctactaaaaatacaaaaattagctgggtgtggtggcggctacacaggaggctgaagcaggagaatggcgtgaactcaggaggcagaggttgcagtgagctgagatcatgccattgcactccagcctgggcgacagggtgagacttcgtctcaaaaaaaaaaaaaaaaaaaagtgcttgagggtgcacgccaggggtcaaacaatgggtagtgttctgacctgttaaaatttggagaagcagccagggctgagacaacagtgcaaaatgaatgcccgaaaatatctcagttaaacgcaggaaattggtgtttcacacgtgttcctaggagccaaatgtgagagtaaggtataatacatgtgacagaatgggaatgaagaagtctggaaaagcagactgaggccagatggtattttctcttatgctttgaatgaggtaatttgtcttaacatggttggtagttaatttggttgtttataattttttcaacaaataattatgagcacctaccagtgtctaacctcaccctgggtgtagaggtgatggagagccatcaaaggcttttcaccggggcagtggtaaaatcatgcagagctttagaaagtcaattctggcagcaaattcgaataaatggggggctctgtattagtttgctaggactgctgtagcaaagtgctaccaacgaaggggcttaaacacaggagtttattgtcatagtcctggaggccagaagtccaacgtcaaggtgcgagcagagtcatgctccccctgaaggtgccagggaatgatctgtgctgggcctctctcctggctgcctgcagttccagtggcagcgtaactgcagtcctcacatgctgttctctgtgtgtgtgtgtctctgtggctgtgtccaaattttccctttttagaaggtcatgttttattaagtcatattggatgactgtgcccaccctaacgatttcctcttaactgaccatctgcaaagaccctgctgtggtctgaatgtttatgttccccccaatacctatgtgaaacctaacccccaaggtgatggtattaagaggtgggacctttgggaggtgatgggtcaggaggacttcccccctcatgaattgaatcagtggcccataaaagaggcctgacagcactttttcactccttgtgccatgtgggcacacatagaaggcaccatctatgaggaatgggtccctaccagaaagggaatcttgattttggacttcccagtctccagaactgtgagcaatcaatttctgttcataaaattacccagttttgtttattttgctattttgcatgaatggactaagacagaccctatttgcagataaggtcaaattcataggttctagcagttagtgcttcaacatctctttggggagatataattcaacccgtaacccactggaagtggaggatggaggaagtgggaaatctagttaattttcagtggttttggaagacgtgcctgggcagaagtgaggaacttgcagtgtccttaggaaataacgggagcccaaatgagggcaatggcagcaggatgggaggaggtcctgcgtgccatatcgagcatccacaccacagcactatttatcatgaatctgcttctgaaaacttcagcataagcagtacaacttctcgtttattgctttttgctaagatgaaacagaactaaaaatgtgctgaaaactgtaaactctcccatacatttctcatcatgattctctttctactactgaccagataatgaaaataatcagcactatctacacagcacaaatattttcatttatattaaattggatatgctttttcttttttaaaaatgaccagcattgcattttaaagtgactttttttttcttttttctactgactgtacatttctgactttatgtattggcaactggaagatttcaacattattctatatttgaatcaaatgcatatacttttctttccaaatgtaagcaaattgcgatcatctgggagtgaatgtttttaagaatcatgcaatacttagtcttcaagaaacttgtcacgcagaaaatccttggtgtatgaatttttgcagcccatcttatttaatgaatgttctaagaagacttcaaaaagacaaattaaaatcagttgtccctgacaactgaggaatatcaagagctttttaataaatttatttaagactgaatatgggtcaaaatatttttatacccattcttagaactgacagattgtcacatttgttagtgtgggtgaaaataatattatatttcaaaaatcaatgaaaaataaaagttaaattgaaatgtcacatatggtattataagcaattgtgccactcctgcatattaaaattaaacataagcataggcaaccagcccttggtttctgaaagtcttcacaacttagcctgagaaatacaaaaccattttccctcttgttcccttcaccaacttttgactcagatccctttttctttgcttctgaaactgccccaggtcaccccctaggcagccagccagtctaaaagaatcaaagtagctattttacagggctttgctcattatgatttcagcaaaccctttccatgctcctgtttccctctgacacacttctcagaagagagatattggcttacacttgtgcatttgtgtcctcagaaattactgttcatacataattgccttgtatttagagtgccctgacaagattcttcttgctcttacaattagaagtagtagaatgtattttgccattccaatgccaagaacaaaactcaagtctctcaagattcaagattcatggagagctggcaagccaggaactcttactgcaaaggaaagagatttaaggaggcttagaagagaagttgtaaggaattggaatgctaatatttcttgccaaatcaaactttctggaggtataattactgtaattagaaataggtgacattttccttgagatatttatatacagagctcaaatccaaaggaaaagcactcgttttgtaccatctctcttctcaatatctctctctgtctttctgtcttgtccaattaggaaattcagtggtagctaaaacacaactttgcctactttagaattctgtctgtgtctaagccccagaatacaacttttaataactccaagcctccttgaaaaggtgacaacaagacagctttgacattttgtgcacattcatccttactgctgggaaaaccacaaaacctggagtctgccaatggagcatcaataatctttgtgtcataggtgaagaccagtaaaattagcacttaagacaattcttcctggctttcctaaacaaattcgtgaaaagaagtggattcgtctttctctactcttagctcgtctatttgagtatatactttcttctttgaagacatcgttcgttttcatggatttcttatcaacctctttgtggctgacttccagccctttcattagcatggtctgcacgtgtaaatcatctgactcgtttagctttccagctttgtctctcgcctcccttccttccctcccgcttcacccctgcccctctttgtctaggcacagtggagttcctctgatccccaaaccgatgttccttcacattgctgtgcttactattctaatgtccttttatttctctattttcaaaaaatgcattctacttggtagttttctctctatggaagcttcatctgaagacttctatcttaaaacaaatttttctcttttttttaactccagaaaactttgttctagtatttaccatatttcattgaaatgatacaataattcacacagagtagataataaatatctctttaattaattaatcatgtatattttattctcagcactctctttaccaaattgccagggcattagaaactccctcctctgtaacccatagaagctctacatattgcctttatcacattacctggcagctaatcattggcgttgtttctcctcagataccccagacatcacaaactccttgaggttacagcttgtgttgcactcatctttatattctgaatctaacattgtgactggcacagagcagacacctggtgagtattgaatgagtgactaaactcaaagggcagcacatacagtctccaaggtatgtgttatgactgcattaggctgtttttgtattgctataaagaaatacctgtcactaggtaatgtataaagaaaagagggttaattggttcatggttctgcagacagtacaaggagtgtgatgctaccatctgcttctgtggaggcctcaggaggcttacagtcatggtggaaggtgaaggaggagcagtcatttcacatggcaacagcagaagcaagaggaagatatggacggagccacttttaaacaaccggatctctcgagaacccgttcatgatctggaggacagcaccaagccatgagggatccacccctctggcccacacacctcccccaggccacaccccagcattgaggatgacatttccacatgagatttggaggggtcaggcatccaaaccccatgtcaatgacctttctctcccagtgatgtcagaggacacttatcatttgtgccacgctaacctgtgggtacagcctgattcttattttccctttgtttatttactcattttttttgtttgtgaattttgtctctccactgggccattaattaattcattatattagttagaattctccagagaaacagaaccaacaagagatagatagatgatagatagatatatagatagatagatagatagatagatagatagatagacagatagattgattgatagatagataggaggggttcaatattatgagaaatggtttgcctgattctagaggctgagatattgtgctgcctgaaaaccggagaaccagggaaggtgtggtacaaatcagtccagggctgacagcccaagaagctcagtctgtgacagtgggtgtcccagctccagagaaagagtgtgttcgcccttgctctgccgttttgttctcttagagccctccgtgtactggggggtgcttgcccacattggtgagggtgatctcctttactgagtccactgattcacatgctaccccttctggaaacagcctcacacacacacccagaaagaatgttttaccagctatatgggcatctcttaacccagtcaaggtgatgcataaaattaatgctcacactcacctagatcttacagctcacattttcctagcagagaagaatggattgctatagcaatgagggttcttagagactcaggatgttcgccctgcagaaattacctctaaattaatcccagctggaagtcagagagcctctataaaacatagcctgtgttcagccacattgatttttattatgggaaatatatgaaaattcagcaaaggtgacggagtgccttctgaagagaacccagtggagattcttaccaccattaaaaacaagctcatcatcagttcatcttattggtgtgagatttgcttcacaatcttcaaataatgttacagaagatttcatctgaaactacacattttggggatttttatttaggctttcatttaaaacaccgaacactgaataaaagaatctaagcctattatctatatatctatggcaaagtttcttcactttattgtcaaaagtttacataaagttgaaaccagaaaaaaacatttttttcttaactatctaatattggtgagaaattgagagatacttttttttttttttttggatggagtttttgctgttgttgcccaggctggagtgcaatggcacaatctcggctcactgcaacctccacctcctgggttcaagccattctcctgcctcagcctcctgagtagctgggattacaggcatgcaccaccatgcccggctaattttgtatttttagtagagatggggtttccccatgttggtcaggctggtctcgaactcctgacctcaggtgattcgctcgcctcggcgtcccaaagtgctgagattacaggcatgagccaccgcgcctggccgagagatatctttttaccttgaggtatatttagagttgacctcaacataccactgtactcagttgaacagatataattagatttataattatcttttaaaaagttgttctaatactaacagtttaaataatgtgagtatccaattacttggttttattatcctacatatttaacacttacatccaggaacatgcaggttttcttttatgcttagctttgttttctggggtaacaatgaagaaaataatctctagagaataaaagataagaaaccatgaattatctgaaagacttaaggtttatatcatttggagcctgaacttaaatgatgtgtttgcaggagaaaaacaattctagaagaccattctacttaaatggagcttgtactaaagtgttgaaaagctgcaaaatgttgcttatttttaagtttaaggcagctatacctggaataattaccatgacaacttaaggccaagttcaagagcccgagtgaaaaatagaatcagttctataattgattctctttgaaactactaaattcacagttgcagaattgtaccactttaactatattctttgtctgaattatatgcagattgtacaggttatgtgtttttactgtagctttggtatttcatttctggagaagaaacaaggttgtcagtcaaatatcttaaactatgaaatagtgcatggactcacagagctccgcttcacatgcatagtgtgagatgaacagaaagtggccactggcatgacaagaacatctgctacttaaaactatgtggccataagcaagataattaacctctttaaattttcttttttatctttataaataagaatgtcaatgaattccttatacagatataatgataaaatgagataatatatttaaagggtatagaaaggtgcctagcatatttaaaccatctaaaaatagttttgcttttatgtattgaaaagttcggttgcaccaaagtcactgcaaaagtgactagtcaaaggcaagtaacacaaaacttaagaacaattggattacatgagtaagagatttgtagttctccccctacaaatatggagttggctcaggacagagctcttcaagaatgttttcaaggacctaggctcctcatctctccagtcctaacccttggtcgtgactttcatcctcatgattccaagacagctgctgcacatccaatgccatgtctgcattccaaccacaaagaaggaaaaaggataaaaagccaaatatcttcttcacataggaggttttttctttttaatttggaaaaataaccactttctagctaacttttaattatattctattagtgagaagaaatataccaaattgccatttaacacaaagaggggtaggaggttttaggtcttaactggaaacatagctattcctttctctgtatctgttatctgtctctgtctctacctctctctttctgtgtgtgtgcatgtgtgtgtgttgtgtaaagagagacacacacagagagagagagagaaagaaagagagagagaacaaaagaagaaaggagaaggtatattggatagctaaccagcaatgttagccacggttatatttagacaattcgttttgcagcttataagagggcatgcttgaatataaactcatatgacaagcatagttaaaatactttcattcaattttgcattccatgaagcttcactatatactctagtccagtttagcaaggagtgttagactggggctagaatctggacagcctgtgtctgtctctagtttactgcttagctttgtgcaaattacctaattattctgcatataattttcctctcccattaaatgtggaggtcagatgagaggctaccaatttcagatcttaaatttggtggtttcatgattgttatatttctccctattcttttaaaaaacagtttcatattttcaaaaacttaataattttctggaactattgaactttggttaagacagtcttgcagaggttatgtattgttctcagcactgtgccaggctgcatgtgagacacaaaaccagttaaagacatgcccgccgctctccgtgtatgacactaagcaccttcagtgtggccatgactcactgttggtgccaaggttccaagaagagataagtcagaatgacatgaggaatttaaagatggcttcacagatgaatggaactggaactcaatgccatctcactaacatttgaaaattaaatacaaggtagaatgaaaagatatggttaggtggataaaatatgaaggaacatctcaaacaaagggagatgcaccaacagaaacacagatgagaacgcaggtgctatgatgtggatgtttgtctctccaacccctgcattgaaatctcaccccagtgttggaggtggggcctgatgagaggagtccgggtcatgagggcagatcccgcatgaatagattaatggcccccattgggggtgagttctcacctcagagttcccacaagaactggttgttcaaaagaggctggcacctgtgtccacccacctgccatgtcctctcgccatgtgatctctacgtaccagctccccctcaccttctcctggcaccatggtggacgttccctgaggcctcaccagaagccaggcattgtcagcactgtgcttcttgtccagcctgcagaaccataggccaaataaacccttctttataaattacccacctcagggattcccttagaataccaaattagactcagacagtaagcttgacaagttggggccgaggaaggagcctctcccagttaggtgagaaagcatatgctagtgactgataaaaataaggttgcccgaagacttcgtaaacctgtttcctgcaattcttactctaacacaaatacacagctaggaccaggaggctgcttcaccataagtgtctctaccacttgcacacacagtgcacacaagttgaatcagagcaacttgctgtactggacccaggttcctgtgagcagaaagtacaatacactcctcagtatccatgccatgtatccgactcagtgtcactcagtgttgctaatactgtatccggacttagccaactcctggatccagagctggccaaaataagcaaaacaaacaaacaaaaacctacctgaatgcctttgttgcaccttcagttgtgaactaatcagtcataaatcccaacccaactctttctatctcttgcctataactgttcctgtcacttatgcattggtatcacaaatgggagagacctggtgttaattcattgagtaatgagaagccactatggatacttgaagcagaaaggaactgttttacgaagttctgttcctcggcagcatttgaaataaaaaataatgtagtcatctcactaggcagatgagataaaggattgctgtgtctattatcttggagaaagaccataaagacctagattgaggtggtagactttcaagtgagggtgaaaataaatgggatttgagctacagattggaaacacagaatggattggaacagagagtgtgcaactgtctttatttcagatttctatttgcccagtgtttgtccatttttcacctggggaacaggacccagaggtgccagaagtgacattcaagctgagggagggcaccaagtctatatgactgggaggaagtcaaaggtaactctttgtcgtggcagctcatctgacataaatgcaagtatcaagtggggcttttggctagtgctgagatttagctttttcaactgcctaaaatttagatcatggcaaaaacattttagtagggatatattttaggtagttatgcttaaaaataagaaaatggggacatgggagaggttggtcaaaggatacatcattacggttaggaagaatgaactcaaaagacctagtgtatagcaaggttatgataattaatgacaatttattgtattcttgaaaaatgcaaagagagtagggttaaatgctctcgccacaaaataactatgtgagataacgcagttgttaattagctagatttaaccgttcaaaatatatggtaaacaataaatagctacaatgttatctgtcaaattaaaaaaatttaaaagtaaaataaataaggaaacaggcaaacaaaacttttaaaagtctgcattttaatattctagcagtgttttaatctattttatcttatctatagattttgtttctctctatataaagactataaagatatccgaaaaataatctctctgatatctttatagtctcctcaatttacaaactattcgattttaaaaataattgaccatatatatccatattatgttggtatgtgtgtcaaccataatcgtacttttttttttttttttttttttttttttttttttttttcagacggagtctcgctctgtcacccaggctggagtgcagtggcacgatctcggctcactgcaagctctgcctcccaagttcactccattctcctgcctcagcctcccgagtagctgggactacaggcgcccgccaccaggcccggctaattttatgtatttttaggagagacggggtttcaacgtgttagccaggatggtctcaatcccctgacttcatgatccacctgcctcagcctcccaaagtgctgggattacaggcgtgagccaccacgcccggccaaatcttactttttgtaactaatttaatagaggaggaggaaagaaaagtatatgaaagtaccttcaaataatggagtgataattttagttcaagttcaatagttaacatacacttaagatatttttaaagaaacatcacattgtaatcaccagagccttttaagcactggctaattgagaaatatactaagtctccaaaaatacattttttgtgtgactttgacatgatgctgtggtttctctttgtctagaatcactttacctgtgaatcctgtaggctcacatgccactagccaaatcaaacttaacagctcctgggaaatctttaaagattatttcatcaatttgcttgctacatatgtggccttagttaatgttgtaagtgctttttttcccatttcagatgatttttttccttcattgtatttgaaaaaattaactttcctatttaaaaggcaaagtcaacatacagttcattctgagagtatttcttaacatgtttgggtcaaatcttctttgtagatactggtagaactcacagagactccggtaagatgacacatttcccagtacaatttcaggggggttcataaccccaaagccactctatgaaatggaacaggagacacttccagactgtatgattaattagtaatttgtcagatgtaaagatttttattgaaggagggcttgcaattggaataaacataaattatttcccagaactgggagcacgtgtcctgaggaggatgacttgtttgctctgtggaggtgaaagcgatagcctgagccacagcctcgctgagccattgttgctgacgggtaaatgctggaacccttatataccagagggaaccactaccctgcagtctcagttgtgcttctctgtcttcctggatgaccacaaccccaggcaatttaggcccacattatccattcctctttctaccttctcccatccttcatgtaacaaatatttattgtgtctaccacagatcaaacatttgagaaaaatcaaaacagaaaactcctcgatctacagaacttacattccagtgggggatgatagaaaacagaaaataatcatattagaaagtgattaacactgtgaaaaaaagtgagagttagcaaaaacactccctccatccacagtgtggtgggctctctatccactttgacccacatttggtggtggaagtggctctgtgctggtttttggtcccaggactgcaggcctggctgttccctgtccctgagccatgctgttggaagtctgggtgtttgaatggagagtccatgggaaggtcctgagacagaagcaggggaagagggacccaggcctgcaaggccccagccatccctgccaaggtgctgggccctccagataccccagccacgagctggagacccctacagtcattacatggagcagaagatcacccaggcatgccctgccctagagtctgaccgacagatcacaaacaaaataaagtggttattggttgaagccattaaatgtggtgtggtttgctagtcagcagcagataactggaagcttggtggttgtctccacaaaaacaaaacaaaaacccaaactacattatttcaggcacgaccgcagtggccctgtcagttcttcactgcaccctggctgtcggctgtctccgtctctcatttcctacggccctgttcttccggacctttcccactcaattcaaacccaaaccacatccttcgcttttcttacaatcatcacaagacctcgtcttgcattaaaaacaagtatcaaaaatatcctaaatgaatggtgaatacaagtttgagagcctcaaatctttcactataatctcctcctcttttttctctttcttctcttagaagaaaagctgacactaattttcaaggctaatcctcccacttcacttgtaatatcaatccctttgttctcttctacttacccctggtaattattttcaacccgttcctccatcctcctaccttacctatgccaacaagagacctgttctcagttctcatccaacttcacagtggcaacattctttttgaaatactttcttccctggctttctaaaacactgacttttaaaccatccttcacaatgctgcaataatggtcttcctaaaacaagcattatactatgaagttttctccctcagaaactgtcaatggctccctgtagctttctaagtaaagaccacggtcctttcaccgtagtcttagctctccataaataatctcacacagctctttctattttgcaggcctttattcagttgcatgtttcagacaactctgctttccttcaagttacatcttcattctgaaaaccttttcctctcctcctgaatccaacccattcttcaaggctctgctgaggtccacttctccaactcaggcttcaaccaacacattatacactcacccttcttccaatggcattgaacacctgcccctgcattcctgtttagcattccttttctgtgctttgttaaatattctctatcatcttctctttttttttttttcatttagtaatctgcttaacatttttaaggcatatgggataagagacactgggacccatgctaagaaaacagaggcaatagactctgtccatcctcaagaggcacacactctaacataaagacagtcacttgcaataggtttcttttaaaccctcatagaagtaacagttcagtgggagttttgaagaataagtgctcaagactatgtaggaaactcagagacggcttctagaaggaggctatagttgagtctttaaaaaacacatagaaggccgggcccggtggctcatgcctgtaatcccagcactttgggaggccgaggtgggcggatcacgaggtcaggagatcaagaccatcccggccaacataatgaaaccccgtctctactaaatatacaaaaattagccaggcgtggtggcaggcgcctgtaatcccagctactcagtaggctgaggcaggagaattgcttgaacccaggaggtggaagttgcagtgagccaagatcgcaccattgcactacagcctgggtgacagagcgagactccatcaaaaaaaaaacaaaaaaaaaccacataggtagtcaagataaatgaggagggcattctagatgaaaggggtaacagagatgaaaaacactgtgaaatgctgcagaaagtttgggcagcctgctggtgtgggagtgctggatgccaggcaggagaaaggggaggtgaagtggggaggcagcaggaccagatggactatagatgatctcacttgccaggacaaagagcttgacttgtcacaggggaaattgagggtgcagggaggactttcagaggtatagatgggctatgacatgattggataagagatcattctggcaactctggtttctacgtctgccttccccccatctccctgccaccaccacacacacaaattagggcttttaagtgagaaggaactgttaattttacatttgttcctctcctagaagttcatgcaacctcccacatacaataggtacttaataatgtttttattttatgaataaagaggttgaaagttactatgtttaagtggtctcttcactaaatgtgttattatcattattaatcttgcagcaaagggaggagaatagtatttggagaaaggtgcctatgactacatgttctcccactgaccttgcatgggagaaactgggtgctctggcacaattctgctcattgatccaggctgtggggtcctgaggcaagactgtggcccattacacagcctttgagatggcaatgccctttaggaggcaggatttctgcacaccttttcctatgccttctgcttttacacaaggagaaactgatgagtttgcagtggtaaccaccctgttcctaagtgtgatgcctccaaactggtctgagacgtgagggtgaagtcctgtaaagtcctttgttgctgttttttattctcttatctatatgtaagttcaacatctcttgttataaacgcttcaagtgcattaaccctgactaggactcttgttggagagtaacctatatctcttctttgtcataactaagatcagaacctgagatgccttttgggaggaatcctaagacttcctaaatcagatacttttaagtctgctgaaagagatgaaagaggcacaggaactgccctgagagccgactcatccttcacagaaccgttgataggaaagagacctccaaggtcaaagctgcagaaagtgtgttaggaattgcaccttcgagtggtctttgctgagtgttgaatttttcctactttcttctcacccattttatctctgtgtgtaagtgctgctgaaaggcaaaacatgatgcttgaacagggaaggggagtttcccaaataggaggcatatggcctaaattcaggtgcagaccgtgtacatttcagccaagtgtatgacagtgggatcaataaccatggcatgcactagaggtgcaagacccagaggatctcaaattgttccccaaagctcagctctccaaagtcgtggcttacaataggcgactttgtgtgggtgaaactgtaagagcatctctgcacaaggcctttgtggctgcacttttctgcttgctgttccttcccagtatgtatctgctttacgggcaatccccttacttcctcctgttaactcctgggcaaaaattacttctgcgagagttttagaattcagatagggtctgaagagcaagctctgtcgtttatcttacctaacaaaattgtcagcaagagagaagtgcaaccttttcttgatacagctctctcatttggattgtaaaatcttatgttgagggagtgatgaatgggggagaaagaaacataacttctttcagatgtaaagaatgctgactgcttcaaaaacattgctttacctgattttcttggcaaatgcgatttgaaagcaaagcaaggagtagaaaatatgcaggtgtcactttggtagtcacttttgtaggcagagccatcgtgattatgtggtgataccaagtacaggactctgatcagctgcaggtagcacgaaagcctcacctggatataaaattccccagcaagggtggtgagtgtcccggggacatttcataaaaggaagatacatgtgtttctttgcttattgcttgttagtaagtgttgcaaggtgagaggagttagactctggcccttttgagctgtgggccactggtaaatggctgatgccctctgagctcccttttgtctaaataagatatacaataaaatctatgctcaatgggaaaaggtatgctaagccaccactccattactcggtatctggtaatgggaagctatgattactatttcataagctcttttcttcacatgctaaataacaccagcacacactgaaagtacacagaccgctcttttatttagagaagctcaaaattctttgtataattaatcgtatctttctaggaacgatcaaataaacatgacattctcggttgtttccatagtcatttttttaaatcttctaccagctaagtacgtcaataatttaccgtcattttacttcagattcattcatttattcaacaaatatttattgagcacgtgccaatggagcacgtgctagtgccaggccctgttcacagtcaggaaacccaagcccatgcttttgcggagcttatgttctgctgcatgtggacatggggatggagggagtctaacagtctacgagtaggaaatacgtagtaagtctcacagcggtaagagccatgggaaacagggcagggcaaggatagagcaagcacagaggcagggctgggactgtttatacagggtggtcaggaaaggcctctccagcaaggtgctaaatgcaattcaagcagagacgacgtaaaggaagcttaattattttaagaacattataagctaccttgcagggctggagataagggaacgtttcaacttgcaatctggcgtctggtgtcaaaagctggcctgaaaacatcagccatttctgtgcttttctctgtttctcaggccccggcttcactgtgtgccaacagccaacagcacacagcccttcggggctgaaactctgcactgtctgtgagtcatggtggatagaattccaagggtctatatttgtcttgggtaaaataaactgtcttttctaaatatatgccttaccacttcccattagccaaattccccaacacatatttctgctgggaaagctgaacgcaaactattttgctcatgtacagtgcagccagcttccctgtggctctcagaggagacacaaagctaagaatcgaaaacgaacatatctgatgacagaacaaaggtttaaaagaccttgctatgctggaattataacaaaatcaacatcatgaaattaggaaagatatggagagggtgcagcatttagattttcgaatggcacaggtctggaatgaatccttaatgaatatcaagttgtctgaaataagcagagatcttccattgtgtaaaaacctaatatgtcagttacttggtgatcatatcttgctctacctcaattacagtgctgagacaatatcacaatttattgagagagtatttttattttgttaggttgtaggcttcttgaagtaaagactgtcttacctttgtatccaagaacaattcctagctaagaatatttcgatccatttattcattgaatatagtaaaaacatcttattttgataaagaagtatattatacacataagatgagacatgtctgcaatgcttaggtacacttgcagtattgtgtccacatttggttacatattgaagtgtgtgctttggaatatggccagagagagctgaaggctttaaacgaatatcacataagaaattattgcatgaaatgaagtgtttctaatctaatggaaaagaagcttttggcagaaatgatagctgtcttcaaatacatgaaaagttttcacacggaaaaacaagttgatgtgttctgcgtagctctggaaaaacgaccagggccaacggattgaaggcagatttcatctcagcctgaataatccaaaattaaatgagctgcctccagaataaggagatgcttccctctccagtgatgagactcccatttctggaagtgttcaggtagaatctggactggcatctctccggaagtcctgccttaggtgggatgctagaattaaggggccctaatgctctccctaactgtgatgagctaattataacattactcaggtaagcaattccttcagaaacaattacatcttacagagaagagttatcacttttcaggccattatttttagatttttttccttgcaaacttcgtttatttttgacctaaccataccattccactgagcaatattcatgcttggggttttgatgctgattttagacaatgtggttgtaaactgcatgcatttctaggtggtactagaggctagtatgtcaccctgctcaaaatttcccaagacacttggtgtcacattgctatcctcagcatgccaagagacgggttctgtgaattcatgcactgtctaaagcttctttgtcacagattataacctctaataagagaatagtgtctttttggcacttgtgagtaccttgttgctcaagagtagattacccattcatttgttcaacaaatgattcacttaataacatttattgagctcaagtgcatgtgttctaaggatacaatgccaagatgtccctgcctccagcaatttccagcttagtagggaaaacagacctaagtccagacctttaggacacactgtaacatccgctgtaacagtgtttacacaagaccgaacactagcaaaaagaacagagctgcagattctgggtagattcaaaacaatgccatggaggaaaccttgaaatgagtctcaaaagataagtcaggtattttttcgtgtacacaaggtcatttcagcaaagagagaaagtgatattgtcatggagaagtattagcatagaatttgcattggctgttcaggcaacactaagtagcctcatgggtcagttgtgaagcttgggtggtaatctgcggaaatattgtcgagaaggaagcagggaatgaatcatacagtggatagactgaaagtaacaatacgaggcaggaaaactactctgcagattatttcaactgtccacatgaggtaatgacctaatgcatcggaagtgggttttaaaaggagcagagagagtaaaggatatatgtttaaaaggtaaaattgggaggccaaggtgggtggatcacgaggtcaggaaatcgagaccatcctggctaagaccatcctggctaacacggtgaaacctcgtctctactaaaaatacaaaaaattagccgggcgtcgtggtcggcgcctgtagtctcagctactcgggaggctgaggcaggagaatggcgtgaacccgggaggcagagcttgcagagagccgagatcgcgccaccgcactccagcctgggcgacagagcgagactccgtctcaaaaaatacataaaaaaaaatttttttaattaaaaaattgaaaggtaaaattcacaggacgcattgagaaactaccaggtgctatactagcattgaacaagtaaaggtgaatatgcacaacacttcctcaagcaatgaagatgttcttggtggagacaacaaggcttcggcaccagagagtgctccgttcaaatctctgcttttccatttggaaaatctttgtttcagtttccttaatctgctgcattgagactctttcctcactttctctgtctggaaaatcacatgcccctgtcatggttacgtcttcagtggaccctttcctccaaaagcctcttccctcaaaagaaaagtcctgcctattaaggcaaattaatatggaggctaggcctgaacaacccttgagcagacatagccagtgaggcctcatcagtgaccctaaccctgcttgatcggcaaacagaagtgaaagttaacttgagctatttcttgtaaacgcctatattaaataaaaacggaattcaagcccaatcaatatgaagcagccaactaacttataattatagaagcagggactttccaataaaatagaccacataaggaaaactgtataactgcaaacaatcaattttttttcctttattctgtgctcatcctaacccagttgtggtttggagcttcctgattcattaattgctgtttgctcaaataaattctccaaaatgttcttgtgtgctgtttacttttttttttttcttttctttttttttttttttttttttttttttgagacggagtttcactcttgttgcccaggctggagtgcagtggtgaagtcacggctcattgcaacctccacttcctgagttcaagcgattctcctgcctcggcctcccaagtagctgggattacaggcacccgccaccatgctcagctaatttttttgtatttttagtagagacaggatttcaccatgtcagccaaactggtcttgaactcctgatctcagttgttccaccctcctcggcctccaaaagtgccgagattacaggcgtggcgtgagccaccatgccgggcctccgttttacttttaatatgcctaaaggatggcataaaacttaactgaggcaatgaaaaacatgcaaataatagagatgtgggccagagtaagtactcaaaaaaataaagactaatgaggcatcttttattttcttttttaaagatagcatttttaatagaagatgaacatgggcatttttctgaatacataacaatgtatgtttatttcttttcacatgttagtcccatcaaaataattattactttatatgctaggatatgtaccagaacattaatttttgtaggtttcaagttattttttggactactttatcagtattctctagaagaagaaaaaaggaagaacaaaactcaaagagaattaaaaaaagaaaggataaataataccaaagtcagtgtatatttgatttctaaccttattgtatttatatttcaatgaattctaaaatgcttctcacatatttctctttcaatgctgttttttcttcttttactgccatgagtaccttgattcttcaaatgactttataaaaatggctatattaattaagaatatgcataaagatgtcttagatatatccctccattctggaatttacagttgtttggaagaaatgttggctacaactaatcatacagaaaaattttacttcattatataagcaaagacaacgtggtttgttattagttttaaggatcttaaatcagtattactccaaatcttgtccatcttgagctaccttgctcatctgcatttgctttgggatgctttaaaaccagcatgtccaggtaacctgacttagcatccaggaatgcagaggcaataggaaagagaacacattggctaggcacactcttatctagctcctggcctttggtccttctgattgtgagttgtgttggtagaaaggtctaaacaaatgcccagaatacttattcatattaatagtaaagaaatgaatcagcacgatcaattttcattctgttatttcatctcagtaatatagagaaatacattctaatgcagaaaaataaggttttctagtgccatcttctcttccaatgacggagctattgaagttaattctctaacaaaagacagaagcagcagcagcagaaaaaatgaaatatcatttttttttttttgctcgtttcaaattaaagaactcagaatgtttacttatgctggataaaatatacccaaatgttaccttcactaatcaggagcttaattctgtgtttaaagatcaccccagctgcaaattcatctgaggagctgaagcagggagattttaaaaatctaattatttttataattattttcaccaaatgctttatacctctatttggtggctggttcctgagaactccatatgaagtcaggtcagctttgttcacatacacccttctccatggactagccacctaatccaccctctgattaacggagaggcagaatgttcgcaatgtgtaaccagatatgctggtacatcaatgactactgtacacccaagcattgggaactcagtcttaaaaaaatctactgcccccttattagttttctccttagtgaaatagtcttccctacattggaatatgagcagaatatatcccactgagaaatgagtttgaatataatgggagactggctctgtccaatgcccagaccctattcttcaacctgacaggtgaaaattcttatcttgggttgtggaggaaaaacgaagcagggggaagggcaaaaactgggtggcgaaatgggggcagccagggcagaggaagcatgaaggctgagtcagtccccacttcctagtcttctccagacccacgctctccaggttgggttgtcacgatgatggactgggactgacaaccagcatctccactgctgccgtgggagtcacagtgagcacaagacccagagtgtgcagaagtttttaaatgcaagtggacaaccataaccagggggagtcacctgttgcccaggttggacgggagagtggaccatgctatcaggtgactccatattttattcaaatgaagtttttggatctccttattgcataatgtataagggagagcaggggggctactagttgttttatattaacagttgctttagtctttgggaaaatagcaataatattctattgctggagcatataatcaactgcttccatagattcaccttaggaatttttcacccctgatagaattacttgacattatgccattaagtcataatgagcactgttatgcaatcctttaatcgttttaacacatttattacaggggtgttctggatgatatttaccatattacttagagtcttgtttgtgggtacctcttaaattttaatttgcaaaagaaaaaaaaatcacctaggaatccaattaaagtgtacattctgatttagttggtctggatggggcccaagattctgcattgatagcaaattctcagtgacgctgatattgctgtcctgtgctacactttgtacctggctttatagatatcccatcgtagaaacttactctcggaaaagctctgaatgttgaacaagtggtttgtttttattatgcagtactgtgaattgcattgagttgggccatatgaaatcaccaatttttgatcatatttgacatatattgggcaatttctcatgaattgcattgagttgggccatatgaaatcaccaatttttgatcatgtttgacatatattgggcaatttctcatactgtagatatagcatgacaatagcatagtatgctaattcaatgtttctctttgagttgatagctatggagcttgtaaccaaaggagtgacccacctaaagcgaagtgtacggaaccatttacctggggcatagtttaagttttaaaatttataaaacctttccctcttttataagtgagaaatctttagttgcaagtaatagaaatctatattcactagctgaagaaaaaaaaatgtagacttaagtatttaggaattgcaggtttagaccgtctcctgttggcacaggtggatatagggacctcaatggtgacatcaggcttcaggcttcagcttatctgcccaatctctagttttgtttgcttctatgatgaattcacttttagcagcttctttctccacctagattgttccttgtagctcctggattacaggccatcttcttagcaactccaacagataacaaatttccccttccaggaattggattttattagacttgctttggccagagaaatggaaagctcaggttagtaatcttggctcccatgccccctggacctgggtcaactctgtcagatgtatattggctcagagttggcaagggattattctcctagagaaaactgggtagctattcccagaaaaaggaagagtgttcagagttgttcccaggatgccttttcttgcaggaccgttatccatgcccagcccactgctgtcagcattgacctgtgagttgctctgacagatggtatgtgagcagaagatgtgtgtcacttctagaggaagtttaaaaacccgaatgtgcttctctgtgctcccctagcccattgcaatgtcccaggtaagggcagcttcttcagcctgggtccaacacatatggatacatcttgtgggtaagaaataagcctctgctgctgtaagccactgcttccaggacttgcttgttattaaagtaattcttagcctaacctgactgataaaataggcagaaacaacagttgttcatattattccactcatctcattccaacatgaaaaccaattcttctttgccaatataaggatttcaaaaacaccccaactgcatttaatttatacattaattacaatctaaaatccactcacttcctcctcaaataagaaaattataaaagtctgttcacttactgtccaattactgcctaagatctaagttcaggatcttttggtgatgggaatttatctaggtcaagtccagattagcttctactggtggagatacctatggttgaatggggtatttaaatatatttaagtaacatatttaatcacctcccaatacatataagattcagtagtggaaatcaaaaggactaattataaaactaaacaaggtaaaattcttttttgttgaaaaggaggcaaggaaaacagcagaattgtatggttaagtgttcatggcaagttagcactgcagccctctggcagagtgagctccttggttagccagcccatctttcctgactcctctctctgtgaggatcttctttatttattgacctcccatgtcacatctgagatgacattggagaggcctccctatctgggttgcccacattagctggtatcaggctctatccaggcccccactagaactagaattttcaattaaagcttcagatgaggagaccaaagttacccatcccttatttttagggtgcatcttagtcttggctttttacaataaagacctttcccaggaggtgttcatggtgagctgaagtatccgcccctcctgaggtctcctcttggcttcccccatattcccttccttactgctttgctgaactcagcccagtgactgagcccagcgcagagaacccagctttgcatcctccaatactccagtctctcagtgctcacaagtttcctgccccaggccagaaaaggaacccttaaagacaaaatgaaacgaggccgagtgcggtggctcatgtctgtaatcccagcactttgggaggctgaggcaggcagatcaccggaggtcaggagttcaagaccagcctggctaacatggcaaaaccccatctctactaaaaatacaaaaattagccaggcatggtggcacacacctgtagtcccagctactcaggaggctgaggcaggagaatctcttgaagctgggaggtggaggttgcagtgagccaagatcgcaccactgcattccagcctgggtgacagagtgagactccaactcaaataataatttttaaaaagacaaaatgaaacctatttttgcttttttttttttttttggctttatgttttaacatgatccagttttaactaaagtgaagcttgtctctttttatcaaacctttgagaattagtcaatatattccaaaatcctgtgaattttctaccatgttaccaatctctagcctaggaatgtgtatgatatggtttggctgtgtccccgaccaaatctcatcttgagttgtaactcccataattcccatgtatcatgggaggaacccggtgggaggtgattgaatcatgggggctggtctttcctgtgctgttctcatgatagtgaataagtctcacaagatctgatagctttaaaaacgggagttttccagcacaagctctctctttgcctgctgccttccatgtaagatgtgacttgctccttcttcccttccaccatgattgggaggcttccccagccgcatggaactgtaagtccaattaaacctctttcttttgtaaattgcccagtctcaagtatgccttaatcagcagggtgaaaacagactaatacagtaaactggtacctgaagagttgggtgctgctgaaaagatacctgaaaatgtggaagcaactttggaactgggtaacaggcacaggttggaacagtttggagggctcagaagaagacagaaaatgtgggaaactttggaacttcctggagacttgttgaatggctttgactaaaagcctgttagtgatatgaacaataaggtccaggctgagatggtctcagatggaaattaggaacttgttggaaactggagcaaaggtaactcttgttatgttttagcaaagagactggcagcattttgcccctgccctagagatgtgtggaactttgaacttgagagagataatttggggtatccggtggaagaaatttctaagcagcaaagcattcaagaggtgacttgggtgctgttaaaaaggcttttagttttataagggaagcacagcataaagtttagaaaatttgcagcctgacaatgtgatagaaaagaaaaacccattttctgaggagaaatttaagctggctgcagaaatttgcataagtaacaaggagccgaatgttaatccccaaaacaatggggaaaacgtttccagggcatgtaagaggtcttcacagcagcccctcccatcacaggcccgaggaccaaggagaaaatggttttgtggtccaggccctgggtccctgtgctgtgtgcagtctaggtacttggtgccctgtgtcccggctgctccagccatgactaaaaggggccaaggtacagctcaggctgttgcttcagagggtggaagctgcaagccttggcagcttccacatggtgttgagcctgcgggttcacagaagtcaggaattgaggtttgggaaccttcacctagattccagaagatgtacagaaatgcctggatgtccaggcagaagtttgcttcaggggtggggctctcatggaaaacctctgctagggcagtgcagaagggaaatgtggggccagagcccccacacagagtccctactggggcactgcctagtgaagctgtgagaagagggccagcatcctccagaccccagaatggtagatccactgacagtttgcaccatgcacctggaaaagtcacagacgctcaacaccagatggtgaaagcagccaggaggagggctgtacctgcagagccacaggggcggagctgcccaagatcatgggaacccacctcttatatcattgtgacctggatatgagacatggagtcaaaggagatcattacagagctttaagatttgactgccccactggatttctgacttgcagaggcctgaagctcctttgtttgggccaatttctcccctttggaatggctgtatttacccaataccagtacccccattgtatctaggaagtaactaacttgcttttgattttacaggctcataggtggaagggacttgccttgtctcagatgagactttggattgtggacttttgagttaatgctgaaatgagttaagactttgagggactattgggaaggcatgattggttttgaaatgtgaggacatgagatttgggaggggtaaggggtggaatactatggtttggctgcgtcccctcccaaatttcatcttgaattgtaacttccacaattcccatgtgtggtgggaggaacccagtgggaggtgattgaatcatgggggcgggtctttcccatgctgttctcctgatggtaagtctcatgaaatctgatagctttaaaaatgggagtcttccttcacaagctctttctttgcctgctgccatccatgtaagacaggacttgctcctccttgccttctgccatgattgtgaggcttctccagccatgtggaactgtaagtgcattaaacctctttcttttgtaaattacccagtctcgggaatgtctttattagcagcatgaaaacacactaaaggccgggcaaggtggctcacacctgtaatcccagcactttgggaagccgaggcaggaggatgacaaggtcaagagatcgagaccagcctggccaaaacaaaaattagctgggtgtggtggcgcatgtctgtagtctcagctacccaagaggctgaggcaggagaatcacttgaaccgggaggcggaggttgcagtgagctgagatcatgccactgcactccagcctaggagagagtgagactccatctcaaaaaaaaaaaaaaaagaaagaaatgcttatttattttggaatcttctgtgatccctcatatagtgcctagcacatgccctgtactagttaagcaaatgagaagaaaaatgcttgtaagctgcatgagggccccagttacacctatcttgctcagaattatgcctgcagggcctaacacaatgctggacacacagcaggtccacaacacatatgtgagaatgaatgtgtaaacaaatggctttgtgcacaatttcataccatctacaaaaacgttttctacacgcagcatctccttagtctacacaggaatttgggtggcacaaaggaggttatagaagactcttagcaaggtgaaagatatttcaagttggctgggtacggtggctcaggcctgtaatcccagcactttgggaagccgaggcgggtggatcacgaggtcaggagatcaagaccatcctggctaacatggtgaaaccccgtctccactgagaaaaaaaaaaaaaaattagccaggcgtggtggcgggcacctgtagtcccagctactcgggaggctgaggcaggagaatggcaagaacctgggaggcggggctagcagtgagccaagatcccaccactgcactccaacctgggtgacagggcaatactctgtctcaaaaaacgaaaaaaaaaaattcaagttaacaaagtgacaatctgtatgcacatatttaggaagaaaagatagactgacaatctacctcaaagggaaagcaaatattggaagtttcatttgttgctattctcttctctgtttttggtggatcttttacctggaccatgaagtggttttctgcaaggggagtattgcagtaaaggcacgtacagacagagatgagaacataactgaggcacagagggagagccgtggtgacagatactttctgtccttggctttacttctgggggagacttctttttcacatactcctggcaattattagtccaacaaatccatcataaagttttaggggagatgtaggaacattcagtcccggtatatgcaatcattatcctttgggccgaatctcctctgagttaattaaattcaaataagtatctttccattccccgggacttgggaggaggagtccaacgcacttgagaagtcacaaaacagccattagatgttaataactaagaactgttccaacctctgctggttttaaatgagaagaccagaggcataaagctccacagggcattcctaacttcctgaggcactcagctgttgaaaatcaattcctcaaataatagtttcctcttccaaaatttagctggatcagatatttttagtttaaaggtcctaatgagactttgtaggaacacgcacagcaagggagaatcctgcacgataaatcactggaggtgtgccaccttacggctggaaatttgaataaacagctttgatgatttatagcagatgtttttccacttagttgtagcccaccaaagcacatactaggcagcatactccaggagaatgggaattagaaccatttttgtgtcattcgccactgtctaaatggcacctggcagtgtctggtagatagtaggtgcccaacaaaatttttctagtggacaaatgacagttctatttagacacaatgcagtctcctctggtcagtcctaggaagaagagggcattaaatcacgtattggttttcaggcacaaagaatagtggacctattttgaagtgaaaatgctattgccttggtaaattcttctgtggggctagaaagaataaactagaagtctggggagttgcacggttcttctgaaggccttctagacctactctttatagatagattgccttccaaacatagcatgtttccacatgtatttctcaattattagttacattacttctgcctattcttggaccctagcccagtgtctttaagtttgaacttaataagtgttcattgaataaatgctgactcatatctaatagggcatatgttccaaatttacttctaaccataaagatgtgttttttctgcatcaagctatccttgctgtcagtcctttttgtgaccaaagcctttattggaaagaagattgaatggacataacagtacgatcaacagatgtgatgcttggcagtttccccatctctgcctgtaactccagcactttgggaggctgaggcaggtggatcacctgaggtcaggagttcaagaccagcctgaccaacaaggcgaaaccccgtctctactaaaattacaaaaaattagccaggtgtggtggcgaatacctgtagtcccagctactcgggaggctgagacgggaatcgcatgaaccctggacgtggaggttgcggtgagccaagattgcaccactgcactccagcctgggaaacagagcaacactccatctcaaaaaaaaaaaaaaaaaaaaaaaaaaagacagaaagaaatagcacctaattcttattagagttattttgcagtctaaatgatttcatatacgtaaagtaaatagaatgttacctggcacttgaactctcaataaacgcaatttcagtatccacaatatgtattattgtatattatcactgtagttccaagtgatcaccacaaatatcaaaactaatttatgttatataatcccaactggaatcagaagaatgctttgggttatcttgggactctgcaaatacttaagtttgagaaacacaaagaataaaaaaatctaaagagaaccagaatttatgtaaaataaaaattaaagtgaatacgtattccagttgaaaggagaaaataagcacagagagttctcagggtggaatttatgaaaaacatcttcaccttcatcagcaaacacatcttttttttttcttttttttttttctttttttgagatggagtcttgctctgttgcccaggctggagtgcagtggtgcgatctcggctcactgcaacctctgcctgggttcaagcgattctcctgcctcagcctgctgagtagctgagactacaggcatgcaccaccacgcccagctaatttttgtatttttagtagagacggggtttcaccatgttggctaggctggtctggatctcttgacctcacgatccacccaccttggtctcccaaactactgggctcacaggagtgagccaccatgcctggccaacaaatacatcttaagtactaattgtgtattatgacttgttaagttttatcaacacggagaaaataaacttggccattgtcgtcaaaggaatggccattgagagtaaaacagtcggtcactcaccacgtaggtcccacactgcaacttgtggaatagaaatacaggaaaagtgcaatgcaatgtgaaagatcacaaatgttcctttagaagggttggagacagcttcaagagaaaaggtaacatttgggttgggccttgagcccatacagatatttatgtggtgtagaagaggctgtggtggaagtggggaagaagagggcttctagcaaaggagcagagaggaggagaggcctgggtcttaggaaccaccacatgctggcatggccagattttcagtttagtgaagagagggcaagggctgcaactggaaacatgcaatgcatttcctgtgccctggtaggcaatttgatcactatcttactggcaatagaaagccaacaaggcctcaaagcaggcttggaaaggatgactctttttcaggaaaaatagcctgtcagtagtgtggaaaataaattagaaaaggggagcaattaggtggtgagacagttgtgacaataatccaaacagtggcaaagccaattgttgaatctctgattcaggcctcaagacagcattggaacagacagaaatggagactaattgcatgtggaagaaaaatggagcaggacactatagattccagagcaaagcctggatagagattgacatggtttggatctatgattccacccaaatcttatgttcaattgtaatccccagtgttggaggtaggcctggtgaaaggtgattggatcatgggggcagttcctcatggtttaacaccgttggccttggagctgccatcgtgattatgagttcttgtgagatctggagtgtgtggcccctgccccctccctctcttcctcctgctcctgccatgtgacacctgcctgcttccccttcgccttccttccaccatggtcccctgaggcctcccgagaagtgggacccgccgagcaccgtgcttcctgtacagcctgtggagccgtgagccaatgaaacctctttaaaaaaaaaaaaaaaaattaccagttctcattcccagaaattacacagatatgcctgtttcttttgttttgttttgtttttgttttgttttgtttttgagacagagtctcgctctgtcacctaggctggagtgcagtggtgccatcttggctcactgcaacctccgcctccagggttcaagcaattcttctgcctaagcctcccaagtagctgggattacaggtgcgtgccaccacgtctggctaatttttgtatttttagtacagatgagctttcaccatgttggccaggcttgtctcgaactcctgacctcgtgatctgcctgccccggcctccccaagtgctgggattacaggcgtgcactgcacctggccctgtttctttataccagtgtgagagtgaactaacacaaattaaggggattggcagagacaataaaagattcaacaagaaaatgttttgagccactggagggatatgatggggagggaatggtaaggtttacctggaaaaggtcgaggccgaattgtttgattggttgtgaaggctccttgtttgtcctccagctacagtcctttccacacatctcattcatacttcaaattgttccatttctcttcaagccccccaatcctcaattaatgggctttctcaaagaccaggaatatacttcagtcactaaacccagtgttctcttttcaggccttaacctacttgtccttttgtagaaatggaagataagtgtgtacctctataattaaggcagtcatgtaatgtattgtccagacagatacatttctgaatgtagaaggacattgttaataattatgttggggcagtcctggactaagcagaacgtttggtctcctgagaagcaggatcgtgccaggtgtggaggctgctccagaacaggcaagcacatagtgagaaacagtggtgccactcaaagagcatcttgagtagtagcggaataaagagcctaataattcagggacaataaactttttccattccctgcctaccccacactgccaacacctctggtccccaaggctgaatagcagatcaggcagagggtgagggagtgtggttttcaggcgtccagactaaagctgcttagtggatggaagttaaagtaccaaagacaaataacctaactctccgttctgcccagaagagccctagaactgaagatcgggaatattggttcaagtacccatacggctcctgcatgtcctacactgctgaaatggaatatacaccttggagctctataggagcagggaagagtttcgggactcaaagtatttcacccttttttagagctatgagataaatgaggagaaaacaaacaatgataacaacaagattgtaatgttaagtagctcttgatttctgagcccaagtgacaggtttagctcagtgcaagactgagctcatgaatatttttgtttactgttttcatgaagcctgcttgtggcaaagataaacacctgccttgcaaatttatttcttaaatcaaaatatatctttcatattttaaaaggaggtgtgtttaaagaggacaaggattaaaaacattcattgctggatttgtgctataatatgcttgccctaaaaattttatttttccttaatttgaccatcaagatgtttgctatgcctttccaatttgcagttttcacataccaaacttctgcagagaatctggatgttgtaaagcatttctgaagttacagaccatctgaaagtttcttaatgggtctaagagccacttcattatcttttaaaaatatatacataaactttagtctttgaaaaagtgcatttttctaaaatgctgataacgctgccatatgttgttttcatgcctttgatttgtaatagaaaatatgttcctaagaaacaatagtagattcacatgtagttgttttccttccaagccccaaattatattttctactttaccaatttataagctgttaaagccaaaagcattcttcaaaatagtctgctttgtcacatcacatacacctacctataatttataattctctatggctatcatttaaccttcaaaaagtgtcattgatattttctgggctacaaagaagttggctactctttctgttcaatgaaggaaataagaaaaataggcaaattaggtgaggtcctgaaatagactgagagaaaagaaatgcactgaatataaagtttatgactggttctgtttgattgaattttacaatgtccagagaggagaaaaatgcaaagccctattaaaaagcatgtttaaatatgttatgaatctcctgggctggttgtctcataatctggattattgaagtatagcacaggaaaggcctaagaccttaattagagtaagtgatatggcagctcgggcatcagcaacacaatctgccgattgtgagaaaaacaaaattagacaaagggctgtggtttagagacatgcttgaacagttaggattttttccctagttttttctaaagtgaaaagaagcagatagccagtgcaataagccaaggggagagggggtataggcctatttggtgggcccatatgtaagcacaacccaaggctcatatgcgctagacaaatcacagccatggagccaggaggaaaataggagtctccataaatccaattctgccagtccaagtccaaaatttatttggacaatcaaagagagaaataatgctgtgaaaagtaatcttctcttcatgtcttctatatctccatggatttcaatgattttgaattggttccccgtagaaataattgtgaagattggctgtcagccaagaaatatttttttgtgcatttactatgcataagtaaatgagttccctgtgtctccttttatcattgtggggtctccaaccctgagatctcaatcctcttcaaaatctcccacacttgtaagtacaaatgtttcaactgagctcatgagtaatttatcttagttcttctaatggccaaggcaatttctgtgcaagaaaacacaaagcatgtcatgagttcagttggcgtctgagagtggtgatgtgtctgacactcaagccaagcacggagtcccccaacactattaaactaccaactcaggccatggttcccctgatgaccggtttgtaagcaaagcgacagtgccccaaatgcactggattaaactgtgctgtgtcccttggggtcctaattacattgaagcctcttggcattccatgtgacagacaaggtcttagactctttccgccacaaaggtacttttgtgtgtaaataaatctcaattttgtctgctttgttttattgttatttgtttttgtctgtagaatctctctgtaagttttatgtacatgaagtgaggggatgtatctgagggctacatgctcaaaactatcctttgttttggagaatgatggtgtgattttgaacccgatctttgtttgccttaacctcacttcccttaggatggattaggtcacagaagatatccggatttgcatggagacgtctgtgcaggacagcccttgggcccagcgtgacttccaaccgtgattcctcaagtgattcctgcaactgtgattcctcacaagttccagcagtgctgcatgcatgtgcaggggaaaacaaggaggcatgaggcaaggatcacaccctcagaaaatgttcagtttaccagagaaggtagacacacagcaaataatgatggcacaaactgaaagcgatgtctgccacacaagtagccacgagaagaaaggacacaaatacaagcaaacactgtcaggccccctaatgtgaacacgaccatcagtttcaggtgggcacaaggaatgaaggcttagtccggtctaagatgtgggtgtctaagcgggtggttttgagggacagaacttctgtcctgtttcaccctcttcacttcctttctcctccttactgagggtcatagcctttgattgtgctccatttcactaaaaggtgcaggtacttttccttcaaaataagctcaaacccttcctgaacgctttctctttcaactcttaagcacgtgtgctgtggagtgacttgttatttcctgccctacagatctgtaagagagctagggcctttgcccaatgtgtgagaagaggtgcaacttgcttcctctcctgcattcaccttagcagggttgtcttccgcgcggctgaggtggccaagctgctcacatccctgcacccaggtcttggccactaccaaatggagaagcccagtcgacaaatgctgtggccgggcattgtcaccccagctgcgagaccttctctctatccatggggagggaatagaaggcttcatttatgccaccatatgagcaataagaactttggactggttttataagtgaatttgtaatctcacatcccaagaaaaaagtcttctgcagtttccaaacccttttaggttcacttgcttgttaattttattgtgagaagaataaataaaatcagaaatacataaataaaaatattttgatgagattgtcattcaaaatggatttgttggtgcaaaaagagtatttttaaaaagaaaaaaaatccacacaagaattatcactaatctcaaaagacataaacgtcttagtagcctgcagagatagcttttactttattttaatatcaaagcagatgaactcaaagcagatgaattaacttccttaaaatatcaaaagctgattgtctgttctcataattcaataaatttggcaaagaaaaagtgtttcaggtaacacatgctttatgaaagtgtctcagttttgtaaattaccccttagcctccagtattagagaagagcttcagatttttataaatattaatcctgtcctggtttattacgtgctgattcagatataaattacttttaaaatttaaaaaatgtcatgcttattggcctaagaaaataatgactttcctatcagagactacaaccagactttaagaactcaatatcataaaaatgtccattctccccaaatttatttacagattcagtgcaattccaataaaaagcccaaaagtttttctatgtaattagacaagttgacttttaatttatatggaaaagtaaagggccaagcacagtggggattcatcattgggtgtatcaaaccttattgtaaaccagaagtaattcagacagtgcaagtgttgtctagaaatagacaaataggccaaggaaacaaaatagaaactccagaaataaactcacatatacggaaatgtattaagtgcaaaagcagggatcgaagctctgtggtgaaaggaagggctgtttatgaatggtacttgcacattaacttatggataccaaataatggaaattggattcctacttcacagcctatacaagtatggtcatgcactcccacataatattttgatcaacagtggactgcatatacaatggtggtcccataaggtaatcagggagctaaaatatttctatggcctagtgatgtagcagccgtcataacatagtcacataatgcattaccttttccatgtttagctgtgtttgatacacatagaatcatgttacagttgctgacagtactgagtacagtaacctgctgtacaggtttgtagcctaggagcaataggctattccgtatagtgtaggtatgtggtaggttgtgccatctagatttgtggaagtacactctgtgatatttgcacaatgatgaagttgcctgatgaagcacttctcagaacgtatccccattgtgtttctcagaatgcatcctcgtcatcaagtgatgcataactgcatagctttaaggtagatttaggacttaaatatttaaggcaaaactacaatctttcaaaagacagtatcagaaatatcttaattacctcagggtaggactttgctttaaaaagatgtaaaagaactaaccataaaaaagatggataattcgactacattaaaatacagagcttctgatcatcaaaagaaactattagaaagtgattggacaagtctgaagtaggaagaatgtctgaacaacacagaagcagcaaaggcttggtttgaagagcataaaaacgcttataaatgaattttaaaatgataagcgatgtgataattggcaaaagctataaatagaaatttctcaaaataagcagcataattgatgcatgagatatgaaaaatacccaatcttactagtaatcaaagaaatgcaaattaaaactacaataagacagcatttcctatccacctcagataacgttcttaaatagcagagcacatatatatgatttcactttttgtggtttagcttttcattctgagaatgagaataaaccttttcacccatgttttccatagtccggtctgttattctacattcttttacattctaataccttatgttttccattacatcctttcttctcacccttatatcagtttctaatggatttagcaggaaaccaacattcctgttcaacttgtacaaacttgtgaaaacataattgaaatgaaaatggaaatttcaggccaccagatgtctttatgcatctgcataaataacagtgccatgaaattgaccccagcctaccttttaagtaggaaaacactctcctttaatccaatgtggatgattatggatgattcatttgctactaatttgctgaaaactcaattcagaaaatactaacaatacgtatattaagccttaacaaatgacattcaacagaaatctgtttcctttgatacttttcctttaaggaagtctccagacagtgtttcctaatcagtataatgagctttctggaatttatgaaagcgaaggctcctttcagatctaaagtttcagctctgtattttcactattaagaattgtttacacctataaaaccagattgaagagctttgctaagtctccgtccctcttctccatcccctctgcatccgtgtctcccaaagctctttattaccctccccatttctttgctctgtttctggctgccgcttttcctcaatcttgctctcattctccttcacactttactgctctctcactaactccacaagtttaaaaaactaacccaacttagaaatgtctactaacttcctaaaacatcctccacaacattaaaaagcactgctaatatttttacaatacaatacacaaatatttaataaaatcaggacaacacacattcccactttgtaccatcgtgttaccaaatgagattcacttgtaatgaacaaatcatcaatcttcgctgttatcagaaactagcttccccaagccttccagtaattttttagagttctggaagcaatagctccaaacctagtctgtcagcaggagactcggcctggcttacgctccacttggacttctgctcgggctcccgggaagccatctggggcagcctggcgtccatctgcccttctgaagtaggtcgcagaccctgccaagatactgaccctggatgccagtgaaacctcatccctgtcatgacaaagaatctctggagtccaggtaaaggtagggagaatgcctcctctccaacatctcccacactgcatcgtctggacaatggcacagttctacttctgtgggcacctctgttcttcatgaaaaacaccactgccatattttggccagatctgggcaatacaaggctcactctcagcccaaagggcatgcatgaaacagatttcttcccacgagggagagaccctcctattatcctcctaaattccatccccacttagaaccatcctcccatgtatcctcctataatcaatctcccatgttatttatctcctaaagtctattcccagcttagaactgagaattcttcctttctcccagttcccacacttgcctagttaaaaactgtccagtttaaaacaacgacttccatgcatgccaaagacagaagcagatcttagaagaagatggcttcccaaccccacctttctcagggctcttgctaaataatttattagattgaccagccagacctggaatttgaacctgacgcatgatcttggtggagatactaactgctcatttatcatccctaaaagggagaaaaacctgcatttgccatacttcaagatctagtccacacttagcttccctttggactgctgcctttcactctttcatttatctagaatgctgtgtattttcctgactacatataactacaccgtaaaacatctgaagactgcataaaaacataagaaaaaataaataaatcatttcaaaatttcatcacactgaggcaaccactgtcaagatcttggtatctgtttctgttatgaaaatatgcaaacataaattaattttacataaaaggaatcatttctgtttacatcttttaaatttttactgttgcccttttcttgctttccccactccacaagtgtccttattaatttctttattcctcatatcattccttgaaagttgtttattacaggtatattttcctttttctctttctggctgcagaattgtgttaagaatgagataaaaattacccatgtacccatgaccttattaaaaatcatccatcaccgaaacagctgatattcctcctagttcttccccaactgcctccttctgcacccacattagccagcatcttcctttggtgtttgtcattctcacggatacctttacatgtgtgtcacatacgtctttggcactaaacagtatgtagcactgcgttatatgttcctaaccgcagtacaaatggccacagctatatatattttcctggaatctctcttttctcacttaatgcggattaatatgagtaagtctagtttcttgactttgctattttgccacattctcttgtgggaatgtacatcaaggtattagtcaattcctctgttaatggacattgctgttgttttcatccttttgctctcctgtggtctgtggctgtgagcctttttttcagattgaggcagcatagcaagcagttttgaagggggactccagtgcagactgcatgcatctgatgtgtggtggcgccatgtaggagctcagcagccttggcaagttagttaatccactgtgcgtcacttccccattttaaaattgagataaaaatagtatgtacttcataggactattgagaagagtattaacttgaagcatatgcaattataattttcatagtccaaaaatggtcacatattagcatttttatatggtgaaacctaataaatgagataattgatatagcatatttagaatggaggtatacagtcagtacttagtattagctgtaatgatagcagtggtgatgacaatgatggtgtctctttgtatatgttaagtctcaggctttctctggcctaaacagccaggaatagaattgctgggtcacaggatctatccaaattcaacctttacctccagaatgttctccagagttttctatccaagatatgttttatttttctacatatttgtgtcttaatatttttcaataacgttttataatattgttcataagaattattcgttttcttctctctttcccctctcctcctctctcttcttctgttcttttttatctctttcttcctcctcctctacctctccttctttttcttttttctcccaaattcgaagatgaacactcttctgctatcagagtagaaaggtctgtgacttcctcatgtttctagaagatctccatggatcatgcaaaaggtcagatgccatctttactttcacagctctggaaatccatttgctaagctctcaattatcacccagagctctaggacggtatttctaagacttttgtgtggctcacagagtatcatgctgttaactgtcccagaagcctagaggatcccttggctttacagcgcacagctcctgaccctgcagctccactggaaattggactgagccatcatcttccctgagcctccccgcttcgctcttcattgtcctccctccctattcggcagatccagagattcactctgctgcgtaaattcttttagtcccaagataaagcactgcctatgaagagatgtctaacttttaaaactggccaattacatcaaaatttatttggttctataagcaaagatatggcccagcaatttattaacaggaagggaatgctaagtgaatatcagcaatcattaataaagatgttgtgaatggtttcagaacgcacagtaaacaatttaattccaaatgatatattaagagagaactaagaagaggatttctttcagatagcacagaatagaatatttttccaaattaatagttacaatattcaggagaaacaaaccgttcaaaataactgaaccctgcctgtagtctctttcctgtattgctaatcctctttcctatttcgtttttctgtcatttctttctctctctacttggctttttccatcagcatgtaaatctaatttagtttttgccatccttaataaaaacaaaatgatgcctgcgactgttgtctaatgtctacttttcaaaaccaaaattttcaaaagcactatttatgctgtttgtctcttcctcttcccctttcctcccagcccatttcaataaggctgactaccgccaaccactccgccccagaggcatctgcccccggccgcgcaccctctctccctcaccacgccttggtgtcctcacgttcccgcacctctcagaagcgcttcctccacgctccacaacggccttccccgcccagaagcgcttcctccacgctccacggcggccttacctgctcagaagttcatgctcccagcggccttccccacccagaagcgcttcctccaggctgcgcaacggccttccccgcccggaagcgcttcctccagtctccacagcggccttcccgcccgggagcgcttcctccacgctccacagcggccttccttgtgagaggtgacagcgtgctggcagtcctcacagccctcgctcgctctcggcgccccctctgcctgggctcccactttgggggcacttgaggagcccttcagcccaccgctgcactgtgggagcccctttctgggctggccaaggaggagcccgctccctcagct

SEQ ID NO: 2242 - DNA, 146332 bp, Homo sapiens
tgatagacatctgggcaagtcaacaggaaggtggatatccaaatctctctcttcgcaatgagtttccagttagatggaggagagagtaataaaacacagtaagtgtggaaaagattaaaatgcatgttgtgatataccacaggaaatcagaggagagaggttcattctaaggggaatggtggaaacgtcagtgagaacataccacctgggtggttcttgtaagatgatgtggaagagaaaaggtaaagattgagcaaaacagtgcatgagcgaaggatgcaatgtgagatggtctgaacagtttaaaagaataacctgggccaggcacggtggctcactcctgtaatcccagcactttgggaagccaaggcgggtggatcccgaggtcaggagttcgagaccatcctggctaacacggtgaaaccccgtctctactaaaaatacaaaaaattagccgggcgtggtggcgtgtgcttgtagtcccagctacttgggaggctgaggcaggagaatcgcttgaacctgggaggtggaggttgcagtgagccgagatcgcgccactgcactccagcctgggcgacagagactgactccctctcaaaagaaaaaaaaaaaaaaagcataagccgagggaatgaaagtactttctgtggctggagcacaggatgtctagacagaagaatttggaaagaaacagaggatactagatttggaacagatcattcaggtcctcaagaccttgaaaataaggctacagtttttaatattattatactgcaggccattgaagataatgcacttgttttgtattgtttttgtttttcagaagacagagtattaacttttttttcaggttgtagaattcatcaattccataaccatttttgaatgagtattacaggtcaaggacttttctaaaaagatggatatggtctcttctgtcatgggtcttacattctgtgggaggagacaagcaataactacatacaatgagcacaataattgaagtgattatgtgggaattaaaggggtgggctattgacaacttcagacaccatggtaattaatggccttcgatttgtaacaggagctgagattcctgacttcacagatccctgaggagatgtttactaaagggaatcttctggtcactgttaccttcctccgtacttacctgcctcatggagtaagcatgacaaaattcttgattacatagggaaaatcacatcttcgattaatactttcctgtttttattcttcattactacttgcatgatattcacataatcttttctcttctcctgcttcctccgtgcaataagctgctcaggcagcctttgctcttaagagcttgtttgtatctgagaacgagttaaggctttacactggtagtaagtttaagtcatgccaaaaaggggtagaatacctgattctcctagtttcaagacaagccaggttttttttgtttgtttgttttttaaaaaagcagaaactttcattgctctctctcatctgaaactagatgaggctatctactctgagtggccaggtcttctgtaatttgtaactgaaatgcaggttacttgctcactgcacgtacagttcagttaacgagggaaatctgatccaaaataagtgaatttattccgaagttagcttgggggaaggggcacaaagcatcccgcctttgaatgtgccgcttctcctctgttgcaaaaagtgggcattttcatagggtaagggaggacatgagcaagggcaggggtcccactgcttctggtcagttacctaccaggcagttgagttggcaccttcctgtgcagagttcagttgtaaaagtagccaagtggtcatgctttcgatgtgctgtcctggtgcgtatgagttcctaggtcacccctggaggatggcagttccgaggcacgcccctggaggtgagagttccatggggacatgctttggtctgtaaatccaccgtcagctctggaggagagacctgtcttggagcacgaagttagaggaacttgctgtgtaggcaatgtcctgtgagggagaggtgagagattatatttgcatttcagcagagctaagcagaaagcagagagccagggaaaggagaaaacagagtgagagggaaaaatataattaaaccacccgtagaaaaatagggagaactgggggccggggcggtggctcacgcctgtaatcccagcacttcgggaggccaaggccgacggatcatgaggtcaggagttcgagagcaggctggccaacatggtgaaaccctgtctctactaaaaatacaaaaattagctgggtgtggcagcaggcgcctgtaatcccaactactcgggaggctgaggcaggagaatcgcttgaacccgggaggtggaggttgcagtgagctgagatcgtgccactgtgctccagcctgggcaacaagagcaaaactccatcttaaaaaacaaaagaaaaaagaaaaagaaaaatggggtacttggttacattttaagaacctaaaaatctagaatttcatgcaaaactcataattttcaagttggtaattaattttcaaatgtaaacatattgtggctcgcaaagaacaataagatcaatcaaccaataaaggcaaaaatagagagtaaggaagaatccacactaagaagcgtgaagacttgattagagacataagccaaagaaaggagatgtgttcagtgtttactgccatgtgccaagcaggggcgggtgaagacaatggcaatgtgaacagctaggaggaaggcaatatctggtaaattagagccgatgacatatgagtccaaaggagaaaagaggacgctgaacccaagcttgatgattgggagaatggtggtcccgtgacttgtcccaccgaagccaaagaaagaacagatctaagggatggtgatctttgagcaagctcgtttccctcacacgttccagcgctgtttcacgccaggctctgggattgaatgatatccctggatcaggttcactggcgtcccctgctggcacagagcagcacaaagacttcgaaactggatacgctgataaatttatgaaatctccacaaactagagaacacgggctaggtgcggtggctcacacctgtaatcccagcactttgggaagccgaggcgggtggatcacgaggtcatgagatcgagaccagcctggccaacatagtgaaaccccatctctactaaaaatacaaaaaattagctgggcatggtggcgggcgcctgtagtcccagctacttgggaggctgaggcaggagaatcgcttgaagcccggaggcggagcttgcagtgaccagagatcactccactgcactccatcctaggcgacacggtgagactctgtctcaaaaaaaaacaaacacaaaaacactagagaacatgttattaaataatagaaagaaagaatgcccatctgataaaggtacaaaactgaccttaaaatgacttagcactggaaagaaaaaaaaaagaggctacaaatttttggttactgaagagccttttaaataagattatattaaaacagtgggtagatctctccaaagcagaataagaaaacccctaatcttcctcctaactaaatgattatatgatttgatgagtgaggattaagttctgcttttaaatataattgctgggtaatatgaatataaaccaaatatgtaaaatttaagatacaaagatcaatattcccaattctataaaatttgtgtcaactaattgtagataataaaatattttatgtattttttagaagaagataataggcataacaactattgtgaaattatccaaatttgtactcttagttgccaattttcagttctttagaaagtgcaattattcttagcagtgagaaacatgagtctcacagaatacatttaagtcttcactttgatttacaacctccagtgttaattaaacaaatgccaactatgctaatagtctggaaatcctttgacaaatactgaaagaaatgacaggtctggcacatacacatatagatggaggcttgcctgatttttaagaggcgttttacagatttggccttataatacttattctataactattcattttatcctggaaaatgttgtctataaagttttggagagaaattgctctgtagaacaaattgacatttcacaggaataagtccactattgctaagaaaaatggtactggggatggagccccaaaatggcagaggcaaacacagccctatcaacctctcccatccccctgtgtacacattagtatagacttagtctgtctttaggaacaacatttttactgacctgctttctaagttgttggtccctcctcttccctgggatctacatatcagggtagtttcataattctctgttgtctcagttacgtgttaaaagtaagcatgttcactgagtgatgattttactttttaaacaacctcatcttttaccgtaccatcagttatattaaatatgacatttaaggttttaaaagtggagttagaaagctacatactgagaggtgaagccaggcgggcttctgactcatgtggggacttggagaacttttctgtctagctggaggattataaacgcaccaatcagcactctgtgtctagctaaaggtttgtaaatgcaccaatcagcactctgtaaaaacggaccaatcagcactctgtaaaatggaccaatcagtgctctgtaaaatggaccaatcaccgctctgtaaaatgggccaatcagcaggacgtgggtggggccaaataagggaataaaagctggccaccagagccaacagtagcaaccggtttgggtacctttccctatgaaagctttctttcacttttcacaataagtcgtgggtgcttctcactctttgggtctgcactacctttatgagctgtaacgttcgtggcgagagtcggtggcttcattcttgaagtcagccagaccaagaacccaccagaaggaataaattccagacacaatacaatatgttgggtgagcagatcatggcacttatgtcaggaaagcttgtgtttaatcctgggtgtgccatttactaagtgtgtgattagttgtattatatatacatacacacacacgtattttttgagacagagtctcgctctggcacccaggctggaatgctgtggtgcaatctcggctcactgcaacctccgcctcccaggttcaagcgattctcctgcctcagcttcccgagtagctggggctgcaggcatgagccaccatatccagcttttttttttttttttttttttttggatttttagtagtgacagggttttgccacattggccaggctggtctcgaactcctgacctcagacgatctgcccacctcagcctcccaaagtgctgggattatagccataggccactgcacccagccgtatcttttaattttaatacccaaatgtattatcaagctaataaatttgaataaaaacaaaatagtaaagctaatataaatattaaactttttacacaaagaattggttctttaaaaaggttagcaaaattgagaaatctttgctagaatgatttaggaagaaagaagactcaactgaaaatcagaagtgaaagaagagacattactaccaattttgcagaaataaaaaggattgtaaaagagtactgtgaacaattgtataccaacaaactgaacatcttaggtgagatggacaaattcctagaaacacacaaatggccaagattgaatcacgaagaatcagaatatctcaagagacttacagtaaggagattaactctgtaataaccccccagcaaagaaaagctaagggctagatgacttcactggataattgtagcaaacatttaaagaacaattaaaacaaatctttctcaaactcttaataaaaagcaaagtggagggagtactgccaaactcaatctacgagaccagatttaccctgataccaaaatcagacaagtatactatgagaaaagaaagtacagaccaatatccctgattaatactgatgcagaaatcctcaagaaaatactagcaatcagaactcacaagacattaaaagaattttacatcatggcaaagtgggctttagtcctagaatgcaagaatggtaaatatatgaaaatcaaagtaatgccctacattcacagaatgaaggacaaaaaccatgtgatgatctcaactgatgcagaaagaaaaaatttgacaagatgctctattacaaaacactcaacaactagtaatagaaggaaacttcgtcaacacagtaaaggccaaatataaacacccagaactaacatcgtactcaatggttaaagactgaatggtctccctctaagatcaagaggagcaagacaaggatgctctctttcaccgtttctgttctacttagtgttagaagtcctacctggagtaattaggtaagaaaaagcaataaaagtcatccacatgagaaaggaagaagtaaatttatatctgttcacagatcacataatcttatgtgtagaaaaccataactattacataaaaatgaattcagcaaagttgcagaattcaaaatcaacacacaaaaatcaattgcatttctgtgtattaatgatgagcaacccaaaggaaattaagaaaacaattcaatttacaatagcattaaaaagaataaaacacttaagaacaaacttaaccactgaggcaaaagacttgtactctgaaaactataaaagaaatatatacataagtggaaagacatcgatattcatgaattagaagacttatattgttaagatagtagtgttccccaaaatgatctacagattcaatgcaatccctatcaaaatctcgaccttttttgcagacatggaaaaattcattgttaaattcaaatggaaattaaaggaatctatgatagccaaaataatcttgaaatagaaaaacaaggttagaggtctcgtacttcatgatttaaaaactcactgcaaagctacagtaatcaaaacagtggttattgtcataaagacaagagtatagaccaacaaaatggaatagagagcctagaaataaaccttcacatacatggtcaaatgatttcaacaagggtgccaagaatattcaatagggaaagggcagtcttttcaaccagtggtcctgagaaaacaagataaccacatgcaaaagagttaagttgaaccattaccatagactatatacaaaaagttaactaaaaatggatcaaagacctaacccataagagttaaaactataaaactcttaaacaaaaatataaggggaaagcttcatgtcactggatttggcattgattatttggatatgacaataaaagcatagataacgaagaaaaataagtaaattggactacaccaaagttaaaaacttctgtgcaaaacaggctataatcaacagagtgaaaaggcaacccataaaatgggaaacatttgcaaataatataactgattagagttattcagaatatataaagaactcttacaactcacacacacacacacacacacacgaaacccaattaaaccattgacaaaagccttgaatagacatctctacaaaaaagatacacacatagctaataagcacatgaagagatgcttgataccactaattgttagagaaatggaagtcaaaaccctgactggcaaaacactgtgacaccacttgatacccattaggattgctactattaaaaaaaaatcagaaaataacaagcattggcaaggatgtggataaactggaaaacttttgcatttttggtgggagataaaatggtgcagccactatggaaaacagtatggtggttactcaaaaaattaaaaatagaattaccatatggtgcagtgatttcacttctgggtatatatcaaaaataattaaaatgaagcacttgtacagatatttttgcacttatgttcataagcagcattactaacaatagtcaaaaggtggaagtaagccaagtgttcattgctggcggaataaacaaactatgacatttacttacaataaaatatttttcagccttaaaatggaaggaaattctgacacatgctacaactgtaggtcattatgttgagtgaaataagccagtcataaaaggataaatactgtatgattctgaaacagaccgaatagtcccattttttaaaaaaaattttgatgaacatagaaattgacccctttggtattaaagtttgaaacttatatttgttttttctgagttccttcttcaggaaatgaccttcaggcctctcaaaaaaaagtattaaagaactgaaactcacccagttaccacatccagacaatgagatgccagacccctcattcatcatgatggcttccttgcccctcactagttcctgtttccttacacattgttacattccttccctgctatataaactcctagttgtagttggtcagagagatggatttgagactgagttcctgtctcctcggctgcagcacccgattaaagccttcttccttggcaatactcattgtctcagttcttggctttctgtgcagccagtagaagaacctagactgaactcctggtgtttcactaatcatcccacttacacagtgtacttagagtagtcacattcatagagacagaaaatagaatgggggttgtcagcagctggtggaaaggcaatggtgagttcttgtttaatggttagagtttcagttttacaagattgaaagggttctggatatggatattgatgacggttgcacaacaatgtaatgatgttcactgaagtgtacttttagaaatgttaggatgataatttatataacttttttttttttttgagatggagtctctgtcacccaggctggagtgaagtggtgccatcttggctcactgcaacccccacctcctgggtcaagagattctcctgcctcagcttcccaagtagctaggattacaggctaccacctgtgtgattacgggccaccatgcctggctaatttttgtatttttagttcgagatggggtttcaccatgttggccaggctgatcttgaactcctgacatcatgatccacccgccttggcctccaaagtgctgggattacaggcatgaggcactgcgcctggcttataacattttttttttttttttgagacagagtctcactctgtcgcctagactggagtgcagtggtgcgatctcagctcactgcaacctctgcatcccgggtgcaagtgattctcctgcctcagcctcccaagtagctgggactacaggcacctgccaccacatctggctaatttttgtatttttagtaaaggcgaggtttcatcattttgcccaggctgttctcaaactcctgacctcagataacttatgtaacttttatataggtatattttatcacacttaaaaatattaacacatcttaagaaattcagccaacccaaattgctgagatggcatggaggtatggaaagagcttttcaagctagaaagacctaagtttgaaatgagacctaagttctactacgttctaatgctatgacctcagagatgtcatagagtcacgttgacactcagcttcctcatattatgcgatgaccacttatagaggcatgatgaagagtaattgagattatgttatttacagtctctggcacagcctgtggctctccacaggtacactgcaatgaatcttcctttgcattttcctcaggtaatagtaaggtgtaattgactacaaataggtctctatgctttaaatgtaaatattaatttcacttagatgatctaattcagtttttacagcatgctatggtttacacaatcctttatatagtattttattttcctaacttttgaggtaagcattacgaattatattttaacaatggatgatctgaatataaaagagattacaggatttgattaagatcatatattgctgtgattcaacaccatattttcttaattcaatttcatcgttatttatatggtacaattaggaaaggaaaaagtaatccaagccctatattaaaccatacctgttgctgagtgtcttcaaaatcattttattttccttcctaagataaaaaaaaaatgatagaatcctacgtgcttgtctgatgattcgtaacttgaagtcagggattagatctcctctgtttcttagttttattctatagcccatgaatatattaagcattcaatagacatttgttgaattaaaatggtataaactattgatctgaaatactgcatttgaagcttggtacttcatgcattttgttcatatcatttatgtactaaattcaactttttttttattttgcatcctgattgtgttttcataaacatttattctaatgctaaaatttaatatcaataaattatatcttggagaaataatttaacaaactcatatttgcttggtgtgattatcaagactgcagaaactttggcaatataacataatggggaaaaaattggacaggaatcagaactaaccttcattatgggttcctggaatagctccaatctattcaagtaccctggagccaaacatttaaatgctccctgcctggatttctgcatttccccaatggagatgataatatttatctggcctacgttgtaagcttcctttttctacaccatgatactcagtatgacatagaggttcaaatcacttactattttcataaccataggcaaacctcttcacacttccatctgtaaagctgcctaataatagtatctgtgttctagtttatcatgaggattaaacgagtgaatatttatgaagcgtgtaaaacagtatttggcacatatgcaaatgttggttaaattttatgtgcataagtgtgtgtgcgcactttgaaaagtataaaaatatatttataatatcaggtcaattaatattttttctctctaaatgctactctagttatgtatatgcacttcaagtacttgacttttagttttctcatctgaaaaattgcattatcttttatttaacttatatttttgatcattaaatgctcttaagtactccatgctcagtaagacagataaatggagaaatctagcatgaagttagaaattaagaaggcatattgtttctataaaaaagaacaattttaacgaggaaagacagaaaacaagaaacataccattgaggccaactggtttataaggtgttgttactcagtcccagattttaaggtgcaattctcacatatgaattttcatagaggcctttgaagaagagaacaaagtctatgaaaatgcagccagtaaaagatcctccccttccttgaactacacccaacctgacttcagatgcaggttgcctttacttggggacgtgtgtggccgagaggcaagaggggtttcccttgagtagaatagaacttaaagagccaacagcagactcctcagatgctagtaacttgccaccagtagcgtacactgtgtccaacacgcagaggcaggtttgagtggaattcccagatagcttgtgatcaaagactggtcgccagtgaagaagacttgggatggatggatggatgggtggatggatgggtggataaatggatgaatttaacattgaggtataatttgcttaacagtaaaatgttcagtttaataagtttaggccaattaatattaattttgattaatctcaaattgtcttgctatcgagtgtttttttaagacagcaccaagtgtaaaggaaaatcttgagatcattatgccaaagacaaattgactccataagattagtccaaattatcaagtatattccatcattttgaatactcataaaacatattttgatttttattattttaagtgaatatttggtgatttcaaataagcaaacccaaattcaagaactttcactgtgcagaaatttccaaagtcaaaaccaaatagcgagtgtgataagttatactcattagacagcaatagagaggccccctgtaatggaatatggggtgactgtgaggatgctgaagaaaaaatggccatgattttttatctaaaggtgtgcttagtaaagtaggaatagaaaataaagacaaatatgcaactccaggagttatgagaatgtattcgggacgtattttgaaaacaaacccaactgctaaaattgagtcgacccagaaaagaattaagctgagatatctcttagtgatactttcacatccagatttacgcttagattcatgatgcattacaactaataaaattgtttaagtatgagaaagagcagaccaaggggccatgaagaaaatataattaaatgcagattaaaggggcagggcttctggtttggcagacacttacacttcaaagactggaacattctctttaataatacctcagttatctaataaaaatgatcatttggaaatcatgctggtcacttctgtctagctcaagtgtcaatgttctggatatactgggtactttattcacactgaattgcttttatacatcgagaaaggtgttaactcttactcttcttaaaatggactgtggtaattaattctgatgcctggaagcaaataagtaaatctttgaaatattcattttatttatacagacttagatatctactttttaggaaaatcacacttaaatacccctttcacttttgtacatatttgacacagtttggtatcaactgttactcggattatatagaaatattttgttgcaatgaatttatccaatttccttaaaggaagaagcaacaatggattatttcaaggagaacattatgtaatagtccatgctaatgaactgttaaaaaaatattattgacacaggcatgttaatagcagtgtgggttttggtaatcagctaacataattagtccagaattatatggactttttaagtaataaaatttactggaaacttaaatgtaattaattaaaagtttggtttagttataaatatgattaaagcatttttctctaattttttttttttttttgagacagagtctcgctctgtcgcccaggctggagtgcagtggccctatctcagctcactgcaagctccgcctcccgggttcacgccatgctcctgcctcagcctcctgagtagctgggactacaggcgcccgccactatgcccggctaatttttggtatttttagtagagacggggtttcaccgtgttagccaagatggtctcgatcttctgacctcgtgatccgcccacctcggcctccaaaagtgctgggattacaggcgcgagctaccgcgcccagcccatttttctctaatttatacttaaatttgcattattatttgcaaaacgtaccaaaatttggacatttaagcatcatttattctgaaaaaagtataagacatagtaaataacataccaatatgggacatgggagataaaaattgatcacccagtagataaagggaaaagctctttcagaaaaaaaaagtaaatttaattggcatataatcagaatatgtatgagcattttggagttcttgttttcttgttaactaaggtagaattttacaggtttgtagaccaaggcttcatctccatgaatgtggccccatgattaagatggcttggggtcagacagactcagtcctgctgtttgttagttgtgtaacatcagacatgctcaaagcctcaacttactcattttggggaaataataataattattaagactggtgagggccagctcggtggctcacgcctgtaatcccagcactttgggaggccgaggcgggtggatcacgaggtcaggagatcgagaccatcctggctaacaccgtgaaaccccgtctctactacaaatacaaaaaattagccgggcgtggtggcgggcgccggtagtcccagctactcgggaggctgaggcgggagaatggcgggaacccgggaggcggagcttgcagtgagccgagatcgcgcccctgcacttcagccccgggggacagagcgagactccatctcagaaaacaaacaaacaaacaaacaaaaaaactggtgagggttataataaatatatgtgaattaaataaaaatgtgttttaaatgtcatcaattgttttatatttcttaataaatttctcttttgtcaatttcattattcagcaaacgcagaaacttaagattttctgctgtttgtagtaatgtagtatatttcatcatatggcaagtgctaccagagagaagtaggattattatttattgtggtttttgcaaaaccagaggcccatgccaggagttttattcagcacggctcctctttgattcctgtcacacctagacacaatgaaggtgatttgcaaaaaagtagaagaaataaaagaaaaacaaaacaaaaactcttcttgccaagatttctaaagtaatgaagaaataacgtcacttgtaaaaggggtttctaaaattacctatctggaacagaagaaagcaagagtccggtacccctatcaaatcaattggtttaacatgttttcccttttaaagtaaaataataatttaaataataaatacacatttttatttatataatgccatttttaatatagtatcatttttctactgggattttatagtttaatagacgttcatcattagtgtgctgtttcaaatcctggccctgctctatattttttggttggtttgtttggatattattaccataaaaacaaaaacaggcttgcaatggctgcagattcacagaagattattagaaataaaagtttattgttaaatattttgtcatagcaaaatatatttttctttaagagaaaaaagtttttatctaaatattatcaaatttattactttcatcacttacgtaagttaaccagttcatatgcatctgtatgtctcagtagagaccaccaacttcaacattaatgtgttttattttctcaaagttggacttcagacaaaaattataaaactggaagatagtaatatttaaggatgccttcctaaaattatcttaagtacatcgaatatttccaaaaaatgtttttcctctgagagtttcctatgctggtaagaaatattttgggaacagaatagacaaggattaagtgaaaaataaatgtccctttttactcttattccagttctcagaggaaacagtttcttgcacggacttccagttattttctatacataggaagtatattatatataacaatataaaatttatcatgaatgaactactctatacacactctgacagttactttttaagttaaacaatatctcgagtgtctcacatatctatactctcacaagtattacatatatattacatacatacttgcctaattagtttttggtgacaatatattgtattattatatgaatgtactataatttttaatagcaagtctctttgcaagtgtagctccagcttctattaggagtgaaatccctggataaaatataacttgtctccaaagctgattctccaaaactgtttcaatttccattcccgcatggtaatatcaatagaataattgcccattgtcccacaacctgtttaacatggtcacacagcgggattctgactttgccaaatggctcacttcaataagcttaatgaatgtttaaatgaatgaatgtcaatttatgaatgaggattaccatcttctcatacacgactactgaatgtatctcactttctgaatgggaatcatcttctcatatactaccacttttttttttttgaaacagggtttcactctgttgcccatgctagagtgcaatggcatgatcatagcccgctgcagccttgaactcctgggctcaagctaccctcccacctcagcctcctgagtagctaggactacaggtgtgaaccaccatgcccagctaatcgtgtgtttgtttgtttgtttgtttgtttgttttagagaacaccaggctggtctcgaactcttgggctcaagtgatcctcctgcctcagcttcccaaagtgctgggaatcaggcatgagccactgtgcccacccttatactaccttttttttttttttttttttttttgagacggagtctcactctgttacccaggctggagtgcagtggtgcaatctcttctgactgcaacctccacctcctgggctcaagcgattctcctgcctagcctcccgagtagcctggattaagggcgtgcaccaccacgcctggctaatttttgtatttttttatagtagagacggggtttcaccatgttggccaggatagttttgaacacctgacctcaaatgatctgcccgcctcggcttcccaaagtgctgggattataggtgtgagccagtgtgcccagcccccttatactacttttatatgtcttgcctggttttttcttctgaccagatttataattaaataactggttttttttcttactgactttcatgaaattttaatttatcaggaaattagttctgttgttaatttatgttgtacatatttactctaatttatctctcttaaaatgttttgttttttggccagacgtggtgggtcatgcctgtaatcccagcaatttgggatcacctgaggtcaggagttcaagaccagcctggccaacatggcaaaaccccatctctgctaaaaacaaaaattagctgggtgtaatggtgcgcacctgtaatcccagctactcgggcggctgaggcagagcaatcgtttgaacccgggaggtggaggttgcagtgagctgagacctcaccactgcactccagcctgggtgacagagcaagaccctgtctcaaaaaaaaaaaaagttttattttttaatatatacatactttagtgggacataagaatgatttagggcacttcaatttgggtctattttttctttcttttattatactttaagttctgggatacatgtgcaagacgtgcaggtttgttacaaaataggtatacatgtgccatggtggtatgctgcactcatcaacccgtcatctacattaggtatttctcctaatgctatccctcccctagtcccccagcttctgacaggccccagtgtgtgatgttcccctccctgtgtccatgtgttctcattgttcagctcccacttatgagtgaatatgtggtgtttggttttctgttcctgtgttagtgtgctgagaatgatggtgtccagcttcatccatgtccctgcagaggacatgaactcatccttttgtatggctgcacagtattccctggtgtatatgtgccacgttttcttgatccagtctgtcagtgatgggcacagccacttgggcctgttttctagggacacgtctctctgcagatggttacagcctccttcggtttgcgcagatcgccctcagacgaaatgtcagcatgtctctcaatgaagctctttaatccacagtcgttttgttttcagctcagttgtttctggtcggtgcaaagctgactgcagtttttcttctcttttcaatgtttgtaacttttcttctctgtgcttgacctctaaattaggatttgtgttgaagtaaagaattgtaataacctgcagagtcacccttaaatctggataccccctctttctctttctctctcagaatggagtactccagagcaatgttctccacttctcccacggcattatcgcacccctaagtctctcttctaactaggatattcttctctgggttctcaggtccctggaggtctcagggacattgatgccatgttcagggtctaaaaggtaaggtttttgtgctttgtacttcttcagtttggcccagatgtccttgtattcgtgagatatttttcacagtgattcctacagtattttaagatcagttctctcacctgtttttactctttttgtctacataggggatatcagagacaggatataaatagtaatattttattctttcaggaagctataaatgtatttagattattacaatttgtacagactctaagcagaaatataatcacatcatttatgatatttatcttcataaatagatatttgaattggcttccaaaatgaccttagagatgtacttacttaatgatggtggccttgatctttttgtgattagataatagcccagcatgtggccacagtagcagaaacacacagtatgtgctggttaattggctctactcgcttcatgcattattacagcttatctgctgcttgtggactggtacatgttgagcttctcaataatcaaagaagaaatcaggtgccaggtcacaatccagacccaagaagtgtctgcttttctgttttccacatgaagtcatcatttagcattcttttcttctttttcaatggtggagaagcctctggtatgtaaaacatgagtaaagttcaaatagggtcaaattccggaaggcagcacagaacttttcctcctagccgtgttactttggccgtacatccttctatcatcccatgcagctgggaatgggggctgccattttcattttgatcaaccattcctcaaaagggcatttagagagtcattagggtctagagtcatgaaatgagtagaataacagaaggtagcatgtcagaagaccatgggcagcccccaggctgtatttgcagtccccgttctgcataatgtgtccagttggtatgtaatgatgcacgcacagaagagaaccaaacactcaaatgttttggctataatcaaaattataccttgagtttcaatgtacttatgtctttgaaaatggtattttaaggaccagaaatgtacacagtgttctgtgttttcaatacacaaaaataaaccttatgcacgtaagtgtaggcctcactgctgggctgtattccttcctaccacggaccctgtaaatactgtagaactatccaaacaacatctaaacttcagatgtaaaattcctaactcctaatattacaaacattcaactattttgatggaaaaaataggaagcatgacaatcatttataagagaaagaaaatatatttctcaatgaacacagattccttgacatggacactttcctgcagcttccgaagacaccagcagtggaaggttatactattcatcgatggccagggctggttgcaggagatattatgatgctttgaaggttgtcctggtcatctttataaaatatatgtcaaccacacctgctgaggctacagagcactgacagagggtaagagactagagaaggaaaagctttgataagatagctgaagataatcagaaaagatggtaactaatcaaataaacatcctcttgcgtgcacaatgtcaggaatgcagctctggaaacaatgcctttgtcagagcactgttagccgtagggtgtgtgccttcctcctcttgtgcttagtgtttggagaatttttgttcgtttgtttgagacagagtctcactctgtcgcccaggctggagtgcaatggcgcaatctcggctcactgcaacctccacctcccgggttcaagcaattctccgcctcagcctcctgaggagctgggactacaggtgcccaccaccatgcctgcctaatttttttgtattgttagtagagttggggtttcgccatcttggccaggctggtcttgaattcctgacctcgtgatccaccctccttgggctcccaaagtggtgggataacaggtgtcagccactgtgcccagcctgagaattttaaaaagaagtagaaaagtgctattcttgattaagcagctgtcatatcagacactggagaatgtggcccaagctcacatggttcatttctgcaacagctcttgcaatctatacattgttgtcaccactctatggggaatcaatgagaatggtggcagaaaagtactctgctgaatggtgaggcagatataaatctggcctaagtgaaacaaaaaactctccatttttaactacactttactggctccaggactggacattttcaggggtagtatagggaaggactaaggatatcgagggttcttggatgaaataatacatagattgttggtcctggctgagtgcagaaacaagggaaaacagcagggcttgaaagcttaggagaaaatggagggaggcaagaggttggaggacttagtggattcatggagaacaaatagaaatacggaagttagaaggagagtgataagaggcaaggcaaagtaggtgatgaaattacccaaagtatgactctgggattgggttgctgaagaagagataataaattctttaaagtaagtaagagtggtgaagtgcttatcccatgtgacttattagagacagaatctgaaatataatttgggtttacattatgaaatttagtgcattatgccataagaatgctgtgtctcctaatccattatgttcgttaaggtggagctttacatgtgtcttgatatctgagtataatcttttgcaataaattacagaagttgtctcatcactaatttggggtgtgctgattttgtttctaagtttataaaatgaaagtcttgatttttgttggttaaatattttgaaaaattgcagttcaagagcaaagttatgttttactcatcagttttttgaatgaaaaattatgtgaacgagataacttttgtatgaatttttaatttttagtaaagttacttaagttatgtttattctccaaaatattatcagtcacatttatttagtgctcaagactaaataagaattttagacagattctcgctctgtcgcccaggctggagtgcagtggcgtgatctcggctcactgcaagctctgcctcctgggttcacgccattctcctgcctcagcctcccaagtagctgcaactacaggcgcccaccaccatgcccggctaattttttcgtattttagtagagacagggtttcaccgtgttagccaggatggtcttgatatcctgacctcgtgatctgcctgcctcggcctcctagagtgctgggattacaggcgtgagccacggtgcctggccaatttttttaaaattatgaaactaggaaacattgttctattaaaaatatttttctctatctattcacagtaacactgaagaatgcagtttacttacatctttttctgtttgacagaagacagttattagtaagtataattattagataaagtatacttattttccatgtttaaaatatgaaaaatatgcaatataggttggtactaagaggggaaatctgcttctgatcaaaattttattttaaatatcatttttatttcttttgtcctaagttatatactttttcttctattacttattgcaaagttactttaaaagaaaacaaaatcaaagaaagcaatcaaccaagattttaaaaataataatagcagaatctctcctcaattctttcctcttctccactccatcttgccttcacagctttttttgtttccaaaggtagtcaaaacattttagatatttatgccaaagggcatggatctgtgataccgtgggtcctgccaagctgaaggttttcctttggccaagataagttactgtggaaggaaagtaactcttccaatccacggttcttagaaaattatacttttatactttttaaattttaaatgaaatgccccacagctttcaatgcatacccagttcagagaatttgaatatcatccaacatgcttccacagtgatcccagtctgagaggactgtgttattatgtaaatgcatagcttgctttctaggtaataaatgataaaactcttcatacaggagaatttggtcttcggtgtatttctatatgtattgaaggtttgctgtgaaatcactctggaatctctcagctggtctgctccacagtatcctactggtcttgggctttgtatattaactttccagaactcatgctcactacagacttgctttagggcctctaaatatttgttgcttttgcatgccaagagttttatccttatttttggagacaggagaggatgtgagtgttgaattgtatttcaggttacccttgggacatcaaaatgaccaaggcagtgtctgctaagtatttgctgagactctgctatgattctttcaagtctaaagacagttatctgaatgatatccccgtgacagtggactcctgcacattcacagtcctggaaggagcctgtccacattggcattctggaagtccataaaagacaaacgcatatgcagtccccgagaaagcattgttgtaaacaaatctgcactagatggaaactctgttatgtggtgccggcatgcatggaagagtaagtccagaactacacctggaagttctttttactaaaagaacacacagttcttttttactttattatattgtattttattttattttgttttattatactttaagttctagggtacatgtgcacacatgcaggtttgttacatatgtatacgtgtgccatgttggtgtgctgcacccatcaactcatcatttacattacgtatatctcctaatgctatccctcccccctccccccatcccacaacaggccccggtgtgtgatgttccccgccctgtgtccaagtgttctcattgttcaattcccaccaatgattgagaacatgcggtgtttggttttctgtccttgtgatagtttgctcagaatgatggcttccagcttcatccatgtccctgcaaaggacatgaactcatcattttttatggctgcatagtattccatggtgtatatgtgccacattttcttaatccagtctatcattgatggacatctgggtttgttccaagtctttgctattgtgaatagtgctagaataaaatacatgtgcatgtgtctttatagtagcgtgatttataatcctttgggtatatacccagtaatgggatggctgggtcaaatggtatttctagttctagatccttgaggaattgccacactgtcttccacaatggttgaactaatttacactcccactaacagtgttaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagcgtctgttcatatcctttgcccactttttaatggggttgtttcatttcttcttgtaaattagtttaagttctttatagattctggatattagccctttgtcagatgggtagattgcaaaaattttctcccattctgtaggttgcctgttcactctgatggtagtttcttttgctgtgcagaagccctttagattaattcgatcccatttgtctattttggcttttgttgccattgcttttggtgttttagtctttgcccatgcctgtgtcctcaatggtattgcctaggttttcttctagggattttttttttttttttttttttgagacggagtctcgctctgtggctcaggctggagtgcagtggcgcgatctcgactcactgcaagctccgcctcctgggttcacgccattctcctgcctcagcctcccgagtagctgggactacaggcgcccgccatcacgcccggctaatttttttgtatttttttagtagagacggggtttctccgtgttagccaggatggtctcgatctcctgacctcgtgatccgcccgcctcggcctcccaaagtgctgggattacaagcgtgagccaccgcgcccggcctcttctagggattttatagttttaggtcttacatttaagtctttaatccatcttgaattaatttttgtataaggtgtaaggaagggatccagtttcagctttctacatatggttacccagttttcccagcaccatttattaaacagggaatcctttccccattccttgtttttgtcaggtttgtcaaagatcagatggttgtagatgtatggtgttatttctgaggcctctgttctgttccattggtctatatatttgttttcgtaccagtaccatgttgttttcgttactgtagccttgtagtatactttgaagttaggtagcatgatagcatcacaattctatacacatttcaggaatgatttttttaaagagacacctcaattcttaatgatttttaaatttttgtaaaataatcaaatgcaaccaatggactgattgaataaatctacttttccctttttgttgatgggccctaaatttccaagtcttctgtgtataaggtgggcttaattttacaaatagtcattttgaagttaaaataacttgttttctgtatacccaattttaaaattcagaatgccatatcagccactttatggataatttctcacatacttctttctctgaatatgagaattttaaaaatttatgcaaaaatgtttcaacttacaatggcatattttaatataacatcttcaatttcaactttttccttttggatatacttttatagaaaggaattcagtatttattaaaccactattttcttcatctattggcagtgtgtttaaggaattcagtttataccttgtgggaatctttttcagataaactgtatatcaagtagttttgtggtgtttgaaggaactttttggcattcagggccatttcttgtgctgtacaaagcagcccttagtgctttctggagagcagactacttaaaattcatatgaacacattcgatgtgatgtgtatgtttagaatcactattgaaatatttctctatttaattggggtggttcatgctaattcacatggcggacattggcagctattttcagtctaccaattttttcttcgggggacatagtaaaatctctgcttccataaatgtttccactttctgaatgcagcagttttcccttcttcttctagctctttcttagtgggcagagagaacaggaaatgctagttgttgcaatgcaagcctggcaggcaagcacacctctcttccccaggaactgagtaagccacgatgctcaactccagtgactgttgaatttcaacagctgcaccctctctttttacccctggtgtcacatagagcatatgctcttggacattcaggaaatcaagtattgcttccattctggccatggtgctagaaatgcagggttttatctctttacctcaaccatttctgtctcctccctcagctcctaggaagctgctgactcacccttttcttgacaagtccttctgggtagtcttcctggatagcatctgagatgaaccccaaactggcacactttctatctctttctgtctgccacatctggaatcacaataaagaggacactactggtaaggacttcaaatgcatgtcaaatggtcagagccatgggctctaggaacaggtgccagcaagtcacaacaaagggttaaatgagaccaatctgcccactccacagtgggcacctctggactctgggtggatctgaggactcttctttggtctgaatatgttggaaacttatttgccagtgaaacagttttgagacatgaaacctttaagaaggcagagccctcataagtggactaacaccattatcgtggaagtgggttcattattaagagagtaggcttgttataaaagcaagttcagcctcctcttgctcttgctcttgacctcttttgccgttccactttctgtcatgacataatgcagcatgaaggcccttgtcagatgtcggcatcatgctcttggacttccagcctccagaaccatgaaccacataaacttctgttcatcataaattacccagtctgtggtactctgttacagcagcataaaacagactaacacagacccatcatctcctgacacagatataaagtgaatccctagcaggcatctttgtccctcagaaaagtcctggaggccaagtagtggaacagcagcataccaatatctttcccacaaaaaacctttctaatttcgtgtccaatatttctaaaagaatggaggcaagtggtcttccgagggtccccaaattattcccagccgcctccttggcaaggtctgctttgatggattcacagattgttctgcaatatgagtagcattgacagttactatctttgggcctcagtcaaaacagagacagagaatacccatttaacaggcactccaacttaggtatccacagaacgtatagttttgttattctctatcatgggcctgctcttgccaatgtttcagcagatagctgcgtagtttagaatttctagttaataatatttcagtttcaactgtctcccttcagtttaatatggggtgtatttaaaataaatacaactccctattagatattaaaggattgttttggaacaactgagtcctttcagataaatcttcaatactctacttttctctcacttctctcactcttttttgtttgtttttttgtttgtttgtttgtttgtttgagacagagtctcactctgtcacccaggctggagtgcaatggtgtgaccttggctcactgcaacctccgcttcttgggtttaagtgattctcatgcctcaatctctggagtagctgggattacaggcatgtgtcaccacacctggctaattttttttggtagtttttgtagagacacagcccaccttggcctcccaaagtgctgaaattacaggtgtaagccactgcgcccagactcactctcctttacttctccaggttggtggctgtgtctatgaggagtaccctttctatgtctgcaggaggagagtgggtccttgcatccacacagcagcctggagtgtcactctggacactctcttgcctcagcctcccgagaagctgggactacaggcatgtgccaccacacccagctaatttttgtatttttagtagagacggggtttcactatgttggccaggatggtcttgatctcttgacctcgtgatctgcctgcctcggcctcccaaagtgctgggattacaggcgtgagccactgtgcctggctgatagtttcttatactgtgaagaagctctttagttcaattagatcccatttgttaatttgtgctttgttgcaattgctttttgtgtttttgttatgaaatctttgccacttcctatgtccagaatggtatttcctaggttattttccagggtttttatagttttgggttttatatttaaggcgttaatccattttgagttgatttttgtgtatgctgtaaagaaggaatccagtttcagtcttctacatgtggctagccagttatcctagcaccatttattgaaataagaagtcttttctccattgcttgtttctgtcatatttgtcaaaggtcagatgatttagatgtctggtcttatttctggattatctatttggttctgttggtctatgtgtctgtttttgtaccagtatcatgctgttttagttactgtagccttgtagtatagtttgaagtccggtaatgtgatgcctccagctttgttatttttgcttaggattgccttggctatttgggctctttttaaattgtgtagttaagtaatgttaagcacattcacctgaataatcttgccaaagtaaaactttataatcattgaacaacaattcccacttttcaactctccccaaccctggtaaccactattctatcttgtgtttcaataaattttgctactttaaataccttgtaaaagtggaatcatacagtatttgcctttttgtaagtgacttatttcatttagcccagagtcttcgaggttcatttatgttatagcatgtgaaataatttcctttgtttttaaggtagaataatatcacactgtgtgcctataccacattttgtttatccactcatctgctgatgaacgtttaggttgcttccaccttttggctgttgtgaatagtacagctatgaacgtaggtgtgaaagacctcaagatgctgtttttaattcttttgggtatatactcagaagtgagattgctagatcatatattcaattttttgaaaaaccactatagcttttgagccaatgtttcaacagatagctgaataagttagaatttacagtgaacaatattacagtttcttccagtttcaactgtctcccttcagtttaaatatggaatctatttaaaatacaccccccattcgattttaaatgattactttggaataactgagtctttttaggtaaatccttaatacttcactttccatagctgttgcaccattttacagtccccacagtgcacaagagtcccgatttctcgacattcttgtcaatagttgtgattttacttatttattttggtagtattcatctgaatgggagtaaggtgatatatcattgcattgcaattggttttgatttgcatttctctgataattagtcactaattattattgagcatcttatacttccgtgatgacgtgggaatttttcttcattgtacaacagatatcattatagtggcgtagttctacactctacacaattttttctaacactacacaaaagcaaacactaaatctaacttccaattgtcaggattactggtctactcctctacccacccataggctgattataaatctttgaaattaattacatctaaaatttttctttcctgtcaagtcactgttgacgaggttcctctgctcacattggcagtctctttctttctcatgattcttcaagtcgtcattttgttagaggccaagctttcactcatggactgaagttatattgtgtgctttttgcctgagtgtttaatcccttaatttacaagcggatgtaggagtgcatacccaggaggtgagggcaaagactcccgttgagtctttggaatctcaaatctgttaccgttttggcttgggacaacaaacatcctgtcagtctcaattgctgtataattgaaaagagaatgataacagttgtcctacatacatcataactctctttgaatcaatgataattaatccatgtgaaaagctttcaaaaacttgtaaaaatccctcataattatatggtgttttacaatttacaaagaactttcacatgcagatttctcacgtgatttttatgttttgagggcagagtgagaaattataaagtatctgtgtatatgccaataatgatgcctaatatcccccactttacatatttaaaagacctttaaaattatggcttttcctagttttcacagcacattaaaaaagccaataccactacacaggtgtgtagtttctggtcttgtgcactgaccatttcctacaccatctttttgtatgctctctagcttccgtagttgttactcgagtagaagagtactgaaaggccacgtagaatatacagcttggtttcatcccactgataaaaatctacttttaacatacatgttaaaataatcaagcctgactaaattatttttgtattttttccattttacctgttatcaactttttaattaagcaatggggccatggtaggcagggtattccctagaacttgtgaatatgttaccctacatgacagaaggactttcagatgtaattaaacttaatgacgttgagttagagagagggtcctgcccagtggaatcacaagggtccttaaaggtataagaaggagtcagaggacagagtcagaaggagacgtgctgatgtgagaatggtcagagagatacaaccttcctgtctttgaagatggaggaaaggggccttgagccaaggattgttgttggcctttagaaactggaaaatgcaagaaaatcaagtctccctaaagcccctagaagggaacacagtccaactaattcatttattttagcccaggagatccctgttgggcttccgacttacagtactggaagataatacattcctggtggtttgtgtcacaaggtctgtagtactttgttccagtatcagtagaaaaccggtagaaggggaattcacgtaaatatcattacacacagaaataattacttattattcttttgttctcaaatcctaccttgtaaacaaaatgaatttttgtttttcggggcttttgtactaattcttatgaatccactgatattttgttttttctgtcgtctccctcaggaacccgaaaggaagaagctatacgactggggacacatgtcttagaagcacactcattagataaagtgtcgcatactctttgataaggtaaggctccctggacgagatgttttacaggtaccatgagctcagtgaattgcttttggaaagacactcagcggagtgggcaccacgaggttaggagaagcagcttctgctcgtcataactttggcaaatgtttacacatcagtaatgaaaaatattctcttggcgatttcaggcttgttactatggatgttgtttgctaacattgactatttttcctaactgcttatagaaactccaggctgtcacccatctgttctctcatcaaagtagttttgggccagcaactatttcagacatttctacagtttcagatgtctcactctgcctatgactgtatgttgtacttgaggactggacgcacagggtaaagtgcaaatagcaagcattcaggtccaactctcctccttctggttaacaatatgaaagaaagaggtagtatcggaattattttagttcaatgtagccattataaaatgtgtatatattttaaaacatcatgtggtacatgataaatatatacaacttttatttttcaataaaaaattataaaaaaagtcatcaaacctgatttctcatactacttttttggtaacactcatcacaccaaagacttattattttaaaatgttatttttcataattaatttcttattaattttataggctagattttaattgttatgtctaaatagtagtgtctggtacgtggtagataatcaatgtgacttgaataaatgaataagtctgttaacgacatacttctcatcactgtaacttatttttggtttaggactgataaaacattttttctctcaccccatattgctaaagatcaaatccttcttctttaagatgctaccataccattgttccattcatcaacgccaaatcattcctcgggcctgagaggagctgccatccttcacttcgtctttgggtcacttccaacctctgttctctgtgtgtctcttctggacttcctgggagaatagcctctctcatgatactcactttcttccacatcttcaatctctgcttcattgatagattatgctactcaatatagaaacaacatcttttttattttttaatgataaacattctccccctcaatcttttaacctactaatgcaggcaatctaatctaaagaatagcctgcaatgcctcctttcatcatttcccatttaatccagctttctggctgagtaattttgcagaaagccctttctcccatgtcacagatggaactttgcagtggcctattctgataaacatgtggcagtttacatgctatttgcatttgaagctgtttatcactccctccttctgagtactttcttcttggtgggcttttatgatagtaattgctatcctactgctgagtttctgaccactgcttgtcagacactttattatgctccctttcctttgcccatacttgcaaagttagatttccacatatgcctttcccgtcttcttattccatgagatttatctaagtgatttcatccattgctatgggttcaactgctgctaatatgttctttactcccaactctctttctacagcttcacatatttaactgccttttagggaatcaccaaaaggcaattccatcttaacatacacaaaactgaacttatgatccttaagtatgaggccagttctttcttatgcattttctaaatcagtgagtgatactatctcttgtcctgttgtcctgggcagaattgcaggaggtgaccgctttctctaccctccctataaaaattaccatctctcgtttaccaacctcccaataccccaatcattagtatctttttaagaaatgattttctgttgtttaacattttttatatgctattacctatatggttttcctcctgaaatgggatattgggtaagagggtaccagatggaggtcacatagacctacagtttattcaaaggggacatctatggagcaaaggcaaaatggagaacccagtgcagccaaacagctactcaaaggtctgagcagagatacagaaatgacacaggagataacagaaagagagagacatatcaagtgggttttgagtgtaggcaaaaccacatttacccgtagctctggagaacccactggcactgttttgagactgttgcagcctgcaagggagggcggacactgagttcagacacacacaccctccgaccagctcccaaatgtctgctgacgtttacaactttgcttcctgctttcctacctggtcttagccttttgatacacaccctcccactgctatcagagtaagatttgagctaagtacataatctggccctgccagattatgacattagttggagaatagataggtcaatgggacctgagatacattttagaaaaatattaatatgtatgccttatgtatagtgtgcagctggcattttaaacacgtggaaaatgatgaaaaatttaataaaccatgagaggaaattggataaatatttccgatacacacacacatcagattcccttttttatgtcacatgcaaaactaaaataatatttgaatggcttaatcagtgaaatatttttctaaattaactaacataccggaaaatatttgacttatctcaaaccaaatatgtatttttattgtatagggttttttcttttttaaaaaatttcagcttgcaatttagatataggaggtacatgggcagatttgttacaatggactattgcatgatgctgtggtttgaagtacgtttcccatcaccctggtagtgagcatagttcctgataggtagtcttttttaacctaacctccctccctccctccctccaccgtctagtagtccacagtgtctattgtgtctcatatttatgtccatacatgctcaatgcttagcttccatttataagtgagaatatgtggtatttggttttctgtttctgcattcatttgcttagatcgccccagctccatctatgttgctgcaaagaatgtgattttattcttttttatggcgtatagtatttcatggtgtttatgtaccacattttctttgtccaatttcctactgatggtcgcctgtgtggattccatgtctttgctattgtgaatagtgatgcagtggacatctgagtgtaaatgtgtttttggcagaatgatttattttcttttgagtgtatacccagtaatgggattgctgagtcaaatggtagctttgttttaagttttgagaaatctccagactgcttcctcagtggattggtctaatttacattcccactaacagcgtataagctttcccttttctctgcaatgttgccagcatctgtttttttgactttttataatagccattctgactggtatgagatggtatctcattgtggttttgatttggatttctctgatgattagcgatgctgagcgttttttcacacatttgatgtatgtcttctttgagaaatgtctgttcatgtctttgcccatcttttaatggggttaattgggttttgtttgttcaactgtttaagttccctatagattctggatattaggcctttgtcaggtgcatactttgcgaatatctcctcccattccctagactgcctgtttactgtgctgatttttactctctgtttattttgctatgtaaaagttctggagtttaattaggtcccacttgtcccgtttttgtttttgttgcaagtgcttttggggacttagctaaaaattatttgccaaggctgatgtccagaagaatgtttcctaggttgccttccagaatttttatagtttgaggtcttacatttaaatctttaatgtattttcagttaatttttgtatgaggtgaaacggaggggtccagtttcattctgctacatatggctagccagttatcccagctgtgtttattgaatagggagttctttcccattgcttgtttttgttggccttgtcaaagatcagatggttgttggtatgtagctttatttgtttgttttctattcttttgcattggtctatgtgtctgtttctgtaacagcaccatgctgttttggttactgtggctttatagtatagtatgaggttggaaagagtgatgcctctggcattgttctttttgcttaggctttctttggctgttcaggctctttttggttcaatacaaattttagagtaattttctaattttagtaaattttctaaagtaaatgttctaatcctgtgaagaatgacgttggtaatttgataggtatagcattgaatctgtaaagtgctttgagcaatacggccatttttacaatagtggttttggtactgaaacaccaggtgctcagtctaggtcctgctgcttgctgcacagaaagccaatgactgagacagcaagtattgccaaggaagaagctttaatccggtgctgcagcagaggaggtgggaactcagtctcaaatccatctctctgacctactaaaaccagggatttatataacaaggaaggaatgtaacattgtgtaagaaaacaggaactagggaggtgtcaggaagcaatcgcgatgaatgaggggtacaacatctcattgtctggatgtgatgatctactgagtttcagttctttgacactttttgtgagaggcctgaaggtcatttcctcaggaaggaactcagataaaacaaatataagtttcaagctttaagaccagaagggtcaatttctatgtttattaaaaagaaaaaaactgttagactgggcgtggtggctcatgcctgtaatcccagcactttgggaggctgaggcgggcagatcacgaggtcaagagattgagaccatcctggccaacatggtgaagcatcatgtctactaaaaatacaaaaattagccaggcatggtggcacatgcctgtaatcccagctacttgggaggctgaggcaggagaattgcttgaacctgggaggcggagggtgcagtgaactgagattgcaccactgcactccagcctggtgacagagcgatactccatctcaaaaacaaaaaccaaaaaccaaaaaaacaaaaaaaaaaccaaacaccagaataaaactgtctatgggacaattgggtcagctttagtttttccaatccttgagcatgggatatttttccatttatttgtgtcgtctcatctcttatttctttcagcagtgttttgtgcttctcgtagagatcgttcatctccttggttagctgtatgcctataggtattttattttctttgtggctgttgtaagtgggactgtgttcttgatttcaccctcagcctggatgctgttggtgaaatatgtatttttaaaaaagaaaagcaaaaaaaaaaaatagatagacttgactaaacaaacattattataaacaagaatgagtgtcaatattcttttccataaggtactcttacaaatcagtgtaaagaattataatttctctatttaaaaaaggagatagcattgccagttcacaaattgtatataagtggcctatgaatgcaaaaacctcaattgcataagtaataaaaaagtctaaataaagtgatattacaaattgtataaaagtggcctataaatgcaaaaaccttaattgcataagtaataaaaaaagtctaaataaagtgatattattttctactgatacaattgatggggagaaaaaccaaaataaagtgaacagaagaaaatggggaaaaagggagccttttagactgctagtgggagggtaactttgtataaactattagaatacaatttgtcaatccgtgttacaatcaaattgttcattcactttgtaacaacagttctatttctaggaaataattatagatggcaactatttctatataaagcttttcattacaatgttaaatatgataaaattggggatactcaagtggtcactaataggagcatgactaaataaactttggtagtgacagtgaatagaataccatgcatctattagaaatgccttttagaaaataaagtcaatggcatggggatacagacataatttgtaaagcagtataactcaaatttgtagaaagaaattacaggacaaagactggtactgattcaaaatggtgcctggctacgacgggcctttgtccccagaattaagcctggagaattgtcctcgaagtaaagcaggtgctctacgtgtagaaagctcctggtgcggatgctggactctgagagaaggctgagcacagccttgggtaatgcagaacttcctcaaaaggcaaggaggcaaaaataaaacaagtgaagagcaactctcttagaagaggaaatgcactcaagcccttgggccacagagaaaagtgctcctgaaactggaaactctatggtctcccagcctccagcctgcctgctcttcagtcagtcaccctacaggtgacaccccctgcattccccactctcattttcagagagctgctgccgggaccctcattctgggaatggactatgaggaaggagacctacatagttgtcaaggaaacctatgccagttacatatgccatacattttaatcgcttagttatcaatgtgacaggtagggagaaaacaccaaatgcttgaggaaaaccaggggtatgaaagagaagcattaagattactttttaatggaaatgtatatattcacctaggctattcttccttacccaagttgaaactgaatagtatgacctaaacgtacatttcgtgtgctgggaagaaaaagcaactgataaccccctttcccgtaggtttcctgtcattaatttgctcaccagtgcaaccccattcaggcccccaagctagtgccatcttgtgtgcacaaggctggggcaattggattcataagaagttttgtccatgaggaattttcagtctaatgccaagtaattgacaatgaaaatgtttcctggtttccatccaaatatttattaatacagcaaaaatgtaggatttgtaggatttatgtatcttccaactatctccactactgcaggacacagacaccatctataaatctcacattgtaaccactaacacttatctttgttattgtcacctggaatcttttatgccaaaataagagtcttaaaagaatgaagccctgcaatttcactgtccaacaacagaggttttacctgataaatcgtcttctcgtctgacagagtgggccacagaaacatctctgacagctgttgcatgatggagtgggagcaaggtcacttcctgcaaatgttagggttcttcagaatccttcaggcgttggaggaataattgaactcaacaggcaatcagtcacgtctgaaacatgtgaaatatacctaaggacccgaggtcagggttgagtgtccaaattcaaccagttattcacacggtctgaaaatgaaaatgtttcatttcagagaagtttatatggagtccttgacagaatgttgaatatgaaatagattttttttctgtcttcctttgaaaatctttgtggataaagcttaacatggtgcattagaatcttaggagtaaaatatccctcacaaaatttgatatcttatctgattagttaatacagacatattacatttttcaactaattttttttcttaagaagaattctttcagaaacggagaagcatgtagtaacatactgattttaaggaacctatgctaacaattttaagtagtaaaacttaaaactaaacttaagaagtaataaaaaggtgataataggataattactatttggcatcctactaagatatttagttggcaatttaattttaaattacctggttttctctgatattcacatattattaaatgcaatttcatttaagctgctctactaagtgttagggaaatatgaaaattgaaagtgtgaccttgttgtccagtaaagtaattttatcgaatttggtagactcttaattgtccctaagtattcattttccctttctttttttttttttattgtagcttttcttttgaaatatgcgttgcctcccagacattgcaaaatggtatagtgagttctggtgtattcttttttttttttttttttttttttttttggagagacggacttgttctgtctctcaggctggagggcagtggtgtgatcatggctcactgttgcctcgacctcccaggaacaagcgatcctcttgcctcaacctcctgagtagctagaactacaatcacccctcaccatgcccagctaatttttaaattttttgtagagatgaggtccgctatgttgcccaggctgatttagaactcctggcctcaagggatcctcctgctttggtttcccaaagcgctgggattcaggcatgagccactgtgcccagacttaattctggcgtattcttaagccagtgtcccctaatgaaaatatcttccaggacctcagtgcatggtccaaatgaggaagctgttaagaggtacaatactattaacacatgtacatacagatttcaacagcatttaagttcagttttttctttctgtcttttgttttgtgtttatagttctttttctgtcttcctttgaaaatctttctggataaagatgtttccacagatttctgtagatgtgttcagccatcaccacccagtcccagttagaatcagggtacagaactgcttcatcagtctcatgagaaggtgtgactgaaaggagcagtgcaaagatgctcctttgtcctttcagtcacgctttctccctgactctgacctttggcaccagctgttaggtcttcacactctaattttacactttaagaaaggtatgtaagggcagggtgcagtggctcacacctgtaatcccagcactttgggaggccaaggtgggcggatcacgaggtcaggagatcgagaccatcctggctaacacggtgaaaccccgtctctactaaaaaaagtacaaaaaattagccaggcatggtggtgggcgcctgtagtcccagctactcgggaggctgaggcaggagaatggcttgaacccaggaggtggagcttgcagtgagctgagatcgcaccactgcactccagcctgggtgacagagtgacactctgtctcaaaaacaaaaaaaaaaaagaatggtacgtaagtagaataatgtaggtagcaccattttgagattgcttttttttcattcatcataaagccctacaaatccacctaagctgttgcctgcattgatagtttgtttctttgttttgtgtcacagtttgtctatttattcacaggttgaaggatgtttgagtggtttcaagtcgtgggctgctacacatgaagcagcaatgaacatctgtgttcacattcctgtgtgactgtgtgtttcacttctgtagcataaatacccaggaggcctggattgcattgcaaatatgtttttaactttgtaggaaacagccataccaccttccacaatggttatgctgttttccatttccatcagcagtgcatgagaaagcctgctgctctgcgtgcttgtcagcacacggtattgtcagtatttttattttagccacttattaggtgtgcattgatgtctcattgtagctttaatttgcatttccctaatggctaatgatggtgaacatctttttatgtgcttatttgctatctctataccttccttgatgaggtgtcaacaaatgttttgcctgttttcttgttgttgaggttgcagcattctttatatggtctggataaaagttctttcttaggtatgtgatttgtaaatatttcttccaggcaatagctaactttttatcctcctaacaagccctacttagaactgaagtttgaaagtttgatgaagtccatattaccaatttttttctttcttagacatgacaactttttgtctaactcttgcacaggaagatttttttcctgtgttttcttctagaaatgttgtagtttcacactttacatttagatctatgatctattttgagttaatttttatagaaagtgtgaagtttaggtctagctttttgtttgtgtgttttcttttttggcctacagtgtttaattttcccaacatcttttgttgcaaattctaatcttcctctatgggattgctttgcattttcattttaaaaaattaagttgactgcacctatgcaggtctatgtccagttcctttatcctgtgccattgatccgttcctctgcccaagccacactgtgaggctgtcttcccaagctcctccctttccaggatctccccggccacagcttctcctttcctcgttttgatcatctagccagaaagctgggcttttagttactcagctctgctgtgcacatcctgcaactgcggctgctccaagcaggagatacagagaaaaagaagccagtcttttcctcaccaccttagaaagagaggtccctgccttgaagctcacgctccccgcacctgctgccttcacagtccttaccctgcagagcgcggcttgagagaggagaggggcgagcttgggatggtggatggccctcccagctctgagctttgggggccagagctaaaagagaggctgctgtctccaagttgccttcaatccaagctggagaattctgcagacaaatagggcgctttcctccactttggtagtacttcaaaatcttgtcttcttcctcaatgcgtcaactaccacccagttttcagagccctccaacctcttttccctgcatttcttcctggcactggatccctaagtactcagtttaatccatacattgcccttatcatttctttttttctttttctttttctttttcttttttttttttttgagacagagtttcactctgtctcttaagctggagtgcaatggtgcaatcttggctcactgcaaactcagcctcccgagttcaagaggttctcctgcctcagcctcccgagtaactgcgattacaggcacctgccaccatgcccagctaacttttttttttttttttgtagttttattagagatggggttttgccacgttggccaggctggtctcgaactcctgaccttaggtgatccatctgcctcggcctcccaaagtgctgggattacaggtgtgagccaccatgcccagcccgcccttgccatttccatcatctgtctttcacactggatcttttttcagttgttccaataaaccaagtggtaaaaatttgaaaagtgaatgtgagtaataggaccaaatttaaaaagttatagaattttagggttggagaggaacgtgaaagagttataatcaccctttcaagccaccaagctgagatgaaatgccttgccctaagtcactcttagccctctgatcttcctacgatgtcatgcgactttcacatagaaactaaaaggacttaccattaatttctcctctttcatttacacatatgaatttttttaaaagtctttctcatatcttgactaagttatactcacaaaacctacccatttttctgctgaatttattcttgaacttgaatacagtctcatgtggaaacagtaataataccaaaattgcaaataatctttatatctgacattgctcttagttaattctgttgctagtttggaaagttttttttttttaaaaaagaatgtttaaacatcattacgtttaaaacattttaaagcctgagtacgagttttaaatcagaatcactgacttccctcccttacacctcattattacaaaccttgatttgaaagccgtatttcctacaaagagtcaaacgagaaaaaacatactcctgtgtgaaaagaaatataccaatgtaccaaatccttatagtttctcttccccaacctgtgaccaatgttcaccctttggtgccagactcatctgttttacacacacacacacacacacgcacacacacacaccccgaaaacttgatgtaaaatgtaaataattcatattagacataataataaggaaaggaaagcaaatagcaaatgtgcctttgttgttaggagtgaagatgcaggttcagaattgtctgtgctgagtaaggataaggtcttaatatctgagaaaaggggtctgaatcctgaggaggatatacagaaagtggccttttgaattagactatttgggcaaatgtgcagaatgatggcgactgactgggcagaactggcgtatggcaccaggttgtagcaatggagatgaaataaaagggcctgatccctaaaagaactttaaaggaagaaacaacaggacccactaacaaatggaaaataagtgatgaaggaagataatcacaataatatgtagtgaatctgagtcttttggccagggaacttgtgacaaatatagaagtaccaaaaaaaaaaaaatagagacattcgaaagatggatatgggatggaaaaaatgaattgttcaggatgtgctgagcttgaaatatcaaggtcatattcaacagaaaaagaaatattgtgaaggggcccagatgtgagggtagggcaaaaaatgatattagtagaaaagtcatttgagtaaagaaagtggatatgttaatagggaaaacagagtgcttggcccagggcagaccctgtaagattcccatgagtaaggatcagcaggtcaaagatttaccagtaagaagacagaggccaatgagacaaagcaagaaagcccagagtccagagagcatgagggagtcctgtttcagaaggggagggtgactagccggaagacttggagaaagtggaagatgaagaaaatcctttgagcgggggagcactgtctggcttggaagatggtcctaggagataggtggggaaatggccagatttggggaggaagaatactggggaatgtgaaaggtctgtgcctagagaacaatgcgtcaggacatggtgatggaatgaagggattggacagcgctgaacattttaggagacagaaggaaaagaagagtgaagtgagacagaaagacatggaggatgtgaaagaaaatgtgaggatttatattcaaaataccaaaaagctttctaattcctagacttgcccccggctagagtgggctatctgggtgaagagtttatacagatatccccatatacactatttattctacttagataacactctagagacactatgtcctgttttcttgaaagactcataccaatggtgacatttcagatcttctaaggaagtttattttagcttcaaaataacacgggtggcacgggggaagtatttttagcctcaaggagcgttttaggccaggcacagtggctcaggcctgtaatcccagcactttgtgaggctgaggtgggaggatcatgaggtcaggagttcgagaccagcctggccaacatagtgaaaccccatctctactaaagatacaaaaattagctgggcttggtcgtgtacacctgtaatcccagctactcaggagactggggcaggagaatcacttgaacccggaaggtggaggttgcagtgatctgagattatgccactgcactccagcctggttgacagagcgagactctgtcaaaaaaaaaaaaaaaaaagagaggactttagtacttctgaaactcctctgtgtagctcttcgttcaagcaatcctaactcagaagtacaagaaggataatattcttgtgtgtgctctgaagctatttagtagcatcagaaaggtggagaataagtagcttataaaacattgacagctcttcaaattggactaacaggaaatctccaggcattttattcataattttggaagaaatgcaataacaaagatttaatgggtcccatattgtgaaacataattgatctagaataagtactattcttattcctatagacaatcatactctgagattttggtcaagtatcagttgattgttaattatctacgtgtttgaaatatatgaaatttaatagagaggccataagtcacatccaagaagtactaagagaaagcaccactgcaaaatcttggtaaattcagaaaataataacaaatctcataatgaaataaatattttattgggattataagacctaccatccaaagaaccattaggaactttacaataactcattaatttatatgggaaatatgacagaaagcaatttctgcttttacttcttttcttctttacttctttcccttagtgtgttttgcatgtgtgtttgtgtttccttgaatcgttgcttaatccaagaagctttcaattgacatcccatgtcagacgggaatgccactgtatcacttattgatttcaacagtggtagtttactcctggaaactaaaaccgttaggtgtttctaaaatgtatgcacacacacacacacacacaaacagagtttaagggttaagtatttatcttcctacctgtatttttcagaagaaagaagaaaaggaggatatgcttctgtactagagactactctttattagaaaagcacaggaacaattctcaacctgaatattttcaataaatgccttggtgaaaattactgaagtggtgctacaaaattgccttgtcttatttttgaggacatgtggaaagcctttctacaacttttagatatatgtaataaagctgaacattcttcacatcatccaaacttattagagagcttaaagtgtaatagtcaaatcgctagcattggttagtttgaatgaatagtccttttaagacttttttttttttttgagatggagtctcgctctgttgcccaggctggagtgcagtggtgcgatcttggctcactgcaagctccacctcccgggttcatgccattctcctgcctcagcctctggagtagctgggaccacaggcacccaccaccatgcctggctaattttttgtatttttagtagagacggggtttcaccgtgttagccaggatggtctcgatctcctgacctcgtgatcctcccgcctccacgtcccaaagtgctgggattacaggcatgagccactgcgcccagccaagactttttaaaatgcttccttcttcatggatctgggctcctgagtgagtgtgctgagtgaatcatgcatggtagcagacacctttcggaatccggcttcagtagacgtgagggtaactccagtgctcagaaaaggtcccttagcagctggacttgctcaaggtgactggatgctcgtcataagatttccaggttgggtctgagttatgtcaagtactagttggaattgatttattgctgtcttgctcacaagccaggagcacacttctgaagttgccaagagtgtgaaaaagcagatatccaaattgtgaagtgagtggtttcctacattaactcgaattgattttgttcttcctaatgctgataaggattattttggagtagaatacagtagccccctcttatccatggggatacattccaagaccctcagtaattgtctgaagtcccggacagtattgaaccctacatatactatgttttttcttatgcatacatgtctttaataaagtttaatttacaaattaggcacagtaggagactcacagtatctaataaattggacgattataaaaaaactgtaataaaattatgtgaatgtggtctccttctctccaagtatactatagtgctgtaatcacctattttcagcccatgctgacttctagtaactgaaacctcaaaaagcaaaactccagataaggggtttcatttactgtaataaaatgaaaattctgtaaacatgtttagttgaaaatatcttacagacatacataattcagtggaagcgatagtgatatgtttcagaaattcagattcaagatttcagaaattcagtttcaaggttcaaggctcctctgacaattgaatgacttagtttttcaaatataatcaagattctgccttgaattatatataatatatattattattatttccatatataatttatggaaaagttataaaattaatataaacatttgaaatactgtcttttggctcactttgaaaagatttccagtttgcttctaaatgaataacaaatttgaaaggccaagtgatttaaggcaggtacatcactacttagcaatacgatttgttcaagcaggtgaaaagtatgcaagaatcaaaatgctctttgcaaaaggagcttcaattttcatcaggaaaacccagtttgtgtcagagggtgaaacttgcttgactagatctgttcactgaagccattgaacaacttccgatgttcttgctctctcccatttacgatgctgaactttacagagacagactgtttgaagccttcctaattattcccattcttagccaagaaggattactaaagctcagcctctattgtaattcttaaacttctcagtgcaaattattaatatatggcaatctaaaatgcctttctctggctttatgacctgattattatttcgagtctctctagcagtgaacttgaggatcatgcaaacatgttctatgggaacatcactgtgtagctgaataatttgttttttagtaagctagctcaaatttatcatcagtcatgaaaatgttttatcaatgctcttccataaagcagacatattattttactagtttcagtttagccctgacagaaacctgatcgggaatactattattaagccacaaatacctgttttaaaatatgttgtcttatgctatttcattgtattgtattaataattcatgtaatatttcctttggttttattgtcttctgtgttataattaaaactgaaataatttgggaaatgtaatgtatatagcacacatctaaagttcagagtgagaataaaactacaactattttatctattgcaatagctcaaatagtagagtttaactataatacttggtatacatatcaaacaaggtatctatacatacattattttaattttactcctccctcattttctctccacgtcccatcacataaatatgcacaaatttaactggccagaggtgacctacattctctacatgcagtgtccatgatgaagatagcaactgtatttgctaaggttttcacagttcataacagtgaaataaaatgtagctatggacattcattgattaatctaatatttattgaaggtgtatttgttagattccgtgatacaatgatgaacaagtcattgtgtaatcatgaagagcttctagccaagtgggtaaaaagataaggaaatcatcccaattagtgagataaactacaagatagggaatcattccgtgtgttaccagcacattctacccacgctgtatttttcagggaaaggtggtgtacattacctgatgtctaaataggaggtaaaagcataaggtgctgggagacaaaggagttgtagattacctgatatccaaataggaggaaatagcataaggtcatggaagagagaggggtgtagattacctgatgtccaaataggaggtaatagcgtaaggtcctgggagacaaaggtgttgtagattacctgatgtccaaataggaggaaatagcataaggtgctggaagagagagggctttagattacccgatgtccagataggaggtagtagcataaggtcctggaagagagagggttgtagattacatgatgtccaaataggaggtaacagcgtaaggtcctggaagacaaaggtgttgtagattacctgatgtccaaataggacgaaatagcataaggtcatggaagagagagcgttgtagattacctgatgtccaaataggagggaataccataaggtcctggaagacaaaggtgttgtagattacctgatgtccagataggaggtaatagcataaggtcctcgaacacaaaggtgttgtagattacctgatgtccaaataggaggtaatagcataaggtcctggaagacaaaggtgttgtaaattacccgatgtccaaataggaggtaatagtataaggtcttggaagacaaaggtgttgtagattgcctgatgtccaaagaggagggaatagcataaagtcctggaagacaaaggtgttattatattacctgatgtccaaataggaggtaatagcataaggtcctagaagacaaaggtattgtagattacctgatgtccaaataggaggtaatagcataaggtcctggaagacaaaggtcttgtagactacctgatgtccaaataggatgtaatcgcataaggttctggaacagagagggttgcatattacctgatgtccaaatagcaggtaagagcataaggtccgggaagagagagggcagtagattacctgatgtccaaataggatttaatagcatacgatcatggaagagagagggctgtagatgacatgatgtccaaataggaggtaatatcataaggtgctggaagagagagggcattacattacctgatgtccaagtaggaggtaatagcataaggtcctggaagagagagggttgtagattacatgatgttcaaataggaggaaatagcataaagtcatggaagagagagggttgtagattacatgatgttctaatagaaggtaacagcataaggtcctggaaggcaaaggtattgtagattacctgatgtccaaataggaggaaatagcataaagtcatggaagagagagggttgtagattacctgatgtccaaataggagataatagcataaagtccttgaacacaaaggtgttgtagattacctgatgtccaaataggaggtaatagcataaagtcctggaagacaaaggtattgtagattacctgatgtccaaataggaggcaacagcataaggtcctcaaagacaaacttgttgtagattacctgatgtccaaataggagggaatagcataagctcctggaagataaaggttttgttagattacctgatatccaaataggagataatagcataaggtcctcgaagacaaaggtgttgtagattacctgatgtccaaataggaggtaatagcataaggtcctggaagacaaaggtgttgtagattacctgagttccaaataggagttaatagcataaggtcctggaagagagggcagtagattacctgatgtccaaataggaggtaatatcataaggtgctggaagagagagggcttaagataacctgatgtccaagtaggaggtaatagcataaggtcctggaagagagagggttgtagattacatgatgttctaatagaaggtaacaggataaggtcctggaaggcaaaggtattgtagattacctgatgtccaaataggaggaaatagcataaagtcatggaagagagagggttgtagattacctgatgtccaaataggagataatagcataaagtccttgaacacaaaggtgttgtagattacctgatgtccaaataggaggtaatagcataaagtcctggaagacaaaggtgttgtagattacctgatgtccaaataggaggcaacagcataaggtcctcaaagacaaacttgttgtagattacctgatgtccaaataggagggaatagcataagatcctggaagataaaggttttgttagattacctgatatccaaataggagataatagcataaggtcctcgaagacaaaggtgttgtagattacctgatgtccaaataggaggtaatagcataaggtcctggaagacaaaggtgttgtagattacctgagttccaaataggagttaatagcataaggtcctggaagagagggcagtagattacctgatgtccaaataggaggtaatagcataaggtccttgtaagagagagggttgtagattacatgatttctaaatagggggtaatagcataatatcctggaagacaaaggtgttgcggattacctgatgtccaaataggaggaaatagcataaggtcctggaagaaagagggtagtacattaccggatgtccaaataggaagtaatagcataaggtcctggaagacaaaggtcttgtagactacctgatgtccaaataggaggtaatcacataaggttctggaacagagagggttgtatactacctgatgtccaaataggaagtaagagcataaggtccgggaagagagagggttgtagattatccggtgtccaagtaggcggtaatcgcataaggtcctggaagacagagggttgcagatgacctgatgtccaaatgggaggtaatagcataaggtcctggaagacaaaggtgttgtagattacctgaagtccaaataggaggtaatagcataaggtcctcgaaaacaaaggtgttggagattacctgatgtccaaatagcaggaaatagcataaggtcctggaagacaaaggtgttgtagattacttgatgtccaaataggaggtaatagcataaggtcctggaagacaaaggtgttgtagattacctgatgtctaaataggaggaaatagcataaggtcctggaggacaaaggtgttgtagattacatgatgtccaaataggacgtaatagcataaggtcctggaagacaaagttgttgtagattacctgatgtccaaataggaggtaatagaataaggtcctggaagagagggctgtaaattacctgatgtccaaataggaggtaatagaatcaggtcctggaggagagggctgtagattacctgatgtccaaataggaggtaatatcataaggtgctggaagagagagggcttaaaataacctgatgtccaagtaggaggtaatagcataaggtcttggaagagagaggtttgtagatatcatgatgttctaatagaaggtaacagcataaggtcctggaaggcaaaggtattgtagattacctgatgtccaaataggaggaaatagcataaagtcatggaagagagagggttgtagattacctgatgtccaaataggaggtaataccgtaaggtcctggaagacacaggtgttgtagattacctgatgtccaaataggaggcaatagcataaggtcctcaaagacaaagttgttgtagattacctgatgtccaaataggagggaatagcataaggtcctggaagatataggttttgttagattacctgatatccaaataggaggtaatagcataaggtcctcgaagacaaaggtgttgtagactacctgatgtccaaataggaggtaatagcataaggtcctggaagacaaaggtgttgtagattacctgatgtccaagtaggaggtaatagcataaggtgctggaagcgagagggctatagattacctgatatccaaataggaggtaataccataaggtcctggaagagagggttgtagattacgtgatgtccaattaggaggtaatagcataaggtccttgaagacaaaggtgttgtagattacgtgatgtccaaataggaggttatagcataaggtccgggaagacaaaggtgttgtagattacctgatgtccaaataggaggtaatagcataaggtgctggaagagagagggctgtagattacctgatatccaaataggaggtaatagcataaggtcctggaagacaaaggtgttgtagattacctgatgtccaaataggaggtaatagcataaggtgctggaagagagagggctgtagattacctgatatccaaataggaggtaatagcataaggtcctggaagagagggttgtagattacttgatgtccaaataggaggtaatagcataaggtcctggaagagagagggttgtagattacccgatgtccaataggaggtaatagcataagatcctgcaagagagagggttgtagatcatctgatgtccaaatattaggtaatagcataaggtcctgggatacaaaggtgttgtagattacctgatatccagataggaggaaatagcataagatcacggaagagagagggcagtagattacctgatgtccaaatagcaggtaatagcataatgtcctggaagagagggctgtagattacctggtgtccaaataggaggtaataggataaggtcattggagagagagggctgtagattacctgatgtccaagtaggaggtaatcacataaggtcctggaagagagagggttttatattacctcatgtccaaataggaggtaagagcataaggcccgggaagagagagggttgtagattatctgatgtgcaagtaggaggtaatcgcataaggtcctggaagagagagggttgtagatgacctgatgtccaaatgggaggtaatagcttaaggtcctggaagacaaaggtgttgtagattacctgaagtccaaacaggtggtaatagcataaggtcctcgaagacaaaggtgttgtagattacctgatttccaaataagaggtcatagcataaggtcctggaagtcaaaggtgttgtagattacctgatgtccaaataggaggtaatagcataaggttctggatgacaaagttgttgtaggttaccggatgtccaaataggaggtaatagaataaggtcctggaagagagggctgtagattacctcatgtccatataggaggtaatatcgtaaggtactggaagagagagggctttagattacccgatgtccaaataggaggtaatagcataaggtcctgaaagagagagggttgtagattacatgatgtccaaagaggaggtaatagcataagatcctggaagacaaaggtgttgtagattacctgatgtccaaataggaggaaatagcataaggccatggaagagagagcgttgtagattacctgatttctaaataggaggtaatactataagctccgggaagatacaggtgttgtagattaccttatgtccaaataggagttaatagcataaggtcctgcaagacaaaggttttgtagattacctgatgtccaaataggaggtaatagtataaggtcctggaagacaaagatgttttagaatacctgatgtccaagtaggaggtaatagcataaggtcctggaagacaaagatgttgtagattacctgatttccaaataggaggtagtagcagaaggtcctggaagacaaaggtgttttagattacctgatgtccaagtaggaggtactagcataaggtcctggaagacaaaggtgttgtagattacctgatttccaaataggaggtaatagcagaaggtcctggaagacaaaggtgttttagattacctgatgtccaagtaggaggtaatagcgtaaggtcctggaagacaaagttgttgtagattacctggtgtccaaataggaggtaatagcataaggtcctggaagacagaagtgttgtagattacctgatgtccaagtaggaggtaatagcataaggtcctggaagacaaaagtgttgtagattacctgatttccaaataggaggtaatagcagaaggtcccggaagacaaaagtgttttagattacctgatgtccaaataggaggtaatagaataaggtcctggaagagagggctgtagtttacctgatgtccaaatgggaggtaatatcataaggtgctggaaaagagagggctgtagattacctgatgtccaataggtggtaatagcataaagtcctggaagagagagggttgtagattacatgatgtccaaataggaggtaatagcataaggtcatggaagacaaaggtgttgtagattacgtgatgtgcaactgggaggtaatagcataaggtcctggaagacagagatgttgtagattacctgatgtccaaataggagctaatagcataaggtcctggaagagagtgtgtgttccagtcagaaggagctattggttcaggatagctgcaacatacatttagtcattatgatggaaaactgataatggagttaggcctgatgttgagatgtataattgaagaagagtgagaggatcacctttcaattcacaaagatcatcatagggccagtataaaagtattttagagacaagtaataatggaattagggaaaccagttcaggtaaaaaatgatgttgttctagattttggaggtgactgaagagaaaaagtacatataattcacttatagctctgcttatcctattacgggtatttctttctaatggagattacagatgttatttttaaaacactttgtgattctgaggaggcatttacttatgggtctagttgtatcattagtaacaatatatattgtgtttatcttaagcacacttctctgcacattatctcaacttcctgggttgcttgatcggataaagcatttatatttgtcttctaaaatatgactaaatactatccccaatcaaagtgacataatattccatagttgtgcaaatgtttagtttttttttttttgtgccgaaagataagtcacaggctggggtatttgatttttcttttaaaaatgataaagcagaaggagagagaaagagaccaagaaaataaaattgtatacagtgaaacacagatgttatctgaaaaatggattttttaagagaaatataggtataaaaggcattcatgagaaatacaagaagagagaaagagaagtgaataaattaaactcttttaattattgcaacagctcaaatagtagattttaactataatatttgatagacatgtgaggtctttatacatatactattttaattctctctctatatatataatgaaatgttattccaaaatgcaatataatcccgtggaaaatttattcagtcggaaaaaggagaaaataaggttctaatactgattttagtgcctcaggcaagacacataactttttgggcatcaatttctatatctgtaaaatgaaaacacacgccctactatgtatatcatatgtaaatgtctaaaatgagataatagtattgaaaatggctttgaaaaaaaatacaagggattgagtcactctaaggaatgactgttttttaggagtcaacaagaggcaaaggaaataaaatttattccaactaaatgaaaaagtgttactgaaatgttagccttttttttttttttttttttttgagacggagtctcgctctgtcgcccaggctggagtgcaggggcgcgatctcggctcactgcaagctctgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaatgttagccttttaagaatacaaaaaaatctaattatatatgaatacaatacctgaacccatgaaacttctgtagaatacatgaatctgtaaagttatgtattctaaacatttgtagccagaataactttcttcatattttccacattcttggtacacttacgtgtcacacatgttccctgtttttcaaacaaggtcaatgttttcattatatacatttacattgttattgtaactattttccaggtctgtcagtaaaatttagtctcacacattgataccacattcttgcaattatattgtaattctcacatagtaattcaagcctttttgaatatacaaatcatctgaatttattatatcactgctatgacacctcatacacatgttgagaccatttatgccagaaaagattagatttagtattcaaagagccaaatgtaaataattctggattgcttatccaaatggggaactcagagaacttctatagtttaaatatgcaaatattcaaaagtaatttttttgtgaccataccctcctgctactgaatgtttccttgagctggtgtcagaagcagggtttacaatgttgtgctctatttcctgtttaacctattgccaagatgttaattcagagtgaaataataagaacttagtgagaactgggggtgataaacaaagtgtcctcacagcggagaaactggaaaatgtatccttgaaagcgtgtgaatcgggtgagcgtacaacgggtaacatcagtattggtgttctcactgctgggtcagcactgaccagcagagtctggtgggagccagcaggaccagaaacatgtcctcagtttgggccaatttaaagaagttgggaagctttctagagcccggccgtgtgtctctgcccttgctacaactcctccctctgtctcacagccagagatgcacccatgatgacattcatgtaggctattaagggcgagcatttctcggaaggtgaagcaagatatggtagtcattccaagaaaccttccttctcagctgcgatttgtcaagaggaaagaagtggagttttcagtggaaagcagatgtgaatttggagcagtggggcacttccagagaatgagcccgggtcaattttcataggcaattggcaacatgaatgcataggcactgggaagaatgtaaatggcaagtccaggaagcaagtagtagctaacaaatgcgtgaaagagtagaggagtaaaataacgatttcatcctctgaatgctgcccagagtcaatcccactgtaccccgtgcagagaaagtgactccaggagtgtgtgcccagtctagaagaaacaacaacactccttccatgtagagccaaaatcgtgtgtgtccctcggcctgaggagctggaagaatcctgaatcttctccatttagggcaggagttttagtggcatgtcaaatgtgcaacatcctccaagcctagaacctagaggtggttctagaacacttttcttccttgcttccacatctgtccaattacccacctcaattaatagttaccagaatattcccagagaatcataccagcacactctttgcaccaggaaggggtacagatatgttacaagaagagaggtggctgtcagagtggaccacatgtctttttatagtttggtgctttgtctttcacaataccagcttgccgtctagcaggggatgtctagcgtctcctacaaacatactgattatctaggaacatcatagcaccaaagaggccttctgccctcttccattcccacattgttaagaaaaaaaaaaactggttacgtaaattacagcatattcatttaatacttggaatataaaaaggggtggaaacattgttaaggcccctgtctgtgtaaggatatagaaagcagccaagatatatctgtaggtaactaaaatgcagatgtgcacaatgctgccatgcctgtagaaaacaaggccgggtgcggtggctcacgcctgtaatcccagtgcctgtagaaaacaaggccgggcgcggtggctcacgcctgtaatcccagtgcctataaaaaacaaggccagacgcggtggctcacgcctgtaatcccagcactttgggaggccgagatgggcagatcacagggtcaggggatggagaacatcttggccaacatggtgaaatcccgtgtctgctaaaaatacagaaattagctgggcgtgcctgtagttctagctacttgggaggctgaggcaggagaacctcttgaacctgggaggcagaggttatagtacgctgagatggcactattgcacactccagcctgggcaacagagcaagactccatctcagggaaaaaaaaaaacacaacaagcaagtacacaaaaacgccaaacacacaaaactatacagaacatatgatttttgccaatattccagggtaaaaacatctcaagagttgatagattccagagtctttgagtgagcacactcggttcctatccttgatcccctgccctccggaaggcctgtttctgtcttctccctcacactcaccacctgctatcaggactctctgctccctactgtcaagactagacgtgcctcagacacagattcctcccttcttcagcaggagttcccagggccgagttatttattctagaaggtgcccctggtgatagtggtggggaaagcttctacaggtcatctgcagttacttctggtcctgtgtgtcactccgaagaccacttgtcatgtggggcggcggcttcacagaagcatctaggttagccagagacacttaaagcctgtttctctttgagaatgatggtaagcagaagacctttctctttatcttgtatttattagtaactattaaatatatatttttatacacacagacatataccaaagatgaacattgatccttatcttacggattctctagactcaaatgcttactgaagtcaggcagataaaacaaaaaaaattcaacaacagcaaaccagcaaacagaaactcactgaggtagtgaagtgtaagcaggaagctgtgtggccaggtgtgaggaactgtgtagaactctgggaggaatgagagtagccccttcagcttcactgcttgctggtatgtgggagggagggccagggttccaaaacttccagttcttaaatagaagcctgcagtcctcattggaattgcttgtatgttgactcaaaaggttaaatattgtgcagatcaaacaaataatttctgtgaggaggatttagtcaatgggtaaggagtttgtgaccttttgtctaaacacatgaaaaggaaggggaccatttgcctgactgctctctactttgctacgttctttctacacctgagttagtgctggtggaagagtgtttcttctccttcatccagctgctttcagtcatgtacccccccgtgaccccctcactctggttcaaacgcaaacacaaactgagaataggaaaataatccactgctgaggcatgaacatagcaccaaaggatgcagtactctagttgcaaagaactctggctgaaatttcccccacctcacctgctttctccttttatcttactcaaggctcatctctcttccagttcctctctggggaaacaggagggagattcttcttgtcacataaatgtgtcctgaaaggattctctcctccttatatctactcctttaatctgagttcaagtcatcaacacctctcacctggcccacttgccaacttccataccgtctgtctccatcctctaaaacaaactttccatgtggacaaagctgtcctttctcatgcctcagacgccactgagggcacaccaaggccattggcggcgtggccgtggacttacacaaactttccatgtggacaaagctgtcctttctcatgcctcagatgccactgtgggcccaccaaggccgtttgcggcgtggccgtggactttccttatggtcaccaacctgcagccttaagctttcactcaccctctttgtctgtccccagacttaaatcttttcttcatgttgacccttgaaatacgtgtattcatgaagacctgttcaatcacactctggattttcaaagttgaaaataacaggaagttactacggcaatgatgatttagtgaaaaatatgaaggaatcagtgactcaacaatttttgggccccattttttttttccttcaccagaggataatgttaatatgaagaggttggttgtcaatattacaactttagaaagaggaatacatgtatgtatgtattcttttatatttatgggagttaccttctgaaacctttgaacatcaccaatattgcggataaccatatgttttgataagctcttgggtttatctcgcattgcgatcaagaattgttttcactgcatatcctccaactacattaaatgccttttcaacattctttacaattttctacgtggcaaaagataccataaacaaaactaaagacaaataacagactggagaaaatattgtttgctttgagtataacgtggtaagttacgaaggaaatgacaggacactaaatatgggaaaatgagtaaatataccaagagcaaattcagaaagacctgtgcaatgagacacaaaattatttttaaaattataaaaataagcttaatctcactaataatctgaggactacatgttaaaatggcaatggaatttctttgatgaccaaatatcgttgtttgatcatgtcaagggcaagtgggcagggagaaatgtgtactcctcaactgcagataaaaagagaattgataaaacctcttaaaaaaatggattagatttagaagaatgaactatgtatacactctatgactcagttccatctgtgaacatgagtgtcagagaaaagtgtggcacatcttccagtggccaggtacacagtgttgtgcatgaccctgtgtgggaggaccacaaatacattttagttaagcacgttatggaagactatgtagtatttagaaagatgggaaggatctatatgtactgacatgaagtcataaaaattataaaaatcaaggtgcaaaatctgatgatttgatgccatgtgtgcaaaacattcttttatatgcatttcacaaaaaacaatattatgtatttctcattatccctaaaacaattctagaggattcatgacatgctgttacttgtctcaggtggacaaggattagaaatggtgaataaaaaaggttattttggcggggcacagtgacttatgcctgtaatcccagcactttgggaggccgaggtgggtggatcactggaggtcaggagttcgagaccagcctgaccaacatggtgaaaccccgtctctactaaaaatacaaaaaactagccaggcatggtggtgcgtgcctgtaatctagcgactcgggaggctgaggcaagagaattgcttgaacccgggaggcggaggttgcagtgttgcagtgagccgagattgcatcattgcattccagcgtgggcaacaagagtgaaactctgtctcaaaaaaaaaaaagaggttacttttgccaggcacagtggctcacacccgtaatcccagcactttcggaggacgaggtgggtagatcacttgaggtcaggagtttgagaccagcctggccaacatggtgaaaccccatctctactaaaagtacaaaaattagccaggtgtggtggcgtgcgcctgtaattccagttacttgggaggctgaggcaggagaattgcttgagccctagaggcggaggttgcagtgagccgagatcaagacactgcactccaggcccagagacagagagagaccccgtctcaaaaaaaaaaaaaagttatttttcacatggtagttcattaaaattttttaagtattaagctttatttatcaactgattaatattttttcctaatgaaacaaaattttactttttttaaaaagtctctttgtactattcaaatactgaatatacaaacattagctagtgaaggaatgaatactgagctgatagccaggcttacttgctagctgggtgactatctcacggaagtctagcaggatttgagatttcaatgagaaatattctgcaaaactttagagttgctgacaaaaggtaaaaaaaaaatgtgcttattaataaaataaggccaagtaatgaaaaatgtatttattaaatgaaggccagggaacactgtgtgaggcttcgtgggtgtgagtacttgctactggactgtcatttctcagttatacagagtgaaccagaggtagatagggaatagttattgtcagcaggatctatagaaatagcaacagtggtgaggagtagaaggatgttggatcaaataagatagtgcagataacaccatagaatgctagagccaaaaggatttaacacatacttttcttgataagaaataggagacaaataaaagttcaatgatttgctggaggtcacactgatatttagtggaagaacaaagacctagggcccttcaagagtagaaaatgttatacaaatgtcaaccgctaagcattgggggtatttattgatctttataatttagaggtaatgggctctgagcatcagaccatctgataactttagttcatcagattctcaaagtgttcatcactagaagaagctaaataactgcgttactctgaaaataaaaaatgaatattgagtctgttatacattctttgattttaggatgtaaaattccttttctacttctcacaggcagcactgagatctatgttgcaaagtaaattgggatagtattaaaaccatttgcctcaagggtttttttaataagtttcttgtgataatgtatgtgaatgccccaagtatatgtgacccatgggctggtctgtaggtgggacccactacatcggtgaatcatgctaagctcttaatgactcattgtaggtctctaaaataatggtatttacaaattcaagacacatctttcatgaatagcaaacgcttaccatacaatagcaaaatgaagataacaccaactgaactctctattttctgtttctgtttaacaccaactcaattgttcatttccccacgtggttgagagaggaacattaaataagtagcaatgttgggctggctggtggttctaaggatcacctagaaaatggaatgccagagattgtttagaaacagatctgagatactagataagatgaaaataacaatataagcacagtagtcttcgtaaccaagtcttatgtgattcagaaatcaataatctaaattacagagatcagtacctattacaggaaacagtcgatatcctctggggcagggttttacctctggtgtagcctcatataagtgaaaaagaaaggctaaacgtctttgacccccaattcccattcccttcacagaaaactagctaaatatctaaattgctaccattaaatcacattaaatattgctcttctgcactttctggtctggtgttgtaaaaagcagttggttgtgcatataagaatgagggaaatggaggctatcattgggacacaacgtatatcataacagtacgtgaagtgggtggagcgctaacctcagtgtttctgcaagggagtctggactgcccagagtgcatccgtgtcatcctgcatttggacatcatcaccaatttctttccaaggacccttgtgcccaaacaaaacttgcacacatcagatacatgctgccaatcctgaaaagtgaacatttaaaaccttaaaactgaatttgaatgtacctgatcaatgtaatcacgtttattctgttctcagctctgtgatgtgttctgtctaccaaaaggaagctctattgcagccattcaatggtaatcctgcttgtactcacagagtactactattctaagagcttggtaatatactgcacatttttctcttctcttttctcttctcttctcttcttctcttctctttctttttcttttgacggagtcttgctctgtcgcccaggctggagtgcagtggcaccatcttggctcattgcaacctccacctgccaggttcaagcaattctcctgcctcagccacctgagtagctgggattataggcacatgccaccatgcccagctaacttttgtatttttttttttttagtagagatggggtttcaccacattggccaggctggtcttgaactcccaaccttgtgatctgcccaccttggcctcccaaagtgctgggattacaagcgtgagccactgtgcctagcctgtactgcagattttctaaaatagtatagcctatgttaaaacttgtcctaatagacattataagattacttagacattgttttactttaaagactgtgtatggctttctcacaaccccagggccattactagtaagataagattttcatggaagacattaaaaatcatgttacactttaatagtgatattgtttcaatctttcatcacattaggtcatttccatttagaaaatttgatattcatatggaacctttttgtatcaaaaattatccacatgtgcttcaattttagaacttaactactttcatgcaagtagtttctcttaagtcagctaaggtaatcatgcatcttccttgattctttaagactcccctgccctgaaatatctcccctaaaagtctgacacaattatagaacaaaggatactatgtcttattaagaagtttaatctcatcgttattaataagtaaatatgtgatatggtttggctctgtgtcccctcccaaatctcatcttgtagctcccataattccacgtgttgtgggcaggacccggtgggagatgattgaatcatggggtgggtctttcctatgctgttcttgtgatagtgaatgggtttctgatggttttaaaatggggagttcccctgcacaagctctctctttgcctgttgccatccatgtaagatgtgacttgctcctccttgccttccactgtgattgtgaggcctccccagccatgtggaactgtaaggccaataagcttctttcttttgaaaattgcccagtctcggttatgtctttatcagcaatgtgaaaacagactaatacaatacgcatttttcttgagtatagaattaacctgttatatttttcctaacatagaggaggtagtctggagagatttgaaagaaacacagaggtacaattaatttattagccaagttcttcaggatctcctaagagagaaacagagagagaggtagtgcagtaaagcttccatctgatgcatagctagtgtgaggacacgtgcctagaggcagaaccagggaactgggaaataggaacatctgtattaattttgctgatgatctaccctgaacacatgctttatgttatgggttggctgtgtccccacccaaatctcttcttgaatgaattcccacgcattgtgggagggacctggtgggaggtgattggatcatgggggcaggtcttacctgtgctgttctcatgatagtgaatgagtctctcgagatctgatggttttaaaagggggagtttccccgcacaagctctctctttgcctgccaccatccatgtaagatgtgacttgctcttccttgccttctgccatgattgtgaggcctccccagccatgtggaactgtgagtccattaaacctctttttcttcccagtctcgggtatgtctttatcagcagtgtgaaaatggactaatacagtaaattggtaccagtagagtagggtgctgctgaaatacccaaaaatgtggaagcgactttggaactgggtaacaggcagaggttggaaaaatttggagggctcagaagaagacaggaaagtgtgggaaagtttggaactccctagagatttgttgaatggctttgccccaaatgctgatagcgatatagacaatgaagtccaggttgaggtggtcccagattaaatgaggaacttgtaggaactggagcaaaggtgactcttgttatgttttagcaaagacactggtgacattttgccccttccctagagatttgttgaactttgaacttgagagagatgatttagggtatctggcagaagaaatttctaagcagcaaagcattcaagaggtgacttaagtactgtcgaggcattcagttttaaaagggaagcagagcataaaagttcagaaaatttgtagcctgacaaaacaatagaaaagaaaaccctggttgggcatggtggctcacgcctgtaatccagcactttggaaggccgaggtggatggatcacgaggtcaggcattcgagaccagccctggccaacataatgaaaccccgtttctactaaaaatgcaaaaaattagccaggcgtggtggcaggtgcctgtaatcccagctactcaggaggctgaggcaggagaattgcttgaacacaggaggcagaggttacagtgagccgagatagcgccactgcactccagcccgggcaatggtgtgagactaggtctcaaaaaaaaaaaaaaaaattcccattttctgaggagaaattcaagctggctgcagaaatttcataagtaacgaggagccaaatgttaatccccaagacaatggggaatatatctccagggcatatcagaggtcttcatggcagaccctctcatcactggccaggaggcctaggaggaaaaagtggttttgtggaccagacccaggatccctgtgttgtgtgcagtctagggacttggtgccctgcttcccagatgctccagctgtgactgaaaggggccaaggtacagcttgggctattgcttcagatggtgaaagccccaagccctggcagcttccatgcggtgttgagccttcgggttcacagaagtcaagcattgaggtttgggaacttctacctagatttcaaagcatgtatggaaatacctggttgtccaggcagaagttggctgcaggggtggggctctcatgaagaacctctgctagggcaatgtgaaagggcaatgtggggtcggagcccccacacagagtccctactggggcactgcctagtggagctgtgaaaagagggccaccgtcctccagacctcagaatggtagatccactgacagcttgcactgtgcacctggaaaaaccacagacattcaacaccagcccatgaaaggagccaggagggaggctgtatcctgaagagccacagagccaggagggaggctgtatcctgaagagccacagggtgaagctgcccaaggccatgggaacctacctcttacgttaccgtgacctggatgtgagccatagactcaaaggaggtcattttggagcttaaagatctgagtgccctgctggattttggacttgcatggggcctgtagcccctttattttggctaatttctcccatttggaaaggctgtatttacccaatgcctgaacccctttgtatctaggaagtaactaacttgcttttgattttacaggctcataggtggaagggacttgccttgtcttgaatgagactttggactgtggacttttgaattaatgctgaaatgagttacaactttgggggactgctgggaaggcatgattggttttgaaatgtgaggacatgagatttgggaggggccagaggcagaatgatatggtttggctgtgtctccacctaaatctcattttgaattcccccatgttgtggcagggatctggtgggaggtgactggatcatggaggcaggtcttacctgtgctgttctcatgatagtgaatgagtctctcaagatctgatggttttaaaagggggagtttccctgcacaagctctctctttgcctgccaccatccatgtaagatgtgacctgctcctccttgccttcaccatgattgtgaggcctccccagccatgtggaactgtgagtccattaaacctctttttcttcccagttttgggtatgtctttatcagcagtgtgaaaacagagtaatacactttattacattttccttctacaaaatttacattttttataacaatagttttcatttgtatttctttttggatgacaaagacattttacagacattttatcattgaactctacaatattaagtgttagagcaagttttagctatttaacaataaggaaatggagcttcagcgacctgttgtagttaacatacataataagctgaataactgggtcatgtattctatgctatgttttcctgagttatgtaggtatcctgtataagaaaaaaaatctgtttcatgattctatgaaagtattttgataacttttgatatataagacttattagtatgggtatgcatcaaattttctttcagtatacaacaaaataaatttagtaaagtaagtataatgtaattcaaattcctataaacaacatttagtaaatatctaaaaggaagtatcagaaatactactaaagttaatacacacacctgcctacactcacacacggcacacattttcaaagatataaaagcacataattgaaaagtatgttttctggggccgggcgcagtgactcacgcctgtaatcccagcactttgggaggccgaggcaggcggatcacaaggtcaggagatcaagaccatcctggctaacacggtgaaactaaaaatacaaaaaattagccgggcgtggtggcgggcgcctgtagtcccagctacttgggaggctgaagcaggagaatggcatgaacctgggaggcggagcttgcagtgagctgagatcgagccatcgcactccaggctgggtgacagagtgagactccgtctcaaaaaaaaagtttgttttccacttgtgtgtggtagccaggtgaacagtccagccaaacagtgacacccctagagaagatattgagcatgatttctttctgttttccttttctttttttaacacaaatgatttcatcctacaggttggtttcagcctttcttttatcacttatctattcacacaaagataagcacatgtgcatgcacacacacttttttcttctctctctttattccacagcagcacagaaagagttaccatcgtctttttaatggccataaaaatatatcataattgatttgaccggttgaacatttaaagtatttgcaagtgaatcttgctgtgcagacatcatttagagtgtgtgtagtatgtccataggataaattcctagaagcaaaattattaggcaaaagaaatcatgcatttttaattttaagaaatattcctaaattgcttcagtggatagtatataaatctatatttccactagtaatgcatgactgcatgttttcctcacagtgccacccacacactgtgtcatcaacatttgtgaactgtattaacctgagagataaaatatgttatgtaattaagttttaatttgtaacttttcctttataagtgagattgaggtttcccccactttcatatggtcttcccgtttgttcaccagactattagtcttttcccagatgattcatgaaaactggacatgttaagaatatgaaccccttagctattaaaatggttgtaattttttccaagttttttttgtattgtttatggaattattttatatatagattttaatttttatgcaattaaacatgtttattttatatattggagcattttgtcatattacaaaatccttctccaattccaaactttaaaattcttttttcccaatttattttagccttatatcctgtatttaacatctgtaatttattttagggtaaagtgtgaggtatgtatctcactttatttcttttccagatggtaatttatttattacaatctatcttataaaataaatcacctcctctactgatttgaaatgccacttttattgtataataaatttctgcacattagcaatattttactgtttatcaaaactacatcataattcctatttgtatattgctctattgttctttctagttattgtcagtctaatattttgaactgttctctaaacatacccattacagaaatatagtcctgtttatttacatatgcatgtttgcacttatttatgatgtatgtactacataagagttggggatcaatatataccaaaataaattacattgttcctgtccacatcacaaagtttaagataaattaaaaagttaaagtatatatgaaactatatatgccttttgagtaaaaacaaggaaattctttttcaaaaagcaaataaacaagtttattattttagattcatttattgtagttaataccttatttcactccaagttttctaataacgaatgtaaagacgaaacatgttgacatctactgtgataaagaaagttcatttcctagcagttaattctaagtaggatgctgggcctatgcaagtggtgatgaatagcataaataagttagcttttccaaaaaattaaatgtttagaagtatcttcaggccaggcatggtggctcacacctgtaatcccagcactttgggaggtcgaggaggatggatcacgaggtgaggagatcaaggccatcctgactaacacagtgaaagcccatctctattaaaaacacaaaaaattagccaggcgtggtggcgggcgcctgtagtcccagctactcaggaggctgaggcaggagaatggcgtgaacccgggaggcagagcttgcagtgagctgagatcgtgccactgcattccagcctgggcgagagagtgagactctgtctcaaaaacaaacaaacagacaaacaaacaaacaaacgtatcttcaaatggacatttcaaatgtttcttctttttataagttgagaaagtaacacagaagcatcagtaaaatgtcttcaggcaacaacgtagcatcatgttggtatgtcacttactggaaagaagattatatatcttttagactcttcccaaaattaaaaaaaatgcacctgtcaaatatgaaatactggtaaagttcaaagaatccgtaatgtttgtggatgattaaaaatgtgaaaactgtgacagattctttctcagtcagagtaatttgatttctgcagagcgggctatagaccggtcttcgggtactttctcaaagattaactgaattttcttaaacaaatatttaatttgattaccagaatatgaaagaaaaaaattttgtctaacaactctttctgaagtttgccaatagctttcttttactgccaatacgacttttctgaagcatttcattatcagttgatctttgtcttcttaagtcagttaatgatacgacacgaacaaaatatattatcatgcaggtaaataaaaactgtcctgttggaaaacttagtgtttcctatttaaatttcagaaaaattcagctttttttgtggttgatattcaatgcacaggcattagaaaaagggtctattgtgtctgaggttttttctggttttaagtgataaagccatctttggcatgaaggatacttggttctcattttcagtagaaagtggcatgcatcccagttacccaatagttatcctaaagcactgaactaaacttaagacataaaaaatgtaagtacattcttttgaacgtgattgagaattggaattttatttgtcaaaatattttacatatgcttattctggctgccatattatgatgcttactgtgtaaaagcttttgtggtattgtatcttactgagatagtatagttttttgatagatgatttctattcgtggactcaaagcctcataattatattatatatgttaggaaggattttccttattttcctggtgacatgaaaaatctatgtaagtgatttataaggagatatctgcacagagatctgtatgttcctttataaattattaatatagagatttaatttaaacattattatgacagttagccaatagtgatattttgagggaatattctatagactcatgagtttgttattctgtgacaataggttttcaccttttaaaataaaaaactatactcacattcccctctgagagaactctataggccgggtgcggtggctcatgcctgtaatcccagcactttggcagcccgaggtgggcggatcataaggtcaagagatcgagaccatgctggccaacatggtgaaacactgcttctactaaaaatacaaaaatgagctgggcatggtggcaggcgcctgtagtcccagctactcgggaggcggaggcaggagaatcacttgaacctgggaggtggacggtgcagtcagccaagattgtgccactgcacttcagcctggctacagggtgagactttgaaaaaaaacaaacaaaaaaaaaaccaaaagaaagaaagaaagtgagagagagagagagaaagaaagaaaggaaagggaaagaaaagaaaggaaagaaaagagaaagaaagaactctatctgtgcagttaaatgagagaaagaacacatagtttagaggacttttatagagaaagaacacatagtttagaggacttttatagagaaagaacacatagtttagaggacttttatagagaaagaacacatagtttagaggacttttatagagaaagaacacataggttagaggacttttatagagaaagaacacatagtttagaggacttttataggacagacccccaaatattcttgcagtgctaggcctcttgggagatattggtaaaatgaaataattatttaaaatctatgaaataaatgtaaatctttaggataagttgaagcatgtaaataagtcttgacatagagtaaaagagaggagtgagatttgtatgtgaatataagattcagatttttaaaattttaatttagtcatctaaatggtctcctgtactgattatactcagctacttaaaatgagtaattctacccgcaaaggtagctagtctctataattgacttaaatgatgtacttttaatcaatatttcaatttcatttgatgcccttgaaatgatgtggaaaataaaaggaaaactagaacattaagtccacatggagcaatataggaaaaaccaaataaaagatttcgaatgcccttttatgtaattaattgctttcaaagaagcaaattccaaatgtcagagatatataaatggatattcaagataatgtttatttttgttcctatttttatgtattacaaatagaggtaatatttaaaacaacaaaaggggtaaaatttaaaaatttagaaaaatatagactactgaagagtaactgccaatggcatgtcttattaatgagaattcttccctagggcttttaatttgaggtggagagagcagaagcagcgggcacggggcagcttctctctaaggtcacatgctgtggtgcaacactgatttaaagttgtctgcctcagatccacatcaagatggttagctactagtacagaggaactttactaggtaggattttctttctttctttctttctttttttttttttagaaaaagtttccttcttgttgcccaggctagagtgcaatggtgcaatctcggctcactgcaacctcagcctcccaggttcaagcaattctcctgcctcaccctccctagtagctgggattaccagtgtgcaccaccatgcccatgtaatttttgtatttttagtagacagggtttcggcatgttggccaggctggtctcaaactcctgaccttgtgacccacccgccttggcctcccaaagtgctgggattagaggtgtaagccacggcaccaggcctactaggtaggattttcttagccatgatatgaagcatctttcccctgcttcctggtcacatgcttctgtaagcacaaggcctctgacctttctccaaaggtgcagctagtagcccccgcttgctgccaagcgagtccacaggctctatttgacgtccagttagatctgatctttgaaataaaataagtaagctattggaaatcagtaaaaatatcaactagagtctgggcgcagtggctcatgcctgtaatcccagcactttgggaggccgaggcaggcggatcacgaggtcaggagatcgagaccatcctggctaacatggtgaaacctgtctctactaaaaatacaaaaaaaatagccaggcatggtggtgggcgcctgtagtcccagctactcgggaggctgaggcaggagaatggcgtgaacccgggaggtggagcttgcagtgagccaagattgcaccactgcactccggcctgggagacagagtgagactccgtcagaaaaaaaaaaaaaaaaaagaaaagaaagaaaacataaaagtagtaaatatccctaaaactttaattatactttgaatatgaatatttgggcatagttttttaaaaactgcaaatctgtccaagtaaaagattgtttttctgggtgatttagggataattaccttttttaaaatcatggtctgttttatgtgtttccaagagcatgcactttggtaattaaatgtggtagtagggatgtttgaatggaaaccagaaagatattttcataattaataattagtttataaaaatcactagcattcctgtacaccaccgacaaccaaactgagagccacatcagaaagataatttgccaccacacagaaaaaataaaataaaataaaataaaataaaataaaataaaataaaaaagacctgggaatgcagctaaccaaggaggggaaagatgtctacaatgagaattatgaaacactgctcaaagaagttagagaagacacaaacaaatggagaaacattccatgctcgtggataggaagattcaatataaataaaatagctatgctggacaaagcaatttacagattcaatgctattcctatcaaactatcagcgacatacttcacagaactagaaaaaattatttaaagatttatatggaaccaaaaaagagcccaaagagccaaggcaattctaagcaaaaagaataaagctggagaaatcatgttacctgacttcaaactatactacaaggctgcagtggccaaagcagaatggtactggtacaaaaacaggcacatagaccaatggaaccgaatagaaaccccagaaatacagccacacacctatgaccatctgacctttgacaaagctgacaaaaataagcaatagggaaaagactcccttttcaataaatggtgctgggataacttactagccatatgcagaaaattgaagctggactctttctttacaaaaatcagctcaagatggattaaagatctaaaactataaaaaccctgggaaacaacctaggtaataccatcctggacataggaacgggcaaagatttcataacaaagacaccaaaagcaatcacaacaaaagtaaaaattgactaacgggatctaattaaacgtaagagtttctgcacagcaaaataaatgatcaacagtgtaaacagacaacttacagaatgggagaaaatatttgtaaattatgcatctgacaaaggtctgatatccaccatctataagtaacttaaacacatttacaggagaaaaatcaaacaacctgattcaacagagggcaaaggacaggaacagacatacatgcagccaacaagcatgtgaaaaaaagctcagtatcactgaccattaaagaaatgcaaaacaaaaccccaatgagtaccatctcgcaccagtctgaatggctgttattagaaagtcaaaaaataacagctggtgaggttgtgaaggaaagggaacacttaaacactgttggtggaagtgtaaattagttcggccattgtagaagacagtgtggcgattcctcaaagacccgaagtcagaaataccattagacccagcaatcccattactgggtgtgtacccagaggagtgtaaagcattctacctaaaattcacatgcacgtgaatgctcattgcagcactattcacaatagcaaagacaaggaatcaacctcaatgcccaccagtgacagactggatcgagaaaatgtggtacatatagactatggaatactatgcagccagaaaaagaatgaggccatttcttttgtgagaacgttatggagctggaggctatcatccttagcaaactaatacatgaatagaaaatgaagtccaggtgcggtggctcacgcttgtaatcccagaactttgggaggacgaggcgggcagatcacttgaggtcaggagtttgagaccagcctggccaacatggtgaaaccccatctctactaaaaataaaaaaaaaaaaaaattagccaggcgtggtggtgcatgcctgtagtcccagctactcgggaggctgaggcaggagaattgcttgaatccaggaggcagaggttgtagtgagctgagattgcaccactgcactccagcaggggtgacagagcgagattccgtctcagaaaaaaaaaaattagaaaaccaaataccacatgttctcacttataagtgggagctacgtgataagaacttatgaacacgaaggaaacaacagatactggggactgcttgaggggggagggtgagaggagggagaggagcagaaaagatcactgttgggtattgagcttaatacctgggtgatgtaataatatgtacaacaaacccccatgtcacatgtttatctatgtaacaaaccttcatatgtacccccaaacctaaaataaaaactatgaaaagaaaaaataaaaaaataaaatctggggaatttgagttggcaaagcctctgaagttttagctattgtgctctagtctgtttcactacaccccacaaataaaaatttaatttgcaatactggaaaaagtcttttatgtaaaggatagatatgttagattttttaaatatgctaaattaagttctcctcttattccagttcaccttgctattgtaaatctatgtttaaataaaagtcatcttcaaacaatattaaccaagttgcctgaagtccaccccttaataatctgagctaattaatcattcttcttggtcacttcctgaaatctctatttcaagacatgtacattctagatgaaatgtattaaaaagacacacggaagtgaaatgctttgaaagcaggtacattttgcttccccagcctgtaagatgtcagagattatgtgttatttctatgtatactttgtcctgatgaaaataaaattttatttgtacctagtattttataatttgaataaaggattataatcaatattcttctcttctttgcttctcttagctgatggccctttttttcagcagttaattaaagtttgaatagctgtcacttgtgactaacttctgtggcgtttcctttgcctgcacctcagacatcatctccttccattcatttcttctcaaattgcgtacacaagtgctctacaaaatcatctacagtcaaatcccagagaagtagtaataagagccattgtagacaggaggaagtgtgttaggaaacaagaaggtagatctggagccagtatagactgcagccaggaccgcatgttccttagggcaatggaaagaagaggagataaatgctgtaagaagatgatatagaaaatttaaaaactgttatacactgttcaaatctcatcaaaggcatcaaagaggatcccattaaaaacactcttgagagcagctgagcgctgacgctttgctgcttagaatgcagggccaagggagatatgaggtcgggagggtttaggtgtgcacctgagcattcagagtaaagagaaatgagcactgggaaaagctaaaaggaggcagcctgagggggccagcaggaggccggccggccggccgggatggcaggccaccttcagcaggtcagccttcaccctggcaggcagatctaacgcggatttgggaaaaagagacactctcagtccctccagattctgggatggtttggtctctggctctgaggttcccaggtgaaactgatgctgctgcaccttgccgtgatgcagtgttactcatggccaagagcagaacttcagatgggagagggctgactctggcttctgctattcacagccatagtgtatgggaaagtcaaagaggcttcatcattcagtaacaaaaacaaatttcagtcacgtgaggaaaactaaactgagctttatgaactttcctttcccctgtcttactttgatgtcattttgtcttgtaatgcaaatatagatatgtttaatccatatttacctttctaattaataaacagctagttttatatagataaaagctttcaaattttattcaaaggaggttttctcagagtgctgattttcattgttcatcaggcaggtacatcatttagtggaaaccaagtaaaattgtatccatgagtccaagcacagtcctccagtattttgtaggattcatctaaagacttaagtttaacattcatgtaattccctctaggatgtacagttcctcagtctcacagaattagcccagtacctgctcttctgggtgctaggatgccatagacaccctgtagttcctttatccaaatcccattacacttcaggtttgggattctaattcattaaggaactgaggccttttcatgtagtatttgtataaatgctgagctctcaatatggaagaagaaacaggaaaggaagaaagaggggtggggaggaaaaggaataggaggaggagaagaaggaataggaggaggatgagaattaggaggaataggaacggggggcggggcgaggaataggaggaggattaggaagaggaggaaatttgcatatggctttaagtcccttaagcttctggttaagtggctcatctacacaaaccccatctcatgatcccgtgacataggagctatttcctctcatcactactgattgtcctccatgttccctttgacttatctttcatggccacatgaccccatccccaccctctaaatccaatccagtggacctccacactctgctgcccagccctcttggtgatttctgagctcttttgctgtaaacacaagtggacagtcatctgaggcagcgttctttactatctgcactctccagagcacagttgagcctgagttccaccccagcacatctcaacctcagttgatttcagaacctttcaatcatttctgtgacatttctgaatttcctgacttcaccaatgccaggaggataaccctccgaatcaaatcgaagatcatttcattgtaaagttcctcctatattgacatttctggggaactatgacaaactcaaggcctcggagggccctagactccatttcattaaatacaatttttgaatgggtatcagggaccttgacctcaggaaataacttgggcaccatttatgtcaacataggggtcatcaacgttgctatgatgtttcctttgggttcatttaaccctatttaaccacatatttcaacaacagaaagatttaaactcagagcaaggtggtcaacagcacacatctattatgtaccatttacagactcctgaagacctgttgttctctctctaccatttggtctcttgccatatttcttcaggtttattagtgatttatctctttttgttaggtattttcctggtccaacattattttataattcaaatattagggcacagaaacaaaaatagaatgtgggtttgaatacacatgaaatacctacatctatgtcatacatatacacatacactaaaatagtttgcaatgggtatagaaattagaagggggataatataaagtaaacttaaacagcttcagaattttgccagaaaccagccctgaacttaacgataaccccatctcagtagaaagaagagaggctgagtaaaggcatgtttactcggaaatgagttccccagcgtgaaactcaagagtgaggagagagaacttttagaatttgccacacacctgctttctgttgcatattaaccacacggtgcactttccactggctgcttgaacaggcacgtcatgtgtgaatgaagtgggtcaaggtcagaaaaatagcgattgttggtgtatgtgataaattgatgtgtacttgccctgggtcagtcactactcacctgcagaagattcctgccttataggaagtaaaatctgtattgctgaatctcacacatttccagaaaaagccaggaagtgtggctactacaggaaatttcctaatttttaaatatgaaatgattcaaacatactgtagaaaaaaactatacaatgtacagtaaccacgcaatagaaatacatctgatgaatggatttggctcatgggccgccagcttgtgacttctgatcaatgttttgaaattatccctgggagacatggggaagaaagattcaatctgtaaggagccacatgcagttttgtgagacaatttgcagacttcaaagtgactgagtcagagtatgtacataaaacgtggcccaagggagaacagaaatctaaaatgaaacacattaaggttaatactggccgggcgcagtggctcatgcctgtaatcccagcactttggggaccgagtcaggaggattacttgaagacaggagatcgagaccaacctgggcaacatcatgagacccatttctacaaaacaaatggaaaaatagttactacccataggaatgaaaagtcactcatttgctatcacacagacatacacatgtatgatagccaactaccggattaaatcaggcagtcagaaagagaaaacaaaaagaaaaggaggcaaaaatacaacagaaaaacatgaaatttaatctttcaatttcgaactttttatcagacaaggactagaaacccaatgaagatgacaaaaaaaaaaaagacaaaattgctttcctatgtatcaagctcaggtgtaattatagttccacactaaactgcaggcttcatacaaggacttgccacaactcttagttttagtaccggctgtaatttatgttgtgtttagataaattcctgagctctctgtacctaattttttttaattagtgaaaaaacacagaaatagcttacatgcttgctttaagaaatagataaatagaatattatatttttaaacctcattatgcctaagtatttaatatctactggtgattttattcttggcgagcatagcaggggccatatgagaaatgtaaatatggttattgacctgttgtgctggtgacaagatgagtcttttctctaggagactggattagcttggctgaaaatattcgttgcataccaaattagactatacattgtatttctgtcactgaatgttttccttagttgttttgtgagtaaaataaattggatgtatgttcaatgtatataattcaggcaccttatttcaaaagtaattaatgtcttactcacttgagaccagataattacagttaatgtcatcttaaaggagcccccaggactgttagccattggtaaacgcataagaattggaataaattgactttcatgatcactgaagcttcgttgggagaactaggagcagagaaaagaatgataaatcaaaaattcgtctcctaagactgatgaagataacatatatattttttcatttactcttagacaacccttacaagatttttgcccagcgaaagtggcacgtggaacatggaatgacatttcataaagataaatccagagattagtgctgaagactacacccctgtgtagtcccacacaggctaccccagaccagcctggcgggctctgcactaggcctcccatcaggcgagagccaacgctcctcagcccggctccacctcattcagaagaaagtgtgtctcccggcctcacattgcgctgaatgcaaggataccgagataaaccaggctttccttcgctcagagtacagttgcagacttggtaatgactgagccaagccagactgactgtgataagataataaattaactaccagtcaggagctaagtcagcagatgtgcgaacattttagaggtaacatcataaactagaacagaggagctcttgggaagaaaaagggcttggaaattatacctggaaagataccgctaataatgatcaagaagaaaaaacaaatccagtttggaagtgagcaatcatttatgatgtaaaatatttcttagaaatggaatctagataatgcttggaatatgctttaaactacctatatttaatttgtttttcttgtgatttttgtattgtttggtgtaaaataatcttaatctttccaggtggtgtctaattaaggcacatttactgatatgagtcattttctaaatatactttatctaagaaaatttaaaatttttggatcaactaaaaactctctcaattattttagagttaactcttccaaattctaaaatgtattcataaattatatacaactattttaatggtcactgtgggcccaacttctgtatataaatttaccttcttattttacaggtgctaatgtttaaagatacttaaatatgccaatttctttcctctatgtagaagtttgaaatacattctatgccctgagagaaccctttgaaatttgaacacatagagtattgttatgtgctttcaaaactttgtgttgtataggaccctcttttagctgaatatttttcaagcagtaagcctgtcctgcatcgcacatgtactgggacacccatggacaaaatcataagactctgtcttcctgacagatttccctcctctcctggggaattctctaatgatgtcactctttttttgtgccctgtatggtttttttttttcagtttcttctgtgtgatgcacgtgatgctgttacactgcagggtagcgtttttaaaaaatctgatttacagtttgtcctactattatatattttgcttataaaaaccttgtgttttttcaaaaattcctaacagacttatttaggtctaactgacctaaaataaaccacacatggtacagtgtacagtttgatgggcttcgacataagcacatataatgggttgaattatgtccctcacgagatatgttaaagtcctaaaccctgtttctcatttgcgaatagggcctttatttggaaatagggtcattgcaggtataattagctaagatgaggttgtagtggagtggagtgggcccttaatccccttaatcctaaatgaggggtgtcatcataagaaagacactggcaaacagatacagacacagagggaagaacgccacatgacaaggaggcagggggtggagtgatgctgccacacgtcaagaagaacctgcggccaccagagttagaagaggcaagaaaggattctctcgtggaggcctcggactggcatcgccttgccaacaacgctgatggtgggcttccagcctccagaattgtaaggcaataaattcatgttgttttaagccaaccagtttgtggtgaaatagccccaggaaacggatccaatctacaatcatgaaaccatctgaaaataaaaatagcaaacatatccctcacctcaacaagtttcctgaaggccctcccatcacacagtcccaagtcccacctccttcctcaggaaaccactgaactcttttgtcactatagaccgtattttgtagaattaatataaattttacataaatttatataaatccccaaattatagaaaatatatttactgtatacatgcggtatatactggctgctttcagcataattatttggaggtttattcatcattcttttgaacattcatttttttgctcctttgtttagctaagtagtactcccttgatatatcacaatttgtttatccattcacctgtttatggacattttagttgtttccaacttttggctatcacgaatgcatctgctgtatgtgcacatatacatgtacaactatttgaacagagatacacttttgtttctcttggtagacacctaattgtggaacagctgagtcctgtaacaggcatatgtttaacttttaaagaaactgccaaaccactttctaaagtaaacatactatgtacaatctcactagcagaatataggagttccagttcctccacatcttcatcaacagttcgtatgattacgctttgaaattttttcctttctaataggtatgtagtagtgtctcattgtggttttttatttacatttccctaatgactaataatactaaatgtctttcataggcttatttgtcatggcatgcctctggcataccatctgttcagatcttttgtctattgtctaatttttatgggtttgatcttatcaatttttgaagattattctggatacaatgaatttgttagatatatgattcctatttttcatggtctgtggtttatcttttctttctcttaacgatattcttgaagagcaggtgttcttatttttacgaaatttcttttatcactattttcttctatggattgtgtttttctatgaagcaacctttctaacccaaagtaataaagtttctgttatacagcttattctagaagtttgatagttttaggctttaccttggttctatagtcctttctgaattaactttcacatgttatgttaggtataaagtctttttggtttgtttgcttttgcttttgtatattggtatccagttgttctagtactagttaaaaatactatttttctttattaagctgcctttgtacatttataaaagatgaattgatcatatatgtgtaggtctgtttctaaactttctcttctattttattgatgtatttgttggtcttgaggcaaatatcacattgtcttgattattgtacctttataatgattattgattgctatacgtgcaagatcctcaactttgttgttttgcaaagttgttttgactaccttgggaactttgcatttttctagtaaccctgttttgatatagattattttgaatagggaatgttttgacttaaaaataatatcaaacttttataattaagatataagtagtgtgaaaggagagaaacatcttcattctatcattcagcccctttcaggaacctcatccaacctcaccactctaggctatcagagttagcacattacatctctatacagacatgcattcgttaatgatgaggatatgttctgagaaatgcattattaggcaattttgttggtgaacatcacagagtgtacttacacagacctagctggtgtagcccatcagttaccttggcaatatggtatagacgattgttcctgggctgcaaacatgtacagcaggttactgcactgaataccgcaggcaattgtaatacaatgataagtatttgtgtatttaaacgtagaaaaggtacagtacaaatttgatataaaagattaaaaaacagaagacctgcttaagcccattctgttacaatcttatgggaccagcattgtatatgcagagtccatcgtggaccgaaatgtcactgtgtggagcacaactgtatctccatccatactgacacacacacgccttctgaaacccatgcctacaaccatattggtatctgtatattggtgctttatagtataaaatataccctcttgaggctgagcctcagtaaatactcatgcttagccactgtcagcctgcttcttcctctaatctccaaaatgaagtaagttcattgacagcactggagatgcctgcattgctggatttacactctattttattattaaagaaagggtttttttctccctaaagatatccctatttctattaatcttttctggctcattatttttctttgataggcatagagggcagtatggtggaagtattctgcctgtctgtgagtattttaaaaaatggaaaatgttggaaatcaatttcttgtgcatttactttttcttaaatactattactgtttcctttccaatcttagactgctgaattctgaataaatctctcacctttgtggttttcttgaagtagaccttaatttgaattttttttttttttttttgacagagtctcacactgttgcccaggcgggagtgcagtggcacaatctcggctcactgaaacctccacctcccaggttcaagcgattctcctgcctcagcctcttgagtaactgggattacaggtgcccgccaccatgcccggctaattttttgtatttttagtagagatggggtttcactatgttggccaggctggtctcgaacacctgacctcatgatccatctgcctcagctcccaaagtgctgggattacaggtgtgagccactgcacccagccgaaatattttcttttctttttctttctttccttctttttaaaaaaattctgtagctgatccctgatggcttttaatttgaataaaactttatttaaagaaagtgtttattcattgatacgaatcacacagagtataatttcaagcccattaccatgaagatattttcctatgttttactccagaatttttaattattttatctttcaaatttagatctatattccagctagaattgtgtgtgtgtgtgtgtgtgtgtgtgatgtgaaggtcaaagtttatttttctttttttacatataaatatgtaattgatccagcaccacttaatgaaaagactactcttttcagccactctcaggtggtacctacgtcgtgacccaagtgactgagtatcgagtcggtctggttttcaactttctattcagttcggttgctctgtagttccccccttgatggtttacattgtctgtgaatattgacagttatagttcttactttaccattcttttaaggaatcatttgaaaaattcacatattggtgaagccatacaggcttagagttttctttgtggcaagtttcctaatgacagatttaatttctttaatagatacaatatattccaaatagatttttttcaatgagttttggtaagctatatttttctaggaatttgacaatttcttctaaattttgaaatatattggtatataggtcaaaaaattgtatgtctttatctttttaatatatgtaatgtctgttgggatgtacctttttaaaaatttcttatattattcatttctcttttctggcctgatcctagcaattgttatagggagtttataaaaattattcgtctttttagggaaataaatttttgctttttaatttttctactatatgtttgttacttcatcaaatttaaattaaatttttttggattaacctacatttccttcttcccatttttattaggattagtttgttcttatttttccaactactttagaacattctttagcttttcctctttgctaatatgtagatatacatttgtttctttcttcctttcttttttttgagacggagtctggctctgtcacccaggctggagtgcagtggtgggatctcagctcactgcaagctccgcctcccaggttcacgccattctcctgcctcagcctcctgagtagcttggactacaggcgcccaccaccacgcctggataatattttttgtatttttagtagagacaggggtttcaccctgttagccaggatggtcttgatcccctgaccttgtgatccacccaccttggcctcccgaagtgctgggattacaggcgtgagccaccgtgcccgggcccccatatagatatacatttctctaagcagttttacctgcctctctaaaattttgagatgtatttttattaaattcagtttaaaagattttctgatttttcattgagttgtctttctttactagtgcgttatttttaaatacattgcttaattttcaaacatattgacatattccaatcactttttcattattgctttccagtgtaactacaccatggtcaggagaacagattccaaattattgtagtatttcaaacttgttgagacttgctttatagctaagtttaaaatacattttggaaaatgctccgtgtaaatttcaatagaatctgagtgtgcttctatgctgtactatagtacttcccaggcatccttcaggtcaggtttctcctcaacctaatggatcttctgtatacttactggtctatatgattgcagaattttttctatttggtctactaattatgaaaaatgtgttttaaaatctattattatacatacattcatttctccttttacttttgtcattctgttttgtatatacagtcatgctccaaataacatttctttcaacaacagactgcatattcaacggtggcctcctaaggttacagtggagctgaacaactcctatagcctattgctgtctgagccttcataatgtcagagtgcggtgcattttaccttttctatgtttagctatgatcagatacacaaatacttactgttgcattacagttgcctagagcaggggtgtacaatcttttggcttccctgggacacattggaagaagaattgtcttgggccacacataagatacgccagcactaacaacagctgatgagctaaaaaaaaaattgcaaaaaattctaataacattataagaaagtttatgaatttgtgttgggctgcattcaaagtcatcttaggctgggtcacgggttggacaagcttggcctagggtagtcagtggagtagcatgctttctaggtgttgcctaggaatagtaggctgtaccatttagcccaggtgtgtagtaggttatgccatctaggtttgtgtcagtgcactctgtgatgtttgcacaacaatacatgtgcctgatgatgcatctcacaggatatgttcccactgttaagccaaacaccactgtatttgaaagttttgttgttaggtgtatacaagtttagaatttttctttctgaagaattgactctttcagtaggaaatgtctctttctagctctgatgattcttcttgccttaaaatctgtcttgtttggtcttgtcataatgcacaaaaattcttttggatagtacttaaacaaaatttttctcatctttaatttttagcactttaatggttttctatgtttatgtctgggattattttgcttctacttaaaggactccctcctttagtatttattttaatgcagatctagtggtggtgaatactctttattttaatttttttaggagtatctttatttaacctttgaaagggtttcactgaacacagaattttctatgggtaattatgttgtttaaagaagtcattgccatttcttccatttctgtggagaattcaactatcagtcttactgtaagtcttttggattgcagctgagaaaacctgttgttatttatatgatcactcacttgactaccaagatataacaaaactactgaaaggaaggaaaagtttgaagtgagaagaaaataaaagatgaataaaattacattacaataagcttagctacaattatggagagaaaaactagaatacagctgataaaacaagtaagtggcaccctattttgggtaaagttagtagtccaactgaaatctgattattagctgacaaaacaggtaatactccactgtcacttaatttgccataatattttagaaaatgccctttagtagaaagttatcatttcatgtttgcattagttgccacagatatataaacatgatattaggtaagactgcctaaaatcttctcccctgtatttttatggtaattatataatatagagcatgtgatgctctctgaccatatattgtgaatggtttttgctcttatagcagaatttaaagccagcacaaggacatatttggtgtaagaaatgtaataagacttgtggtcaaagttatgaatatttaaatgacattatatatacaaagaaaattatgctgttatttggtttcagtaaaatccagcataaaaattaattttgactcacacccaaatcctaaaatgtaaggggaactatttttaataatatgtatatttgggaaaataattgatttattaattggccaaatatttattgtgacaagccattttctttcattatagtttatttggtaagatgttttcttaaagagcctatgatgaatatttataatataactcaataaaaatgaacattagtttgtcttgcagggaagctatgacacgtatggatattacacaaaaatacaagccttaaggaaataggggatttggtccaccttgttctctgtggtatctctagcattcagattaaggcttatctcatagttaatgttcagacatacatgttaagtaaatgaattattatttttttaaatttgattttgtaacatctgaagtatgaagattataataatcagcattaaaatctggtttggagagacctgtattagaggtgtgtaaacattggtctcctttatttgctattaacatgtatatagtcagtgttgaatttaaaatgatgtaaatcttgagtgttcgctgaggttgactaccagtattttcaggagatcaccatgtggtatgatctgagatgtcttcagacctactttgctctaaaaagttatttacactttgcaatgtttgttaaactaccaagatctgtatattttcactatgtttgtgaagatgacagtttgaaaataagaagatgaaaaacaatatattacatatgtatgtttgggagacaaagataaccccaagtttagaaatgtgaggcaggcctatatttctctccaatagtattttatgattgtctccaattcctgcttggtttgaagtcccttaacgcagaataatttggtcagcagaatgatttagttagacagtaatgacactcttactccagacatatttaataaatgccatgtcttctactgtcttggcacaatatgagaatgtctgagtggtataaggtgcataaagtagtctgtttttatggggatcacaattttgttttctgcaaggaaaaatgaaagatatccacacttggttaaaaatgtattagaaatctgactctgaaaccacacagcaggattatgtgcttcggatccatatcttgacctactttcctaaaaatgtccaagttggtaaaactagatagttctgttatcttgtgaggctttcctgacgcactagttttgggttaagataatgatattactgttggaaaagagaagagtgattttttttttcctcttagaaattgtttttcattttatgtgttagctttctctctctattgggtgaaatgtccttgaggacagtgataaaggtttactctgtttataaaaccagtagtcaggcagctatgactgtgcgaaactctggacaggttattcaccagcttcagaagtggacttgtcctcccacctgatgattgatattggttaatctgtatccatctgtctgttggtctctctatccattcatccattccaggcattctataccataatatagatagataccatataccatgtaccataataccataccaaaatatagatagaaatgtaccataatataccataatatagatagaaatgtacttcaacatttctggatttattgttaaatttggtatgttattccttgaatactctgaacaaaataatagtaggttttatataaatagtagagactcattattatagctcattagataaataaaccttttaggttctattataaaataaatgtttcagtttctattcacaatgattaattcattcaaataaattataaagaaaaagatgagtttcttttacaaacacagttagaatcaaaattcaagtgctaagctgataacattctcattaatagcaataaagcctacagcacttattcaacccgaaaaataattgacttatcccagaaaggcttttatttgtagagtttaaatgtctcttctcataaccagcaacttgtacctcatataattactcagataaagaggctttcgattttcttgtataaaagaaaacactacagactatttaaaacaaacaagtggccgggcacagtggctcactcctgtaatcccagtcctttaggaggctgaggcaggttgatcacaaggtcaggagtttgagaccagcctggccaatatggtgaaaccccatctctactaaaaatacaaaaattagccaggcatggtggcacacacctgtagtcccagctacttgggaggctgaggcaggagaattgcttgaacccaggagtcagaggtcacagtgagctgaaatcacaccactgactccagcctgggcgacagagcaagactctgtctcaaaaaacaaaacaaaacaaagcaaacaagtaccaccaatataatactttatagtgaggatttcaaggcagcctatgttcctaatgatatagagttccagggagggaaataaatccaaggtctttacatataaccatggaatgaggatgtgcaagagaacacctgaaagaaaatcagatttcctataactgaaaacaacaacgacaagaacaacaatacccagcttctcaaatggttaattcacgtatggtaaagagcagagaatggaaaggtgctgatcacaaaacagttactaacactcccctcaccctccaaaaaaggtggtaatttatatttatcaggcagttatggaagtttcttaaaaagcaaggttatttttccttgcattatttacactgcaatatattttttaaatttatggaatgatgaatctgtttacaaaaaatgttttttatcacacgtaggatatttatagtgaaatgaaaatgaataaatcttgatagaattgagacactaaagatattttaaaaatcaataaatttctaagagataattatgtggtttgtatgataacataacctttaattattctcattttttctttttttttcagaccactcaatctctggctactccttaaacatgtgtctgtatctacagttttgctgatatagtactgtcagcctgcattttccaccatgtagtttattctaatacatacaagtgcccagtggctttcattacttctgttccatgtactctcaaattcaacatgtttaaaattgagctcactctgcctctggctatgcttccccagaggtggatggcaacagattccatccattcatccaaacttggaacctgagatttacctttgatctcaaattatacctgtttccccttatccaaacactaacccagtgtacacagatttttacctccttagtttttcttaacttttctttctttccatcattactgctgctttgctaatacaggccctcactaaatctagcattctgcctctagtcttattttctccaaatccattttccaaagaagtcttatgtatcaattcagtctcatgatatgactctgaagtgttttttttcaatggctctagattttcttcaaaattaacttccaatcttccttacctcgtgtgtgagagaagaaactggcacacccctttccttatctgcaagcaaaggtggggacgggaagaagttttaactttaaatcaaacaggaaattttgattatgttatatcatttgaataattaactgaaagaactgactgggaaaatcaggaggtctatctgagtttcagttatccccagaggaagaactaggcccaccaggtaaatgtgaggactcatgagcagtgaagaggctgtgtgatactttcatcccaagtgtggctggttcaatatgccagttacgtttgtgattttctatactcaatactgtttctgtacttcaggttcacagggtcctgtttgtgttgtttattctaatgctctctccttaatttcgaatgtgtcatctcattctcctgccttaattggataatcactcttcatcctttaacacagaaatagtcacctcactagttcagatcttggtttgtattctgcgtctttgtttgtctcatgtcttttgactgatgcttgccatcttacttacaatactgggttttagtcatgtttttcagtctgactgtcccatggtccatgaatgccttaaactcagggaatgtgtctcattcatctttgttattttcagagctgagaactgggtctgaaatgttagataatctgtaaacaaaatgaatgaaatgatgttgcagaggagagacatgtgggatagtcatcaacagtaacagagaggtggtcatgattattttccagatggctggggagctccaccttggaaggtccatctctaatggcaaaagactttttaacagggcttcctgaggacataaagagcccaattgttgttgaaatcgcatggaaagttcagcaagtgtagtatcgttgggatgctttgaattgcactctttgtctgttagaagctgaactgggcatccaggagttacaaagaacaaaaatatggcacctgtgctttggaacaactttgtagccacctgtcacttttggggaataatcgtcttctgagaagatatgttttattcctgagatacagagaacacagggaattctctcaattgcttaataataaaactaaaacaaaagtcttcttactctcaaccagactcatttggtctaagggaaagaaaatgactctcccgtgcttcatatgtgataaaatagcactgagttaactgttgtattgattcaatacacaaatagaaaatagaatgatttggctacagacaattcaagtatgaagattgcagttcctcttataaaggaagatgtcttgatactggttttaagtatttcttttaagaaaactctataaaaaccctgttttttggccaatattaaaaaaaggaaaaatactataaaattagtagcatatgtttcttttttcttttgaaaagctaccccagactagaagatgacttttagtaacactgtggctgtatatttatgtgtgtgtgtgtatgcacacatttttctatcaagaactatctctttacttttctattttcttatgctaccctttatttagttacttattttgaactttataagactacctgaagttttaagaatttcttttgttgaaaaaactcgggtttatcaccctagttattccaataaaaatgaagaagaaagcaaggcatcttagaaacagactataataaccattatataaccactagaagggaaatggagtaagaaactattttatagaattaacagtgcttaactactgtttcatgttatactaaaagcactcaacgtaaaataaaattaaatgacccaaccagcataaacatgccaccaaggttgagtaacaaggtgtaagggtcagactggttagggctgccttgagtcttaagagttcatctccaaagccgttgtctcgcccacctcagctttgcggtgacatcccagtgtgcagtgctcactcacggcaccgtcatctctctgagtgatttatgggctcagaagtcatcagcaaggaaactgcaggaagcccctgctgagaaccacgagcactgaaggaaaacagctgcacacatccgagcagattatttctttaacactcgtgtgaaacaaggcatcacgctggacataccgagtcttcctctttttcttttttttaaatggaaatatccttatctgggtgggtgaaggatggatatgacttcttaagtgaaaaacaaccgtttttgtggagctgctgaaaagattaaaacacactcatatacacactcagtttctcttcctcatcaaaaaatgagcaacaaaatagcttactgaatgtgcatgttcacacatgtacatatatttgcatatttaacttatttcgttgaaatcttttctctttctaaaagcaaagctgcactggaaaggaagactacattttatgagcaaagataaaacactctttgaatagtaaattgtttttaacaaaagaagaattcaggctaaaatgagaagaataatcagtttttgggaattttgccttttgtttaagttttttagtttatttaaatctttactgaactagaaaacaaggtaaattattctccaggttttctgcttagcatgccaggaagttctgggacattatttgaggatgttttgacaaacaaaatcatcccgatatggaataaagtcaacattcagtaacgcataattgaattttattttcgtggatgttagaataatgatatctatgtgttaaaccacaagcttcttgagggctttataatgtgtggttaggggactttccagctgccacagatcctgccagatgcttcagcattttggtttgttccacagttgaggaatgaagaaacttattccacagaagtgctgtcgccatgttctgacggctttccacagctgtgtcctcacatgcggtgtgtccataggagctctgtcaatcatgcacttgggcttgggttttaaaatactgatcacaacaacagactagaatagctacttttagttacatgaattagtaccatttggttgtgttttgagatttttttgatatggctatttatataaaattgtctcacacagctatcaaatgcacaggattaaaaatataagaccaaaataatatttaagtaagatgtaaaacatagcaaaaccacaaagttgtaaactcgtttccaaaagtcacgatagaatactgatctcattaacttcaaatggtgctagttatataaagatatgtatgcatgatcaaagcttaggcccgggtgcggtggctcatgcctgtaatcccagcactttgggaggccaaggcgggcagatcatgaggtcaacagatggagaccatcctggccaacatggtgaaaccccatctctactaaaaatacatatcagctggacgtggtagcacgtgtctgtaatcccagctactcgggaggctggggcaggagaattgcttgaaccatggagtcggagcttgcagtgagccgagaatgcgccactgcactccagcctggcaacagaacaagactccatctcaataaaaaaaaatatagcttagatatctctgccatgaacatatgtaatccaaataatcttttcggcaaatgtgtgcacagggaatatttaaaaactcataatgctcgtcaagaggaaattaatttccacttgaactaagccaacgtaaaagtcaaaaatgccctttggaaatttaaacacaaaacaaaagattgtgcgtaaggagtgaatctgtatatataagaataatcttcaacatggtctaaacgttctcttaatacagcccggtttagtgaataacttagctgcgtgaccttgggtaagtcatttagtttcaatgttttcacataaataactgaattgtgagggtatattgaggcatgcatttcgtagtactttaaaaaataatgcaaatttatgatacattattttaaacgttattataaatgcttacattatatacatatgcgttatatatgtatatagatataacagctgcatatctaatgatgattatactcttctatttctacattaaatatatttttatgtgttcttttgaaaagttcgattactagaactaacaatatttcttcattttatgagatggttctcacattaaaggaagaaaaatgccacgacgtctttctcttcagtagtaggaacaagtgagagaattaattgttttaaaatgactgttgaagaatgatgagaggctctctgtacaataaacaagccaaactcaaatatatggctagagttctgggttgttaatgcacacactataaacttttatgttgggaaatcaagctagtgatgtccaaaaatcatttcttttttagatttccagaaattcatgaccaagaatggtttagctcatgtgcatattacctttggacacagatcaagcaaacaaatataaaaaaccaagtgaaaaatgtttgtcaggctttgttaaacggtgaaacaggatacagtcttattttaagagcagacgaaaatttgcattttatttcaatttgccaaaccaatttttgtagaacctcatcatagcaacattcttgtggcaagtaaagtcagcatgttgttcctatcagtagagggggaatcagaaacagattctggacatattccaatttcaaggggttcagaaagaaaattaaaattaaacttcaaagctgaagtgctcaagactaaactagactaataatacataaagtggaaaattaagtaattctaaatgtcatgggcatgtgaatatcactgactcatctttaattttatagaataagttagtgttataagtgacgagattaattcaagctgactaacacaggttgatcattttgttatttatgcttttgtttccctcttttatttttgttaacaagcttagtgcttggcaataataaatgggtagctcaaatattatcttctctaaaaaactttgttgatcttttctaaaaatacatacttggtttattcacacttctatgacaacccttttaactctgctttaaagtttggattatatgtctatttctctgtggttttttggagtgcaaagaccatgttccctgttggattttccttttctacacaaagtatggtatttggcatataaacatgttaaaagtggtgaacaagcatttcacaaaagaattaatgagtgaagcagtaagtgggttcatagcaaccctcagttgttgacgggatcaactagattattacaagcaaatcctgttgtttcattcattcattctacaaatattgatcaagttcttggtataaataaaatacctggatccatagctgttcatcagcccttcatttaaggtgtcatccatgggagtgaagatgagagacaagaaagtggtgcctgaaagctcagcagttagggaatttgaggccattctaggttctaaaaacactgtggtgaccttagcgcttaaactttctggttttcagtttcctcatttgtaatacgaagggatggccttaatggtctttacattccctgtaagtttaacattttattatgatgattgatagtagtactgctgaggcacaagctctgcagggtcctcatcacatacagcctgaggcaggggtatagaatcattataaggatatcagcactgagagactataattctaaagtcatgcgggacgcaaaatacagcagaggtggcacagaggcagagaggaggcacgtggaggtggtggggtgtgtgtgtgtttgtgtgagagagagagagagaaagagagagagatggagagaaagtgtgactgttcaggggaagaatttgtaaaacatgacactgaaactcagtttttaaggatgaattctgcaggggcacagccagggggtgggtgattccaaatgtcagaaacagcatgcacaaaagcatcgagtttagaaacagtggggcataaagaaaattggaagcacttaggttttgttggagaatgaatgtgtttgacaggttgacaggttggagactggaactgtaggtaagaggctgacctaaaggctctggattccaggcctgagggtacagactgcagtctatactcagagagagatgacagatgctggtttcaaaagctcgtggcagctgctgtggaaggcggaactcaaggcagtaaaactaggagcagtgggccttttgagagcaaactgaggtgagaggtgagatccaggtgagagagggaggggtaagagacgggtaagctggagcttgggcagtggcatgtaaaagagttcctagtgaaggacatttaggaggaagaaccaatcgatagcatttggtaatagactagcatcaatcatcagggaagaataggaacttttttaggttgtccaagtgaggggagatgattttcttaacagataccagccacatggaagcataaatatacctgtggtagaaagatgatgaatttggttttggatagattgaatttgaagtgcctttggggcattcagaaggactagcccattgcgtttagaataacatccagaagccttactagcctggccctgaaagcccactgctgctgctcagccctcatctcctgccgcgccccttcatcctgcccctggccactccaccgttcctgcaccccccgatcccctaaaactagcccgcccctgagttttgcacttgccgtttgctccactggcaacaatgtctcctcaaacatctacagggctggtttatgtgtgttcagcctgtttatggagtctccgaagatcatcttgacagagtccccttcggagaccatcccaagctgcatggccctgggcatttctgtcgcgccgtgttttattttccgcaaagcttatacaactatttacggtgatcatggttattttcgtattcgcttgctctctacttgagggaaaagctctgtgagaacagagaattggtttcgcttgccgttgcgaccccgcacctagcacagtgcctgatgtgcactaaccgcgctgacggttgagtaactgtgcacctgcccgtggaactgtggagagagccggcggatacgcaggtgcagcagagcaggacggacggaggagcgcatggacttgcttccattgttcaagcgccttcatgtagtcagatattgctacaaaataagatattttaaccacaactggttttttcactctgacttcccctcttccactcatctcatgttagttgatatgaaaaagtgtattggggacacagctaatgagacattgaattagaatacattagatttggttctaataggatgtatttgtacaatttgcgacatacataatcataaatgccaaattacatagagaaatgcatatttatttagaacgagaagagaaataataatactagcttttgaaaaactaacaaatatctaatcttcacaaagtctagaaaatcacgtgtttttatgttgttttgccggatattgttccatagtccttcttttcctatgtttttggctgaatagtatttaatctcctcttccaatggcagcgcttttgtaatgtcactttctataaaaaggaaagataattctatttttctactagtatggttgatttattttaaacagtgtttagaaaagtatttttagcattataacttgttaatgaaacataaaaatttcaaggattgttttcaaatttaggaaaaacttgttttttcttttttttgttgctgttgttgttttcgagacggagtctcgctttgtcacccaggttggagtgcagtggtgcgatcttggctcactgcaacctctgcctctggggttcaagcgattctcctgctgggactataggtgcccccgccactaggtccggctaatttttgtatttttagtagaaactggtttcaccatgttgtccagggtggtcttgaactcctgacttcaggtgatccctcctcctcagcctcccaaagtgctgggattacaggcgtgagcccccatgcccggctgatctcgtttttcacacagggtttgttacttacatgcttgctgtttttggagctgcttcagatttgtgccctacacatgcagtaattctgataaattctattttatgaaattttccaccaaagttaatgtactgatttctgtatatgctttattatatcatatatttttgaaaagagagaatttccattacttgagagaaaattttcaattcatactttattcattcaatttttaattatgtacatttcaaaatgtatttcttttccattccttgcatgcgtccggtgacaggtcccccaggacattctgtcttggccttgcccctttgtcacagtggaatacaattcagctgagaaaaggagaaagtcctgtcagtcacaaaaccatagatgatcctggaggacattattctaagataaataagccaggcatagaaacacaatactgtatgatcccacttaaatgtgggatgtaaacaagtcgaacccatagaagcagaaagtagaatggtatgagaatgtgtcggtcgaagtgtacaaagtttcagttaggagaactatattctggagatctatttggcggatgtagtaacaataatgtactctacccttgaaaattgctgaaagtaggttttaaatgttcccacaacacaaaaataagtatgtgtgatatgttaattagcttgatttaattatttcagaatgtacacatatgtcaaaacatcatgttgtatcccataagcatgtacaataaaaaataatttaaaacaatgacaaaaatccagaacacacaaaatacctataaaatataaataaaaatataatagccaggcatggtggcatgcctgtgatcccagctactctggaggctgaggcaggagttttgcttaagcccaggagttcaaggctgcagtgagctgtgatcatacaactgcattccaggctgggtgacagggcaagactctatctcaaatatatatatatatcatatcattatatatgtgatataaccataaactataaaatatacatttaaaatattatatatgtaaatatacatttatgaattacatttgagttcttgctgcccttttttttaatggcagcatctaaaagactggaatttgtccaagtagaaaatcctacttttgttaaccattacttggctgaatgtcaataaatgcccatggtatgagaacatggttgtttataagaaatcatcaacagataactgtatatttataaacagttaacccttaaacaacatgggtttgaattgcatggtccactcataagcagattttttccctctctgccacccctgagacagcaagaccaagccctcttcttcctcctcttctgctcaatgtgaagaagatgagaattaagacccttgtgatgatccacttccacttaatagtaaatttatttcctctgtctctctctttttttttttttttagttgtggggggtctctctattttgccgaggctggcctcaaactcctgggctcaaatgatcctcctgcctcagcctcccaagtagctgggatgttgaagcaggtcacaggacatcatgcctggcttccttgtgatgtttcaaaataacattttcttttctctagtctcaggttttttgtaaaagtatagtgagtatagtatgtaatacatataacatgcaaaatatgcattagtcaactatgttatcagtaaggctacaggtcaacagtagactattagtagttaagtttttttttttttgtcttttttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactaagaatgatgatttccaatttcatccatgtccctgcaaaggacatgaactcatcctttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgtgtatatacccagtaatgggatggctgggtcaaatggtatttccagttctagatccctgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtcaatttgtttgagttcatcgtagattctggatattagccctttgtcagatgagtaagttgtgaaaattttctcccattttgtaggttgcctgttcactctgatggtagtttcttttgctgtgcagaagctctttagtttaattagatcccttttgtcaattttgtcttttgttgccatttcttttggtgttttagacatgaagtccttgcccatgcctatgtcctgaatggtaatgcctaggttttcttctagggtttttatggttttaggtctaacgtttaagcctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagcttcgttcttttggcgtaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatcttgattcttcctacccatgagcatagaatgttcttccatttgtttgtatcctcttttatttccttgagcagtggtttgtagttctcctcgaagaggtccttcacatcccttgtaagttggattcctaagtattttattctctttgaagcaattgtgaatgggagttcactcacgatttggctgtttgtctgttgttggtgtataagaatgcttgtgatttttgtacattgattttgtatcctgaaactttgctgaagttgcttatcagcttaaggagattttaggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgctgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttggttggtaaactattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctatgggatcggtggtgacatcccctttatcattttttattgtgtctatttgattcttctctctttttttctttattagtcttgctagcggtctatcaattttgttgatcctttcaaaaaaccagctcctggtttcattaattttttgaaggtttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgcgtctttgttctcgttgatttcaaagaacatctttatttctgccttcatttcgttacgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggagagttagctcttcttgttgaattgatccctttaccattatgtaatggccttctttgtctcttttgatctttgttggtttaaagtctgttttatcagagattaggattgcaaccctttttttgttttccattggcttggtagatcttcctccatccttttattttgagcctatgtgtgtctctgcacgtgagatgggtttcctgaatacaacacactgatgggtcttggctctttatccaatttgccagtctgtgtcttttaattggatcatttagtccatttacatttaaagttaatattgttatgtgtgaatttgatcctgtcattgtgatgttagctggttattttgctctttagttgatgcagtttcttcctagtctcgatggtctttacattttggcatgattttgcagcggctggtaccggtcgttcctttccatgtttagtgcttccttcaggagctcttgtaaggcaggcctggtggtgacaaaatctctcagcatttgcttgtctgtaaagttttttatttctccttcacttatgaagcttagtttggctggatatgaaattctgggttgaaaattcttttctttaagaatgttgaatatcggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcaaggagtatctttgtggcattctctgtatttcctgaatctgaacgttggcctgcctttctacattggggaagttctcctggataatatcctgcagagtgttttccaacttggttccattctccccatcactttcaggtacaccaatcagatgtagatttggtctcttcacatagtcccatatttcttggaggctctgctcatttctttttattctttttctctaaacttcccttctcacttcatttcattcatttcatcttccatcactgataccctttcttccagttgatcacattggcttctgaggcttctgcattcttcacgtatttctcgagccttggttttcagctccatcagctcctttaagcacttctctgtattggttattctagttatacattcttctaaattttttttcaaagttttcaacttctttgcctttggtttgaatgtcctcccgtagctcagagtaatttgatcgtctgaagccttcttctctcagctcgtcaaagtcattctccatccagctttgttccattgctggtgacgaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgagatgtcagtgtgcccctgctggggggtgcctcccagttaggctactcaggggtcaggggtcagggacccatttgaggaggctgtctgcccgttctcagatctccagctgcgtgctgggagaaccactgctctcttcaaagctgtcagacagggacatttaagtctgcagcggttactgctgtctttttgtttgtctgtgccctgcccccagaggtggagcctacagaggcaggcaggcctccttgagctgtggtgggctccacccagttcgagcttcctggctgctttgtttacctaatcaagcctgggcaatggtgggcgcccctcccccagcctcgctgccgccttgcagtttgatctcagactgctgtgctagcaatcagcgagactccgtgggcgtaggaccctccaagccaggtgcaggatataatctcctggtgtgccattttttaagcccgtcggaaaagtgcagtattcgggtgggagtgacctgattttccaggtgccgtcggtcacccctttctttgactcagaaagggaactccctgaccccttgcgcttcccaagtgaggcaatgcctcgccctgcttccgctcgcacacggtgcgcgcacccactgacctgagcccactgtctggcactgcctagtgagatgaacccagtacctcagatggaaatgcagaaatcaccgtcttctgcgtcgctcacgctgggagctgtagaccggagctgttcctattcggccatctttgctcctccccccttagtagttaagtttttgaggagtcaaaaatttcaactctgagtcagtaacccccatgttgttcaaggatcaaatgtatatatttccatatgtgtgtttagatacatgtatgtgtgtgtgtatatattcatgcatgtgagcctatgtgcgtgtagactattctctaaaactcaaaatcagagaaaaataacctttgtgtaaagtaaaatatatcaatgaccataatcagatatgaatcataattctaatatgtagttgacgtatagaaaaaagcataagaatttgtattgatatgtttatttaaattaaattataaaattgcatagagttagaaaaagcaaaattagtttattgcaattattattttctcaacttgatattaataaagttatttttataataatggcacatattaaaaagcaattttactctgtccttcagagcatttgctccacattggagctatttccattgtagatttttttgtaaggctataattctatcacatgggcagattgtgctaaaacaagcagaaagggtcacaaccttctgtctaacctttgctatttagaatgaacgcccagggctttcgagaatgtaaattgtcctggcctgttctctgacaaaataagaacatacagttgaagaattattttttgtaaaacctaaatttgccttttttcctcacactaagctcttctcaagtgttaagtttaaagacagttaattatcagctattctttagagcacgggaaaaacagtttagtactcagtaaagtgagcatgcaatctaccttattcctgtttttttcgatggatgaatgtgaagaatttacacagtcatgcaagagaggcaacgatagtgttctcttaagaagacaaaattataagattggaggttaacacttgctcaacccagtaaaaaggcatttggtagatatttctgatctttccctgactgatgaaaagtgctgatatttctaagaaactggtaggaaactttaaaaaaaaaaaactccccgaagcctaccaccaggcatgccatgaactttcagatgacacatcgtgctactaatttttagtgacctttgctaaatttatcaaaaaatgctctcactaaatccatttctgtagaaataaagaaaatatccgtgatgtgcaaactcacagtacaaatctgtgcggcttctgactgcaaaagatcctgcatatttcatcaaagcctcagggttgtggttattgatgtttcccagaacgtggagtgaaaccccacacaaacagattgccaaaggggagaaaactatgatttgtgaaattcaacattatctcttgaatgcctttgctttttattttgaacatactttattttttagaccagttttaggatcacagcaaaattaagcagaggtatagagatttcctatatatccactgcccccatacaggcatagcctcccccattatcaaaagcccccacaagagtggtaaatgtgttacaactgattaacctccattgacacatcattctcaccccaaatttaccttaggtgttagacattctgtgggcttggagaaatgtataatgatgtgtacacacaattacggcattatacagggtaggtttcttgtcctaaacgttctctgtgctccacctattcagtctccctctctcttaagtctgggcaaccattgattatttttactgtctccatagtttgcctttaaaaaaatgtcatatagtggctcacgcctgtaattccagcactttgggaggccgaggcaggcagatcaacgaggtcaggagttcgagaccatcctggccaacatggtgaaaccctgtctctaacaaaaatacaaaaattagctgggtgtggtgatgcttgcctgtaatcccagctactcagagggctgaggcaggagaatcacttgaaccagggagttgacgttgcagtgagccgagattgcgccactgcactccagcctggcgagagagcgagactctgtctaaaaaaaaaaaaaaaaagtcatatagttggaatcgtgtattatgtagccttttcaatttggcttttttcacttggtaatatgcatttaagtttcttccacatgattttatggcttgaaagcttatttctttttaacgctgagaaaatttccattgtctggatgtacaacggcttattccttcgcctattctaggctatctaaatttcttctaagttttagcaattatgaatagaaatgctctaagtgcaagtttttatgtagacatgttttcatcttctttgggtaaataccaaggagagtgattatagtatcatataataaaagaatgtttagtttggtaagaaacggtcaaactctcttccaaagtgactgccattttgcattcccatcagcaacgaaagagaattcattgttctttaacctcactagcatttggtgttggatctggagcttggccattacaataagtgagtagtaatatctcattgttttaatttgcatttccctgaggacgtatggtatggagcatctttcacgtgcttatttgccatctgtatattttctttggttgggtgtctatttaggtctttggaccattttttaattaagttttttttttttatcgtttagatttaagggattctttctatattttgaatagcagtcccttatcagatatggcctcccacatgagaatgtaattcttctgacagtgcctctcatggagcagaactttttaattgtaatgaagttcagtttatcaattgtttctctcagagattatgcttttggtatatctaaaaagtcattgccaaactcttgctaatctagatttttctcctatgttatcttctaggagttttataattttgtgttttagaatccactttgagttaatttttgtgaagagtataaggtctgtgtctaggtttatttatttttgcatgtggatgttcagttgttatagtactatttgtagaaaagactgtttttgctccatcgtctttgctcctttgtcaaagatcagttggctctatttatgtaggtctacttctgggctcctcattctgtttctttgacatgtttgtctgttgttttaccaataccacactgtcttgattactgtagctttatagtaagtcttgaaatctggtaatatctgtcctccagctttgttattctccttcaatattgtgatggttattgtgagtcttttgcctttccatagaatcagtttgtcaatatacactaaaataacttgctggaattttgattggggttgcatttaatgtatagattcagatgggaagaactgccagtatttagcctctctatccatgaacatgagatgtctctatttatttagttctttgatttttttcatcagagttttgtcattttcctcctataaatcttgtacatattttcttagatttatatcttcggtatttcattttgggtgtgctcatgtaaatggtattatgcttataatttaaaattgtacttgttcattgctggtatataggaaagcaatagggtttcgtatattaactttatgttttgccaccttatgataagttagtttcaggaggttttgttggtgttattaagttattgttgttgattatttttgattttctacataaataatcatgtcaactgcaaacaaagacagcttttttactctattggtgtgttttatttatttattatttatttatttacttatttatttattttctcattgcattagttagggcttccagtgtgctgttgaaaagaagtggtgagaggtaatatccttgccttgtttttcatcttagcacaaaagtttccactttctcaccattaaatgtaatgttagctgtatgtttttgtaaatatcacttgttagtctgaaaatgtctttttattattattattatactttaagttttagggtacatgtgcacaacgtgcaggtttgttacatatgtatacatgtgccatgttggtgtgctgcacccattaactcgtcatttacattaggtatatctcctaatgctatccctccccactccctcccaccccacaacaggccccgctgtgtgatgttccccttcctgtgtccatgtgttctcattgttcagttcccacctatgagtgagaacatgcctgcaggttctgtccatttgtggtagagggacattaaagtgttcaactataatagtgaatttgtttctctttgtggttctatcagtgtttgtctcatagctctaatgtctgctctgaattcacataactactcctgctttctcttgactaatgttagtatggtgtatttttctctatttatttacttttgatctataggtatctttatatttaaattggatttcttgcaaacaatatatagttgagtcttgttttttgatccactctgccaatttctgactttcaattggtgcatttagaccattgatactccaagcgattactgatatagttggattactgtctataatattttttattcttttctatttgttgccctttgcttctatttttgaattctacttctttctgcttttttgtagcttgagtttgttttttattgaacagaatgaacaagaagttgttggctcctcaaaatcaattattatttttatatcaaactggaaaattaaaactaaacttcaagttttatcagcttgttatttgacaagtacttttttttcccaggcactgccctttacatctaagccaatgggttttctatctatctgtttcctactttctagtttaggttttaatagtttttaaatctttgtggttattattgatattctcaatttttactattaaaatgaagcattatggatagtaaagcatattttgaagaatttctacggtgattaaaaatttttctattttgtaatatggtgttatttttacatagaaaaacacctgatacttttgagacctcagttatctctcacataaactctcactgaatttatctgtacccaagtcatggtgttaagaagtcttgctgtgaaatgtagaggtcagtcacatacatgttgaaatacaacagaatgtgtgtgggttgcttccgggctcttctgcttaccagctgtgtgtccttgcacaagttaactaaattcttgcctgtcagcttctcatcagtaaactagggagtataaagacaatccatagtattattgtggatgttagctaaaatattttaatgcaaagtatcaattaaaattttttgaaatataatagatgtcccaaaatgctggcttaccattcattattattttaatctttgcatttcagtcttttgtgatactttctccaacatacaacagtctagaatggaaatatgggctatatttttgaatttctaagcattttacctggctattagtatgaattcaagaagcatttgttgaaagaaaaataagattctcaaattgtaagcattagtgcaaacatttacttggccactaagaaaatttaataattaattaatatactttagaatttgtttcaaaactctaaatgtttatgataaaactaaactttctggtatttggatttattcttaataacttcttttcctacattgcctttgtgaagttttctctctaataagccacctttaaagtttgaaactgcagaatcacaaagtgtacacttgctgcatactgtagagtccttttggttgcaccaaatcctgttgagagttttaccattttaataggcatcagtcagcgtctgcaaaaactttgcacacatgtaaagctgttgctgaaatcttttattatctggagaaggaaaagcactaattttttcatgccataaaattcctaaaaatgatgctctgatggtaacataatgccctatatgtgagtaccatggttatagatttaatctaaaatatgaaatcatcaatactatacagccaatatcaaaaacatgttgatcaatccataaaagatatgttgatcaataatgatcaaagcttaccgataccaccgtgtccagtgttcattctaacagcacagcacaatggttccagacaattacctagtcttgttctccatatcaagtggagttattagccaatgggtgaaaattttctgttaagcaagatgaataaattctagacatcttctgtatagcattccacctataggcaaccatattgcactgtacattgaaaattttgttaagaagatagatcttacgttaagcgttcttaccacaatttaaaatagttttttaaattagctagtaaaccttttttatggtctagatactaatttccaaatataaagatggataatttaattgtctttaaaatttaagcccaggtgaagtgtcaagaatgtcagcatttatttctgtgttgacaaatcagaacataaacataaacaaatcaaaacatcaactacattcaggtctccaactttaatatcaactatctgttaattgattttaggtccacatctttgtccacaatggcacatttctaaacgcatcatctggaattaaaactacttacctactctctatacagttgccacttaacgggaatttcctggttgggtcaggaatgtgtttattcttatgcattctttgcaggctgcattgcccagagttcaatctggtttcatattgtgaagcacaggggagagtgggaagaggtaaatattccctacaccttcccacccatccaccctgaccctatcctcttccccactgtctgagggctttagacagtggctacatttttccatggctccgtccagaaaggtccactgttacttcagttttaaccaaataatccctgcccctgagctctggtaaatgcctcttctctttgctactctggcctcggagaaataattccttactgggattcatgatatctgggttttctctcagtgatttcactggtgtctcagcccttccattacccttgcagccagtccccaactcgaaattattgttgtccagggaactcaaacaactcaacaagaaaaaacacaggtagccccattgaatagtgggcaaatgacatgaacacatatttttccaaagaagacatgcaaatagtcaacaagcatatgaaaaactgctaaatatcactaatcagagaaaaatcaaattaaagccataataagataatatcttacagcattaaaaaatatggtggtgaggatgtggagacaagggaatgctttgtacactgttggtgggagtgcaaattagtgcaacctctatggaaaacagtatggagatttttcaaagaactaaaaatagatgtaccatttgacccagtcatcccagtactgtgtatctacgcagaagaaaagtaatcattacaccaaaatatacctgcactcatatgtgtactactcaaagcagcaaagatatggaatcaacctgagtgtccatcaaaggatgattggataaagaaaatgtgttattatatatatatacacatatataaaaacacattttcgtgatatatatatatatatatataccatgaaaaaatactcagctataaaaaagaatgaaattatgtctttttcagaaacataagtggaactggaggcctttatcttaagtaaagtaactcagaaacgaaagtcaaatacggcatattctcacttataagtgggagctaaacaatgtgtacacatgaacatagagagtggaataatagacattggaggcttggaaaggtgggagggtgggagtggggtgaaggatgagcaattacctctcgggtacaatgtgcactatttgggtgatgattacactaaaagctcaggcttcaccagcacataatatatccatgtaacaaaactgcacttgtaccttctaaatctgtaaaaataaaaattaaattgtccttatttcaaatgcagtaggtggtttctgttttgtttttgtgtttttgctttttgacaaaattgcgatatatatgcgctgtataatgatatcctaggagtcacgtttctggatctactttttcagggtcatttctaagcattgtggattatgtatctgttttagattgaaaatactgaaccatatagctttcatgggatttgagaatgaaatcatgttttccctaagaaatgatatcttttcttctaaaaacacaaagcagtctaactttgataattaattctaatatgcattgggaacacatgcataggtagatggaaagtttgatgaaatgctaccatgtgatatatgattttcatatatatctcatttattcttgcaaccactcaacagggatattatgtaacataacttgctgttgtgaaatctgtaaaatagctacaaaccaaatccaaggctgtctgagtccaaagcctagaccatttctactctgtaaaactatttcttcttcagagaaaatatttaaaacaacagtgacagactatgaatgttcaatatgtataatatggaaatttgtctcttttttctttatttttcttgctgtattagaaaaactccttgcagcgttttaagattaatgttcctttccctctaggaaagaggatagagcaaaacaagttttgttttattaatgatttcagtcctggatttaataaattttaaacctacactatgaaattaaaagggatgatgcattttgggatgaggatgagttagaggtagaatgacataaagataaagaagtgaaggaagtttatcaggcgtgaaacagaagcctggggcacgatgatggggaaggtttccaagtgggaggagctactgattagtgagtccagagggtagttcccaggaaggagcaacgtacatcaataaggaggttcaaaaacaaattgtctgtacctggtaaggacagaagtacaaattcattggtctgtgttaaaagtcttgttccttatcaaaatgcaatctatagagaacttcgttaatctggatattaggcaggcatcatgctgattcactaaatgatgacatcatctttatgagccttgataaaataaagtacaaataatccaaaatgtcctggaaatatacatgcatcatggaagatggtaggtaaacttcatggagaatcaggggcttgacaaattgatgttcttagaggattgaggtatgccacaggtagggaagaaacggttgcatgttgcacctccagttactaaggcagaagcccagatcttcatggattttggaggtagcattatttattgggtgatatggtttggctgtgtccccacccaaatctcatgttgaagtgtagctcccataattcccacgtgttgtgggagggacctatgggaggtaattgaatcacgggggcagttttcccccatactgttctcgcggtagtgaataagtctcatgagatctgagggttttataaggggttttccctttctcttggctctcattctctcctacctgctgccatgtaagatgtgcctttcaccttccaccatgattatgaggcctccccagccacgtggaactgtgagtccattaaacctctttttctttataaattacccagtctccagtatgtctttatcagcagcatgaaaacagagtaatacattgggaacttggaaactatcagttttaagtggaatccagagaaacagagggctgtgtagcacaatctgttctgcctcttaagccacatgactcagtaaatccagagatgctagatgtatctgtaatagataatgaagctacatggagtctctgacaagcccaaatataagggttgcagaacagacccatagggttttagataaaagccatgccttccttagcgtgcaactggaccccagcagactgagcaccgtaatgcgggatatgaagtgattttccaatcattctttcctcatgagttggatatgttcagatctgtcaatttatgacactgagggtttgcaacatcaatatattatacaatatttgatgggaaaagtattgtactgatgtttgtagttgtgtaacaaatcaccataaatttagcatcttaaacaacacgcatgtattatttcacagattctatggatgaagagtgtgggcacagattaactgggtcttctgcttagggtttcaatggctgagaaatcaaggtgttgactagactgttttctcatctagagtttactggagaaaatccacttccaagttggaaaaattcatttccttgcagtcacagggttaaggtctccagcttcttgacagctggggctgggagccaccttcagcttctggaggctgccagtagttctgagaagccaccggcaattcctgccaatggccacttatacttcatcaagccaataaggagaatctctgtgacaagccagcctgcaaaacagggtaatatactgtaactatcatgtgagtgacatctcatcacattcaccaaattctatcgattagaagcaagtcaaggtcccattgacattccaggggatggaatgaggcacaaggcattcagcaccaagaggtggagatcatgggggcatcttagagtctgcctgctacagataaattcagagttaggcctgaaaaggtccagaagacacaagtaagttgtagccatgagtagcccaggtgcaatatcatatacctcagtagcaccagtgtcttctcctcagctaaggaaggtgtcaagagagacatcttatgatcaacctatggaggaagaaaaaatttgtggtattttgcatgtcggctcagggcaaagagtgcattttagaataaaggaggtgtggcaacgtgtgtgcatggccgtcagatgcacagggctaagaagcaactgctagaaaggtcaaatagctgtaataggttcagctcatgtggaacttgggacactgctctgtatgtttgagactctctcctccagaaaacagaatatttactgagccagcagtcaatacatggtgctgagactgacatgtctagaaaacacaggtctcaggaccacagggtgaaagagttgccccctcaccatcacacgtgagtatccacttgaagaatcactgtgttttccagtctcacaacattaggctctcctggattagggataatggttcccaagaaagaactgcttctatagggaatatagaaagaattccacataatataaagttacttcaagttagaactgctgtctgattactttgggtttctcatactaacgtactcagaggcaaagaaagaagatactcagctaaggaggtaattagtccaggttattatgagagacagtgacaaatgtagaatccaaaaagactaatatggccatctcctgttatttatctgttcagtaagaacaatgaacgggcacttatagcagtcatggtccagtaagaggaagaaagtatggattcaactctgtaggggtgatggtttgagtcaacgcaacagaccagcaacccagaccaaacaaagagatctgtcattcttcctgtgagtgacaccggaactgctctcgttaaccttacactgttcgtctctgacttcctgttccagacttctctgttggcacattgagagtaatgtcatggtgagctgctgtgcgctcaagaatgtgctacctggaggtttgggaagttaaacctttagagaaatcttttgaccaaaggaacttgggagaaaatggatacacattttcctataacttctccagaaagtcttgagacatagtccatagacttccgtaggagatcaacgaaatgaaggaagcagctgtcgatagttgtggctaacgtaaaaatgtatctctatattcagcctcccttctcccctgttttgttcccctgcttcctggattccactcctcgataaaatacttgcccttaagcctttgccttagctctggtgtctgaggaattagagctaagatactgctcattatgagaatgtcaacacccacgccaagtctactaattccagatgatctaaaattttaagacccttagggatccagttcactggaggattctactcaaaggtatagagaaaggcctttgttcaagctgcacatcacattttgttaattaggcatggaagtcactctcctcgtacccaaggtctcacatgtgctctcctaacgtactgattagcatccaagcaaaaccacaacccatcatataccactttaagcttctcttcccccagtggtattattgctctgtcctaattacgtgacaacaaccccacggatttgaattcaaatggcagcaagcggccaaaatgccaatttcttcatctactaatctgtacttctatagtttctctccgaatgttttcttcctccattttaaagttatatttctgtacatgaataactccattatacagttaatatggtaaaggaaacaaactctttcttatgtcaatgacacctttaatactttttttatcattcctctattttaaaatcttactacattttcctttttgaaggtattattttcccatatgcctacagaaaatatgcccattggcaaaataatgcaaaatgatgaagataataaaacaaaataaagaaaataaaaatccacagtgttcttgtttttgagccatttctttgaatggatacttagcctttgctattacgttattatgactttaacaccatcattgaaatttgcctggctgggcggggtagctcactcctgtaattccagcactttttgaggccaaagcatgtggatcacctgaggtcaggagttcaagaccagcctggcaaacatggtgaaaacccatctctacaaaaaaatacaaaaaattagctggccgtcgtggtgggtacctgcaatcccagcgactcaggaggctgaggcaggagaatcatttgaactcagcaggcggaggttgcagtgagccgagatccatgccactgcactccagcctcggcgacagagagacactccatctcaaaaataaaaaataaaaaaagaagaagaaagaaaagaaatttgcctatcactgagaacagttaatttcatacagggtcataacacgctagatgattgcactgttattattataggtagataacagaaggccaggacattagtctgttttgcattgctataaaggaatatctaaggctggtagtttattttttgtcttggctcatggttctgcagactatccaggaagcatagtgccagtgtctgcttctgtgaaagcctcaggaagcttacaatcatgacagagggcagagggggagcaggtgcatcacatggtgagacagggagcaagagaggggggaggtgccaggctcttctaaacaaccaggtctcgggaagtaagaactcataactgcagggagggcacgaagccattcgtgaggggtctgcccccatgacccaaacccctcccaccaggccccacctccaacgtcagggatcacatttcaacatgagatttgcaggggacaaacatccaaactacatcagcaagttctggactaaagtaagacacatttggtttgacgcccttccattttatttttaatataccctcttccaacctaacagacatcaacccaggtctcgttttttcctgatcagattggggttttattttaaaccaagcccatgttaacagccagttttttttccaaggaaaatatccccattattagctatggccaggattttctgaattctctttcctatttgcactttgcatttttactggggcttctctgcccttcataagaggcgcgcatccttagtggggcactgttaaagcagccgcgtctccctcagccctggctacaggcagcaggtgtttcttccatcttatgcccatactccgcctccttaggctttctacacaagggaccttaagtggaagcccacactcttcttgcaatcaaagctttctctttttcctgaggttcactgatgttgttgattctataatcttttgtggggttttaatttgtgataatgtaaagtgttaggagtcccccaaagcatttatattatgagaggttgttcccaaatatggaaacgtgttcaactcacagtatgcatttctaatggtagaatttacccccctttagtaggtgggtgctgtcaaaggggagtacatgtgtgtctatatggctctgtgtctgtccttgtctacctcacttctctacttattatctatccatttaccacccattctaaatagatctgatggtaatgccagagaagagacattatcatattttactgaataaaataatgagaaaaagcggggttgaagtcacatcacagaccgagaaaaacttctagagtattactgtgcagaaaatgcagtggactagaggaaatttagccagtacttctttctttatgatcctattattttcactacacagaagccagttttctccctgctttttcacttggtaggatttggccagtgtctgttagaaatttggttaaagctcaaacaagtcggattttcaaaagcaacctgaaggtcagctgtttagttttatgcatttccttcttctctgaccaaatactgcaagttctgccaataggcaaaggcaaagataatgtattttgtatggcctagttttgtatccatatgaaatactatagacttgtttgaggttacagtttgaatattaacaaaaatcaataaagctaagatgtactagataacattcaaagtccctttgaaataagaagaaatgctcaggaaaatctaaaagtaaaatatttatttttctcaattgatatttccataagtcatttttattttttgctcttaataaagaaaccataataatgtgagaataaagtgaaatcagtggtaccattattgaatacttatttaataccccctcactacaacaccaccccaagtcccattgctcaaagacaaccacttttgtttctctctctggtatttgggaacacatttattaataatataggtataatgtaattttctattgagtaatttacatgtttaaccattacaggcattttgctttcctgttccaatggataaaaattcaactctcctgatagaaatttcaaagacagaccaggcttggtggcttatccctgtgatcccagcactttgggaggttgaggcaggcggatcacaaggtcaggagtttgagaccagcctggccaacatggtgaaaccctatctctactaaaatacaaaaaattagccgggtgtggttgcaggcacctgtagtcccagctactcaggaggctgagacaagaatcacttgaacctgggaggcggagcttgcagtgagccgagattgtgccactgcactccagcctgggtgacagagtgagactccatctcaaaaaaaaaaaaaagagaaatttcaaagagaaaaagacaaatcacctagccatgagttagatttgttacatcataacatttcagtgttagattggattttccattgtgtctagttcacccagccatctaatgcttgaagtttttctaatcactcttttctttctcagaggacgttgacttctgcacgaatccctccaggttctgtgaaatatttctcaaggttgtcagttgcccatttcataaccctacagctaggatttctctccctgtctcactatctctctcctccacctcaagcctcagatcaaaaatctgtattcttgggacttctcccttttgagctagaattccacatggaatcactactgttctacctgagagatctataaatattttaaagacaatattagtttctgtccttagttttttctcttcaatgttaatattataaattctgaacatgaatatatgtcaagttctctttccatctttaatgctatacgtaaatgttttaagtttcatggccaggcgcagtggctcacgcctgtaatcccagcactttgggaggccaaggcaggtggatcacaaggtcaggagtttgagatcagcctggccaagatggtgaaaccatgtctctactaaaaacacaaaaattagccgggcgtggtggcacacgcctgtagtcccagctactcgggaggctgaggcaggagaatcgctggaacccaggaggcagaggttgcagtgagccaggatcgcaccactgcactccagcctgtgtgacagagtgaaactctgtctcaaaaaaaaaaaaaaaaaaaaaaaaaaaaaggacaggcacagtagctcacgcctgtaatcctagcactttgggaggccaaggtgggtggatcacttgaggtcaggtgttccagaccagcctggccaacatcatgaaaccccgtctccactaaaaatacaaaaattagctgggcatgatggcacatgcctgtaatcccagctactcaggaggctgaggcaggaggatcacttgaatccgggaggcagaggttgcagtgagcagagattgtgccactgcactccagcctgggcgacagagccagactctgtctcaaaaaaaaaaaaaaaaaaagtttcttgtttctcgatgccgcctttaaagtgtagtgtttggagtggccgtgccagggagtgtctccacctctctttcctcacccacagatggttctggggaagctgcatcacagccgtcacttgtattgagctcacgtgcaaccaaaaccctttatagagttgggtttttagctgtgtctagacgcttttatgctgaattcttgaacacacatagactcagctggactcttttacgctgaattcatagacacagctagactcttttatgctgaattctaaattcttgaatttaagaatcttaaaattcttgaattttagacccaaaacagtgccaaatattttatctttgtcacattttctttctagtcagagctgacaggttgttaaatttaagaattttttgaatactggttcttttctattttctatttctgggtatgtccatatctgtatcaactaaaaatgtcccaagcctgccattactaccagtcccttagccattaataaagacatgcaaccagaaatgattgaggacagacctgctgggcatctcctgtccaggttgacactgattatttgatcaataattttgaaagatggattgtgtataagttacaatatatttgatattttgtaaaaaaaaaaaaaaaaagactcagtaagcccaagaatctaagaaaattaatactaaataactttcccaaatgttgacataagaaaaaattatacctgagaaaagcattattaatgtatttttaaaataatttatttaaaaaaattattgtggttttcttacataactagcaattatctataggctttgagaaaaatgagtcaaagcggaacacatactcacattactatagatgttttaattcagctgtaaacctttggaggataatgaccttgttttgccctatgtgcgtggggcagagggaggcaggaactcaggcctggaaggaacctcatgatagtgttgctttttcctttttccaacaaaaagttagagatgcatgatcaataaaataacaagcatataattgcattttgaggtaagtgagcagatgctgtgttgctagggaattgttgttgaatgagtataaaatatgaatttccagaaagttgtcatgtaggtaatatctgattttattggcaaggaaattctcagtccctgtgaagtcatcattaccaagttttgagaatttaatagggagtcaatgtatgcattggtgtgtttctttcttccttctatttcaggtactagtctcatcttttcccagaaacgaaggttggtcagaccatctgggattagaaacagacagcaaaagtgtccctttaacctgaggacactacaggaaaggtctttctttcctttgggcattttcttcatgattgctttacccctatactcatgctactgagctctctcctttccattttgtgaataaactgggactgaagataagatttggaataaatgtgtacttattatcaaaatgaatattttatctcttgctaattcgtagtaatttgcattggttagttcttgaagggaaatgatctaaaaatgtaaagatttatgaatacggaaaaacatgaactattatttcttttaatgtttccctttagtcaactttaggaatacaaaactgagttgttttacctcccttaagttttgggacatgtgattccagctctgttcctgttgatgacagaaagtcacattcaaatctcttgatatcatatctaaaaatcctgatttgtggtcaggcacggtggctcacgcctgtaatcccagcaatttgggaggccgaggtgggggatcacctgaggtcgggagttcgagaccagcctgagcaatatggagaaaccccatctctactaaaaatacaaaattagccgggtgtggtggcgcatgcctgtagtcctagctactcaggagactggggcaggagaatcgcttgaacccaggaggtggaggtaacggtgagccgagatcgccccactctactccatcctgggcaacagagcaaaactctgtctcgaaaaaaaaaaaaaatcctgatttattacagaaaggtccagagcaaaagcagcattttgaacttggtgtatggttaactggacagggatgtggatctgaaggagagcagagtatttgtactagcaaagggacagaaaggacaagttcgggtatcaaaaaaataggtgattaaaactataggaaaaaaccataagggtatgaattgccttgtaaagaaaccattttgagaaggagagcaggaagcaaaattagttaagaaggaatgtttttaagacaaagtaagtattcaacagtaaaaggaaataaaaggtttattgaatgttcccaacacaaagaaatgatgaatgtctgagttgctggatatgctaatgaccctgatctaatcatcatacattgtatgtattgaaacatcactatgtaccccataaatactcataattattatttgtcaatttaagaatattttaaaatcacacaaaacacaatagcagcattattatgtgacaatatactcccaaaatacagaactagtaagaaatattatcaatagacatggcttcaaagaaatagaaattgttttctaaaatatagactttgggcagtaaagcattgcagattgagagaaaacattctttttcccaaagagaagacaatttccaaataagatagtgtccataatgctttgtaactagtgggtgcctcttacgctatcagcaaacttagttccagttcaccctcctcaccttccacccagagactttagggcatgttgctgggggtcaaccttggaagatctctgcatttgaagcaatctactgtctccctgggatgggccgctttctcctttgagtggccgtaacccagcccagagctgctttcgcagaggcaatcaagctatggaaagccctgctcattttgtgttttcagggttgcctttgtttatctctaattcttaagggaaaatgcttctgtaggctcaatgagaccgagtggaaaccatagccaagtcctacagcttttgtagtttctgtgctggggagactacagatctatttggaaaaatagaaactgcattagatcaagctataactttaatatttatgaaaaagctctaattgttgactctctgcagctgaattctacattaaaccctgtagacagggtttataaaatatacatgtacaagttcatataataaggattatttgataatggtaaaaaattaaatgagtattcaaatataaacataaaaatatggcattttctcttctactctaatcctacagtgctatagtaattttttttccttctgaaacctttatggaaaccctaattaacgtaagtcaactgttcaacatctaatattgttgaaaaccttaagtaggaataaaattaagcatttatatttaagtacagttgatactttaaaaaattcttacataaaatctttaattatgatttgctttgtgtatactggcttctgcgatcataaaagaaattacttaactttgccatctctaaaagaaaagtccagagttggcattgtttccagcttatttttcaagacaacaaaaaagtaattttggaaaataagttattttagaaaataaaatataacattttttagaacctggagttctccaaatagtttgttctttcgagaatatgattgagctttctttgccactcaggttcaaagcactgggaagaagtgaaaacaattcaattattggatgcacatttttgaaagggccttacattgctaaattcaggagttgccataattctatgtcatgttgcaagcaagctaaacatcaagagaggtgttgtaaccagctaataattataaataatgtgtgaatactgtcttttttttctgattcctgtgagaaatcagaaggaacaattgcaaggaaatatgaaatcatgttcttcaaatccttcgactctgaaacacagataagaggactgctgacatgtagggaccaatagaatgacagctcgttgcatacaaagataaaaaagacagtgagtgactttggagttgtgttgccttctgcagccgagagaatttggacccaactgtcaaatgactattttttttagaggagtgtaaatggtgagtgtgtacggtgagctagtggtatggttcagaaggaatctgcagatgagctagtggtatggttcagaaggaatctgagcgctaataaacacccactttcccagtaagaaatgtagtgtgctgtgtattagaaagcttcatagactccagaaaaattcaaagaactaaacatgaatcctcctgtcagtaagtccaaggaaacctagactatttcatgcagaaatagcacatttataccgagtatcacttatcacttacagattatgttctcattcattgtcttgtttttaatcttcaaaacaatcttgaaaagaaaatccttgagagttgaaagaaatttaagtgacttggtaaattcatatggaagatggtaaaacattattgtcaatgtgctgcgtcttgcttaatgaatttcctcaaagttagagacagtgtctataatacttgtccttttaagctaagatcataaaatcaaccagtaagatgataaaatatgtagcaatgtatctaaatttatcaagctctgtaaaaccctaggatcaagcagtagcttggagaggtcagaaagctcctgagcttgcaccttcttaagaagaggagaggggaggggaggggaggaagggaaagaagagaggagaggagaggggaggggaagggagtggaggggacgggaggaagagagaaaagagaggagaggaaaggagaggctttagcatgaagcctctggatgctcagattctgctgggaattttggcagcgttatggaaggtccatcacaatcttgaagagaggctttcactatataccaagcatggcttagtctgaactggttcatctggacccaactctagccaactctagtgtgtctcatggtctggtgtgggccgagggcctccaggcctccagagccagccctgtccacaatttggtaatattccattgtttccttacagagctcaagattgcaaaccccaaggtgagaaatggaaaaaagtaatgggacctttaagctctgacgttctatgttcctacagcataagctggtggcttctgcgggtctctgcagccacctcagggcctttctgctcttctcaagagcaagagaagcagaacttcttctcttgcactggaaatacctgtggggtgtgtgtgtgtaagatggacattgagtgaagggacatgagcttcttgaatatcatgttttacgcaaacaaatgtttctgtttttttttttttttttttttttttttgagacggagtcttgctctgtcacccaggctggagtgcagtggcgcgatcttggctcactgtaacctccgcctcctgggttcaagcgattctcctgcctcagcctcctgagtagctgggactacaggcgtgcaccaccaaacccagctaagttttgtatttttagtagagacggggtttcaccatgttggccaggatggtctcgaactcctgacctcaggtgatccgtccaccttggcctcccaaagtgctgggattacaggcttgagccaccgctcccagcccacaaacaaatgtttagcattaagtattgtgtattaattaaaagactaagtctttttcataatagcttagagctcaatagaaaatacaagcaagaaatgatgagtacattcgtggttgcttatggctagaagagggaggagggatagagtgtgactcccaatgggtatgagatttttttttttctttcctgtcttttctttttgaaacaggatcttgctctgtcatgcaggttgaagtgtgtggtgcgaccatgactcagtgcagcctccacctattgggatcaagtgatcttcccatcaggcctttcaagtagctgggactgcagtgcacaccactatgcccagctaattatttactgattttttttttttgtagagatagtctcactatgttgcccaggctggtcttgaactcctgggatcaagcgatcttcccaccttggcctcccaaagtgctgggattacaggtgtgagtcactgcaaccagtctgggtatgatattacttttggcaaatatgaaaatgttctaaaattaggtaatggatgcacaactctgtgtactaaaaactcttgtttcccactttaagctagttgttgtgctttgtgatatgtaaagttcatctcaataaagctgttttaaacagaaagatgataaggacttcttttttttttctgaagcaagccagggtaaggtatttacaaattatgctgttctctttatctctgcaatgacttttaaatcttgtccattcttttcatccattatgtctgtgtcatagtttgaaccctcatccagttttggtccaatacagatggtccccgagttatgatgtttcaaagtatgattttttgaccttatgatgatgagaaggtgatacattttaagtagaaacggtacttccagtacccacacaacctttctgtttttcaccttcagtgtaatgttaaataaattacaggagatattcagcacttcatcataacataggctttgtgttacctgattttgtccagcggtaggctaatgtgagtgttctgagcatgtttaaggcaggctaggctaaggtatgatgtggtaggttagtgtatgaaatgaattttgaacttagtgatattttcaagttatgtgatggatttatcaggatgtaaccccgttgtaagtcgaagagtgtctgtagttacacagaaataataatatgtggttttggttggtttctagttgtaagttgtaaggccttttatgcagactgctgcatttgactttaacatggttttcttacccccgttctttctcaggctttcctaaagcacagttctgatcatgttatattcttactgaacacttcacatggttcaacattgtctacaggatgaaatgcaaactttttaacttgatctatgattctgtcttttttgtcttatttttcacatcatgatcttactaagccacaattcatttttggcatacaaaacatcctggcgttgacttaaagtatactccacttttccacttctctgctttttgcccttctcctaaattcaagctgtcaacatttcacccattcagctcaaatgcttcctcctacatagtcttcaatcgcacgcagcagaattacagccttgaaaattacaaacttctttgtattttaattacttgtctatgtgcttgcctttctactctgcctatctattcaaattattgttcagttgaattttcaaattaatattgtattgtaagcctctttatttgtaattatagagaaaatagattcttatagaaatgatgaagagcaaaattccatcagagccaatacggaccttcggtctacagggaagaataagtaacagatttccctcgcccagcacaagatcgatggctgagaccccaacaacagaagacagactaacaacagaaaaacatagaaacttatttaatataaattttacatgacacacgagccttcagaaatgatgcaaataaacagggagtctgtattttttggacggttgtgcaaaattggactggaggacaaagggaatggtctaatggaaatagacaggggaggctgttcacattcctcttggtgtcctcatgtcacgtgctttcctcccagatgtaggacaagccaggatgctctcccaggaggctcttcaggagagaggggagggagaaggtcagagagtcaccttcccaggtttcatggctgctgcagggagaaagggcgaggggaaggtgagcaaggccttcctgcttctgttgttttctcaaacgcccaggcaccatgttttggggtggcatgtcctgaacctggtctggcctcacctcactataggctcctgtttcttttcttttttttttttctgtttccgcctccctccctctaaacattctaatttaccccaagctctcttccccagaactctcgtgtctgacagagctcgaattctgtcaaccaggctggtcagctccagactctgactaatgaaatgcacttgttattaacttatctccttcaggagcaactctcaatccatgactgaattgtacagatggaacacaggagggtgagatgtctccttgctggaaactgcacagtgtgaaggctctcgggaattgctttatggaatcagactccttcgttccttcgtgtacacctcctagatgcatttttacagaatcagactccttcatgtacacttcctaggtgcattttcctggagctcatctggagtccaggcctcagcttctgttgtacaatgagggatgataatggcagatacttagatacttttgagaaggccacctgagacgtgattgccaaaagcaagtgaggatgactgaatgagagaacggtgaatagcagttattttaaaatttatttttaacatccctacatttattgcaactgattcttgtaggaccacaaaatgtgaaacggatttcaaaccctagcagtgcacaggaatcatcctgtaaagcctttaaaagtacagatctggccgggcgcggtggctcacgcctgtaatcccagcactttgggaggctgaggtgggcggatcatgaggtcaggagatcaagaccatcctggctaacacggtgaaaccccgtctctactaaaaatacaaaaaattagctgggcgtggtgacgggcgcctgtagttccagctactcgggaggctgaggcaggagaattgcttgaacccgggaggtggaggttgcagtgagtggagatcgcaccactgcactccagcctggcagcagagcaagactccatctcaaaggaaaaaataaaagaaaaaaaaagtacagatctttgagtgatcacttttagaaggtccagggctgtgacccgtaagctaatgttttcaaagcttctcaggtaatttagaagtaactggtccttaggttgtcacgtgggaattactgattcttccgtacatatttagtaacatctagagtattctgatccatgagaatattgtctagatttcagagcttctttctgaaatttaccgagaatgaaactctcctgaagataggctttagatctcatcctatgatagtctcacagaaaagaaggtagcttgatggagagtttatggatattctacaacagaccttaatccaggtggtattttattttattttttttaattttttgagatgacgtctcacactgttgccaggctggagtgcagtggctcgaactcggctcacggcaacctccacctcccgggttcaagccattctcctgcttcagcctcctgagtagctgggactacaggtgcctgccaccatgcctggctaatttttgtatttttagtagaggcagggtttcaccatgttagccaggatggtctcgatctcctgacctcatgattcacccacctcagcctccaaagtgctgagattacaggtgtgagccaccgtgcccagccaatccaagtggtatgtcaaatctagcctaaagagctttaaacatttttcatgcatttatttaataaatatatatatatacacacacacacacacacacatttgcatacatgtatatgtctacaaacatatatacatatacacatatacatatataaatgtgtaaatatatacatatacacacacatataaatgtgtgtatatatatttattaaataaatgcatttttcatccacttattaaagatatacacacatatacacatatttgtatatatgtatgtatatatatataaaaatctgcaattttaaaaaacagcacaactggaataaatgtagacatatagtttatagtactttgtaattgtaattaaatactttcttcagaaaattgcattaaaaatttttttatggctgagtgtggtggttcatgtctataattccggcatgctgggaggctgaggttagaggatttcttgagcccaggtgtatgagaccagcctagacaacatagtgaaacccatctctacaaaaatttataaattagcctggcatggtggtgcacacctgtaggcccagctacttggaaggctgaggtgggaggatcacttgagcccaggagatcgaggttgcagtgagctgtggtcacactactgcactccagcctgggcaacagagtgagaacttgtctcaagaaataaacaaaaattatcataatatgaaagtattgataatttaatattcttttgttttttaaatggtaggataataatgtgatttctaacttgccttaccttcgtgtccactgctttaaagacagaactaacatgaggagagaaattagaaaataataaagaaaacgaaattcataaattaaaacatgaagacattatatctgaagggctcttagattgtataagtcaatttttccctagaatatgaaattcttacctatgagaatgaatgttaatgtacttttcaaactaactttcaccttacctttagatgaccttatttcatcagaaaagaagtaaaaaccaattcttactcagaatagtttgaacttacacttaattatcatctatgctgttatttactatagatttcatttaacacagatttttaaatgattattataattggtttcatgggtgagtttattttataatgagtaagagaaagaaaatgtacccctattttatgtcaaatatttttatagtatataatatcttcaaattgtaaatgaatatagagatttaaaaatgttaatagcttctaaggctgggtgcggtggctcatgcctgtaatcccagcactttgggaggccaaggtgggtggatcacaaggtcaggagatcgagaccatcctggccaacatggtgaaaccccgtctctactaaaaatataaaaaattagctgggtttggtggcaggtacctgtagtcccatctacttgggaggctgaggcaggagaatggcgtgaacccaggaggtggaagttgcagtgagctgagatcatgccactgcaatccagcctgggtgacagagggagactccatgtcaaaaacaaaaacaaacaaacaaacaaacaaaagttaatagcttctgaatcattataatttctcaagtgagtaggaatatatttttcttcaaagctcttgcaagattttctgccaatacatgatttagaatttcataatcaatatttattgtttagaaaccctaaaagactgctttcatatttaattttttgtttctgtgattattaaattatttgcctttttaactaaaagaaaaaagacttactcctttttcttctaggtactaccaaaatgcttttctgggaagaacacaatgtacacatccaaactgtaatcagctattttctcttgtgcttgcggcttttcagagctggattatttgacgaagtacatgctgagggctccatcagagcaatagagatagagatgatagagatggagagagatagctacctctgtctaggtgcagatataaatgatgtagatgcagatataaggtgttccatgaaagggccataaatgcaaagtggtcccctcaaatgcaaggaaccgaagaaagaggcggacaaatccagtttgcccataaaggatttattctatttatttgttagagaagttaaagacagaagtgtggtcttgggcaaccacaagacagctagatctctgcactaaaatccccaagacccagaacttacatcatgcggaaaagtatgtgtgttctggaagaatgtgtaggtggctgagagaatgctgtgggcaccacagtctatgagggacacagcaacaccaaggctggttttggaggaaaggcgaaacttacagtaaataggtccttctacaaaaagggtttacatcaactaaatatcttggaggcattccggggctcgagattcatcaggaggcacgtggtggattagcatctaaaatgaagtcactctcgtccctatacagggaataatttgatgcttgatgtcactaaggcacccatcatgagtaagatcagtaatacggaactgacggcattacatttgttctacagagttattaatctagattcaaaatttggataagagacaatatcatcttttctgttcttagagcctctctgagcctaattgggcccgagttgagtgtttccatttcagaaattgtggtgtcagcatgctcaactataaaataaactggttctttatgcttttagtaagtcatacctcttgcaatttactggaaaagtagaaatgcaaagagctccttatgcaacttaatcagaagaacacaaatcagggtcttttaatgaaggtttaagctgagctttgacatgcgaattaggagacaatgcagtaatatctagtatatcttaagttttgatatttgaaagatgattgtgaaataatttttctagtttcattggcatatctactatactctaggcaaggggctggaatcaacaagcaaaaatcaacaagttttgctcttgaccatctcacagacttgtgtttctttatttttttctctatcaagccaagctctatatgaaggcaattttatgatgttgcagattttatgatgttgtgcacttactttaaagaatagcctttacaactcttgagtacactcaattatatttcttatgcccactgaagtttttaagtacctaataaaaaatagtgtatcagaagaggtggcaccgtcaggaatatttcaccagtattaggccaatgaacattagctgtcatgttttcagcattatgtggagagctctgagtcaggtgcacacctccaaaaaacctggtgtgaatatttcagtctcagcaataaaatcacacttcatgtgttacgcataaaggaagatttattaccttcatatcctcttattaatttctttctttcttacatcaggtataattccatacctcagccctttggccttaaagagtaatttaatctattagcccagaaaaccttttaagtcaatccttgacatggaaggaaggcagatatttctttaagggtctggtgtactagaaggtcagtttctgtcacagatcccaggagccgtgcagctaaaaacaaaaccctctggtgctccgtcttttcgccagtacacgcctttaaataagaaacaagacaaaagagacagatcaacgctcatccctgggcttgagcctcaggaaaatggttttaagagaagacgcctgttagcgccagacaaaaggcaattagtgctcattcgggggacatcacgtggtgagggcatgtggactcccttcatccacaagccaagtacgaagggctattgctctgttactaacagggattcatctttaattattcacatttgtatttttttccccagtaggaaaataataatgtttttcatcctttcctgcatatatttattatttttatgtaaattaagagttacactacagagtttctcatgaagaaaaggaaaatacctaaaagatagttacattacaaagaagaaaacacaaatgtagcttcctgaatttttcatgaaaactcacccagaaggcactccatatttcagaaacaaatagcatgggggccttaggacacataaacaatataactgaataaaagaaatttcagaagtcttgtagtcctacaaatatttctctttttggaaaagatttattgaagcaaataaaatgataaaattatgcatgaattgaaaaatatagtgggatggaggaatagaacatttgtgatgattcttgataaagccacacaacataaggtatagaaagtttggtcaccagccaggcctggtggctcacgcttgtaattccagcactttgggaggctgaggtgggcagatcacgagttcaggagtttgagaccagcctggccaacacagtgaaaccgcatctctactaaaaatacagatagtagctgagtgtggtgatgggcacctgtaatcccagctacttcgaaggatgaggcaggagaatcagttaaactcgggaggtggaggttgcagtgaactgagattgcgccattgcactccagcctgggcaacagagaccgtgtctccaaaaaaaaaaaaaaaaaaaaaaaagtttggtcaccatccaagtaaagaaaaaagagaactaaatctaagaaagtggcagttaagtggaaaaggagaaaggttaaaaggaagtcatcgaaaaagagaaacagaataaaactagatgttttaaaggagaaaaaatagacagtggcatcaagaattgcttttaggtttcaagttgcaattcctttaagaagtactgtctgtgaataaatattttcaaagcaaggagaaaaaattaatttagagataagggccatagaaatgataaggtttgttttggttatgctgctcatatcaaaatatttaagtaacagtaatgagcaagtaggtagagatatgagtttggaggttaagaaataggtcctgatagccaggcgtggtggtgggtgcctgtagtcccagctactcgggaggctgaggcaggagaattgcttgaacccgggaggtggaagttgtagtgagcagacattgtgccactgcactccagcctggaccaccgagcaagactctgtctccacaaaaaaagataaaaaaaaaaaaaaaggtggggggaaagaaagagagagaggtcctgagattatgaaaaagaaatgagatctattcacaaactggcagcaccaacaatagagaatgtaagatgttggttgctattgggaactaagtgaggatgatagttgttagagcacattttaaaatatataaccagcatggcagatgtatacatatgtaactaacctgcacattgtgcacgtgtaccctaaaacttaaagtataataataaaaaaaaagaaaaaaaagaaaaatttacctgccctttaaaaaaaaaattacaacactgtctgaaataacagaaaaaaaatatatatatataaactgatgcaagaacttcataaatgataatgtccattcttcttacagaaatagtggaatggtcaaaattaaaactatcatgcagaatcaagggtgagttaggttcaagaaacaagggatgtttaccctggtcagatattgaagtcgatcgaagtgaaggctgagcaaagggttccagactggttattatcaagtatttgtagtgaaagtcactatgcaagaagtgaaagaatgataggattttgggaaagaatcataactactgtttcacaaggtttagtagcaagaagacaagacaaattgaaccttgggagactgccagcgtgaggaaaggctttgtcaggagacagagaaatgaaggcacgtttgtgggcagagcaaatgtaagaagaaaggcagaaatatggacaatgattaattaatgaaataagttttaaagaacagaaaaaaagggttaatatcgaagtccagatagtgagttaagcactaaaataggaaggcaatatgtctgtttttatcttttctttgagacagtaaaaaagaataagaggctggatatacgggatgcctttgtatagagaagatttatacagattatctggggtggtgttgatacacatggtcaaatgaaaaaatggagatttcaaacctgagaaggagaaaatagattaggatataaggagaaggaggaaagtcttttagacgatgaagtcatatcgaatcaggagacacatggtagtagagctacagaaataggactggacagtagggatctggagtggattagtatgagttttcttatccacttttctccagctgtgctaaaataggctgctagcagtgaagaaacaccataatgatcacagagttggggttaattagagtacagggatcgaaagtccaacaggtaagagatttgagagcatcagtgagaagacaattaaataaacttaatatggctctcacaatctaagttaaggagaaaagtgaagccagacagaggttgataaatcagaactataaggccagttcaagggagtagacctcacagtgagaacaaagctcaagttagttgctaataaaggcacagaaaaggtggaaagtaagatctattaaaaaagaaaatcgtaaaattcaaaatcagtaatactgatcaagcgcccattgtgagcaaaagggtaagcttttattgattcagaatgactaagaattgagatatctgatgagttaagaatgttaacttacaattagtgtttcatatataatatgtatataaatatatataatattatacataatattgatgtaatcactcctatagctaattaagtacatgatattttgccaggtcaactgttatgtttattagcaacagtcacgggaatatctgaaatgttggaaatcccctatcccaattcaatattaatgaaagtaacagaaagttacatctttctgttattatatatagttacatctattcttatatctatctttctgtatcaaatatttatctccctatataggtatatttttaatctgtatctttatacataaagtattctgggtaaactgcacagaccttagcatattaaattctcttcttcggccgggcgcggtggcttacacctgtaatcctagcactttgtgggaggccaaggcaggtggatcacttgaggtcaggagttcgagaccagcctggccaacatggtgaaactctgtgctactaaaaatacaaaaattagtcaggtgtgatggtgtgtgcctgtaatcccagctactcaggaggctgaggcacaagaacccgggaggcggaggttgcaataagctgagatcaggccactgcactccagcctgggtgacagagagagactccatctcaaaataaatcaaataaaataaaatctcctctcacacactaccatcttccctaacaggtgtgctaggctctagaagtttgaaagacagaggggtgaattacttctgtattcactcagttgtataaaccatatgtcctcatccattttctactactatacagaatactacaaactggataatttataaagaaaagaaatttatttggcttatgtttctgggggctgagaagtccaagatgatggcactagtatctgcttagcatttgattaaggtgttcttactacctcacacatggcagaagagcaagagagagagagagagtgagagtaagagaacaggaggaggcagaacttcaccttattttcaggaaccaactcccatgatagcccagttctgagataacagcgtcaacacaggcatacctcagagatatttgtggtctggttccacactacctcaataaagtgaatattgcaataaagtgaattacacaaaatttttggtttcccagtacatataaaagttatgtatacactatactgtagtctattaagtattcagtatcattacattaaaaaattagatactttaaaaaaatcctgttagctttatctccagaatatcttccaatctacccacttttctttatgtctatcagtaccgtcatggtctaagccaacagcgtgctttcctcaggctatcaaagtaggcttttaactggctcctcacaggagaccaaaatgaagaaaaagaacaataacaacaacaaaaatagatactttaatttaaaaatattttattggcaaaaaatgttaacagtcatttgaaccttcagcaagtcattttcattttgctggtggaggatcttgccttgatattaacagctgctgactgatcagcatgatggttgctgaaggttaacgtggttgtagcagttcttaaaataagacaacaatgaagctaccacatcaactgattcttctttcacaaaagactgcaccgtattctatgatgctatttgatagcattttactcacagaagaacgtctttcaaaattggagtcaatcctctgaaaccctgtcactgctttatcaactaagtttatgtaattttctaatttccttgttgtcatttcaaccatgtttatagcatcttcaccaggagcagatttcatctcaagaaaccactctctttgctcatccgtaagagtagttctttatctattaaagtgttattatgagattgcagaaattcaatcacatcttcagattccagttctaattctagttctcttgctattctcactacatctgcagtgatttttctccaccgaagtcttaaactcttcaaaaccattcatgacagttggaatgaacttcttccaaactcttgttaatgttgatattttgacttcctcccatgaatcatgaatgttcttaattgtatctagaatggtaaatccttctgagattttcaatttactttgcccagatccatcagaggaatgatccatcactatctatgggagatatcgccctacaaaatgcatttcttaataggacttgaaatttaaaactactccttgatccatgcactgcagaatggatcaagaatggctgcagaatggatgttgtattagcaggcatgaaaaccacatttatctccttgtacatctccatcagagctcttgggtaactaggtacattgttgatgagcagcaatattttgaagcacttttttttttaagcagtaggtctaaatggtgggcttaaaatattcagtaaactatgctataaatagatgtgccatcttgcagggtttgttactgtattcctagagcacaggtagggtagatttaatgtactttttaagggacctaaggttttcagaatgctaaacgagcactggcttcaacttacagtcattagttgtattggctcttaacaagcgagtcaacttgtcctttgaagctttgaaaccaggcattgactgctcttgctgtgaaagttctagatggcattttcttccaatagaaggctgctttgtctccagtgaaaatctgttgtttagtgtagccaccttcattaattatcttagttagaccttctggataacttgttgcagtttctccatcgacactgctactgcactttgcacttttatgttatggagacggtgtctttccttaaactgcatgaaccatcctctgctagctttcaacctttcttcttcagcttcttcacctctctcagccttcgcagaattgaaaagagtagtgccttgtgctgaattaggatttggtttaagggaatattgtagctggtttggttttctttcacgaccactcaaactttctccatatcagcaataaggctgttttgctttcttatcatttgtgtactcattggaaaagatttccatcagaagctttttgtttacagtcacagtttagctaactgcttgacataagaggcctagctttcagcctatctcagcccttatcatgccttcctcactaagcttaatcatttctagactaaaaacacttagtcacttgaaaagttagaggccattgtaaggttattaattggtctaatttcaatattgttgtgtcttaggtagtaggaaggcctgaggagaaggacagagatggggaaatagttaaatagttgtttgatgaagccgtcagtacacatacaacacttaataagttcagtgtcttatatgagcacaattcatggtgccccagaacaattgcaatagtaacatcaaagatcactcatcacagatcaccacaacagatataaaataaaaagtctgaaatattgcaagaattagcaacatgtgacccagagacagattaagcacatgctgttggaaaagcggtactgatatatttacttaatgcaggggtgccaccactttcaatttctaaaaaatgaattatctcaaaagctcaataaagcaaaatgcaataaaacgaggtatgcacatcctaatcacatcctaaaggcctcacctcttaatactgtcgtaatggcaattatgtttccaactgataaactttggaggaggcacattcacatcgtagcaccatataaatgaatgcaaagcaaaatgggcccaagtaggttgttgaaaaactaatgggtagaagggtcttggatgctcacattaattggaggaaaatgaaaaagagacagtaggataatcaatggcaataagatttcttgccatggaaaggtctaaactagatatgaatgaaaatccagctaaatgcaaagatcaggatcggtcttttcccttttttcccaaatatacactatgttattttctactttatgtctttggtacacaaagtgaaatatggcatgggttgccaaattttgcaaagtaaataatacatagaattcagaccctactggataaatacattctatttttaatgattcagaagggccctcatgaggatgattatttttatttgtttatttacttatttattttttgtgacagagtttcgctcttttgcccaggctggagtgcagtggcacaatctcggctcactgcaacctctaccttctggtttcaagctgttctcctgcctcagcctcccgagtagctgggattacaggcgcccgccaccatgcccggctaatttttgtatttttagtagagacggggtttcaccatgttggccaggctagtttcaaactcctgacctcgtgatctacccacctcagcctcccaaagtgctgagattgcagatgcgagccaccatgcctggccatgatgatgatgatagattccttctcagcaatccagaggaattaaatctagtctatcttaatccatgtttatcaacctgtattgtgtaattcaattaggcacttaacattagaaacttataaaaacaaaagtagcataatactcagctgtgttaagaaaaatgtgatatcaactactcctcctttattacagtgactcagaacacccgtgtccttcccaacattggatgcaatgctaaagacatgatgttgctcctgctggaccacaccttgaaggaattgcctaccccacctcacctccaaaattaaagtctttcgttttgacaaaagttaa

SEQ ID NO: 2243 - DNA, 8053 bp, Homo sapiens
cataacaacataggaacaggtcacccgcgtgttactcaaaactgtaggacggcagtgagggctttgctaatcccagaacagaggtgtaacctggctgcatatccagcctcgagaaaatgtctacagcagatctgatggagaacctcagggaggaactcacctgtttcatctgcttagactatttcagcagcccagtgaccaccgagtgtgggcacagcttttgtctggtgtgtctcctcaggagctgggaggaacataacacacctttatcttgtcctgagtgctggaggaccttggagggcccgcatttccagtcaaacgagcgtctggggaggctggccagcatcgccaggcagctccggtcccaggtgctgcagagcgaggatgagcagggcagctacgggaggatgcccaccactgccaaggcgctctccgatgacgagcagggtggaagcgccttcgtagcccagagccatggtgcaaacagagtgcatctctccagcgaggctgaggagcatcacagagtaagacagctgctcagcatgaaccccacgactcatcgcagctaactccgttagctttcctgacgtttcctaacgtcctctgtgggggacagtcacgagggcccatctgagcaccacatcacaaactggcgtgggtccagtttacacccttttttttccctttttttgtttttgagacagagttttgctctgttgcccaggctggagtgcagcagtgcgatctcagtcactgcaacctccgcctcccaggttcacgccattctcctgcctcagcctccccagtagctgggactacagtcacccaccaccacgcccggctaattttttgtatttttaatagagacggggtttcaccatgttggccaggctggtcttgaactcctgacctcaggtgatccgcctgcctcggcctcccaaagtgctgggattacaggcgtgaggcgccgcacccagcctgccctttgttttagaggcctaggactgcgcagttactggtcttcaaagccccttcatgacctgggactctgctcatttgccagaaagggtttgtttctattgcaggagaaactccaggaaatcctgaatcttttgcgtgtaaggagaaaggaagctcaggctgtactaacccatgagaaggagagagtgaaactgtgccaggtcggtgtctgtctgacttttgctgcttgtatatgaccccataagggggactaaagggaaatttagtgaaatatcaggaaaaaaaaaagacaaatttttccagtctcacctctaaaatatgcagtttccttgcattgggctgccttcttctgagcgtcctcgtgggagtctcaaggctcagctgcaattcgccccctctaggagcctcctttgcataactagacaacgctgtggcttcctctatgatggctctggtagaattatttaaaacacaagtgatacttatagacatgtaacatgagacggaaagcgattttaaaaagaaatatctcaaaaacatggaggggaaaatgcaaattaaaaaaaataaagagacagagatataaaagcaaaatagtggtttaaatgatacctgacaagtcctcaaggttggtcacggacttggatttgagctctccagcagtcaaagcaaaggactaaatatcaaattatatattttttaaaaccatgtatctgattctcccaatagactttgaaatctgtttttttttttttttttttggagatggagtctctctctgtcgcccaggctggagtgcagtggcgcgatcccggctcactgcaacctccacctcccgggttcaagtgattctcctgcctcagccttctgagtagctgggattacagacgtgtgccaccatgcccagctaattttgtatatttgtggagatggggttttaccatgttagccaggctgatctcgaactcccgacctcaggtaatccacctgtctcggtctcccaaagtgctgggattacaggtgtgagccaccgtgcttggccgtagactttgaattcttaagtgagagtatttgccatgtatgtttctgttcctttttggttatctgacacctactttcattgaataaatatttgttgaataaatgaacacacatttttcataatttttcttaattttgttttatttgtatcatagtcctgatcactacttgtcatatttcttactcatttttggttttctccactagaacgaccgcctcctgggaatggagattttggttttgtttactattgtatctatagcgcacatacctccgaaaacatcaacctctacacccagcgcatcaacagattaaatgtattatatgttggatttcaggaattgttgccatgaaactctaggacttggccaggcatggtggcccacacctgtaatcccagcactttgggaggctgaggagggtgggtcacccggtcaagagacttgagacaatcctgaccaacatggtgaaaccccatctttactaaaaatacaaaaattagctgggcgtggtggcacactcctagactatagtcccagctactcaggaggctgaggcaggagaatcatttgaactcaggaggcagaggttgcagtgagccgagattgcgccactgcacttcagactggcgacagagtgagactccatctcaaaaaaaaaaaaaaaaagaaagaaagaaactctaggacttgtaaggattaaaaatctacagacaagggcatttctcttactaactttatctcgtgtgtgtgtgtgtgtgtgtgtgtgtgtgtgtgtgttttggcaggaagaaacaaagacttgtaaacaggttgttgtgtcagaatacatgaaaatgcaccagttcctgaaggaagaggagcagctgcaactccagctactagaacaggaagagaaagagaacatgaggaagctgaggaacaatgagatcaaactgacccagcaaatcagaagcctaagcaaaatgatcgcacagattgagtcctcaagtcaaagctcggctttcgaatctcttgaggtgagaataacattcatgagagtaatgggaaaaattatagtaactcatagtacttcaagccataggaaataatgttttctttattcatcttaaaaactaagttctggtccaaaagtagttttcctaaagaattgacattctatatgtcaataaagccttatagaagagagagagagagaaaaaaaaaaacacatccagaggaataactatcccaaacaagcctgagagtggcttcaatttcttctgtacctgcctctctgcaacctcagctttgttaatttttttttctagtttattaatgtgtatttactatgtgctgggcacattaaatttaatcttcacaaagacctgatgaagataagtaccattatgatatgaactctaggtctagatgactgtcatctacaggatgggttaatagcggcactgatttaattattcatacctgtggtactaacgagatctgcccgcctgatagttaatagacaggagagccctcctgttctgtgcagggagctcctatttctcaccacctttggtctactgcccttctaggctgctgcattcttcaggacctttttttttttttttgagacagagtctcgcactgtcgcccaggctggagtgcagtggtgcaatcttggctcactgcaatctacgcctcctgggttcaagcaattctcttgcctcagcctcccaagtagctgggattacaggcgtgtgccaccatgcccagctaagttttgtatttttagtagagacggggtttcacaatgttggccaggatggtctctatctcttgaccttgtgatccatccaccttggcctcccaaaaggctgggattacaggcgagagccaccggcacccggccgtggactttcttaaacataagccatgtgatccaactccagcttcaggtctgttttgtagactggttccacagagtgctactatttaatttagtgccttccaaacacaccaccccgacctgacacaggcttggttagcctcagttctcaccagcccattttcctttgttatctctgcctctcactggatgatcgagactaacaggttggcttgtttgcagaacaggttccctggacaaggtgatgatacgagaaaaagaaaaggacaaagtattctctagtcattgtgagaaacaccttgtgttcaccacagcacatccctggaagaaactggggacgcttttctctgctctctgtgctcccactcatggtgtgcttcatgggaagcagattctgtgagctttgcaaggactgtatgcaaaatgaatttcgtctgtgttatgatcaaagcgcaccatgctaacttctttcttttttacccgtaggaagtgagaggagccctggaaaggtaggctttcattctgtgttcagttatgcaagctgcggggcagtggtgctgatggacagttctgagtggggataggaggtctgcgctgttgctgggggagaaatgaggtggactctccagctggagcaggtcacgcggtctgtgccgaggagtgaacctctctgctctcttgcaggagcgagccactcttgcttcagtgtccagaggccaccaccacagagctgagtctgtgccgcatcacgggaatgaaggagatgctaagaaaattcagcagtaagtcagcctgatttgttacccctccggggctcgaagaattaacttcagcataccttcttccagtgtcagacattcacgatctgacacgaggctcctggttaaggaatccgggccagcacggaacaccagggagggctggggccacagaccgtctctgagcgtgagcagagagaagcagtgagacttgactcaggctttatctggctttgttttctgtctaaagggtctttttttttttttctttgagacggagtctcactccgtgtcccgggctggagcgcaggggcgcgatctcggctcactgcaagctccgcttcccgggttcacgccattctcctgcctcagcctcccgagtagctgggactacaggcgcccgccaccacgcctgggtaattttttgtatttttagtacagacggggtttcactgtgttagccaggatggtctcgatctcctgacctcgtgatccgcccgcctcggcctcccaaagtgctgggattacaggcgtgagccactgcgcccagccaatcctagtcctttctttgttggttttgtcattgtcttttccatcccccccttgcacgtgcagacacgcccccctcatgcaggggcgtctacatttctagctctgatcccgttaggatgaaagctgacttaaattctaaaatcccagtgagggtgcattcaacgaactgtccttgtagaatgctccagatgtttagtccagccaacactgagagacgtcaggattagttctcagcttttatcttgtggacaatctgaccttcagaggaagaggcctaatgagctttgaactccagagtgctgaataaagccctgccatgggccccggcactatgctactgggctctgcgcttacttacaatgataagtaaggcagattttgcctttccttttgtagaattttcaatgaaattgaggaggaaggcattaatcacacagataattagttatggtgggatctggtctataaataaaagtatgaaatggtatgattggggccgggtgcggtggctcacgcttgtaatcccagcactttgggaggccaaggcgggcagatcacttggggtcaggagttcgagaccagcctggccaacatggtgaaactgcgtctctgctaaaaatacaaaaaaaaattagctgggagtgatggtgggcacctgtaatcccagctactcgggaggcctaggcaggagaatcacttgaacccaggaggtggaggttgcagtgagcagagatggcgccattgcattccagcctgggcgacagagcgagactccgtctcaaaaaaaaaaaaaaaaaaaaaaaaaaaaaaaaaaagtcagaaatggaatgactggggtacctgatcttgtctggacagtgagtggaagttggaatcctcagccaggcatggtggctcatgcctgtaatcccagcactttgggagactgaggtgggtggatcacccgaggtcgggagtttgagaccagcctggccagcatgatgaaaccccatctctactaaaaatacaaaaaactagccgggcgtggtggtggacaagactactactcgggaggctgaggcaagagaatcacttgaacctgggagacgaggttgcagtgagtcaagatcgcgtcattgcagtccaggctgggcaacaagagcaaaactgtctcaggaaaaaaataaaaaaataaaaggaggccccatatgtgactgtcggttcacagactatgtgtgcttcatcacatggtccctgggtgctgcactgaactcacaggaagctgcatttgtcatgacataatgaaaaaggctgattagggattgtgatttgtgatttgaacactcagtaaccgtgtaatcttggtgaagtttcctaaccttcctgaacctgttttcttttttgtaaaaattatagaaaagaatgcttgcagtgattaaatgagataatgtacagaaaatgtttggcacattagaagttcagccaaagataagtgctattttctctcccacccaaactgaagaaccagaacctcccatggctaatatgatgcgaacaaccaagggtgtccctatgtggacgcacagctcggagctctaaagatgtcctgtgaacagagcgacgcccattccacccacagggattctcctccccacctcaggcaggctaaagctccttctccacgtggctcttctctctgtctccatttagagcttcatgctatgtgttgtggaacagtcaaagaagagctcagaaattttgttctcaaccaaatactgtttttttctgaaactgagtcttgctctgtcgcccaggctggagtgcagtggtataatcttggctcactgcaacctccacctcctgggttcaagcaattctcgtgcctcagcctcctgagtagttcggattacaagcacgtgccaccatgcctggctatgttttgtatttttagtagagacggggtttcaccatgttgcccaggctggtcttgaactcctgaccttgtgatctgcctgcctcaccctcccaaagtgctgcattacaggcgcgagccatcacgcccggccccaaattacatttaaaaaaccaggactaaatactaagaattcaatggaaatctcacatacctaagaggtttttcaagcatgcccaagggaaatctcttctttcctcctcttgcagcggagataacgctggacccagccacagctaatgcctatctcgtgttgtcggaggatctgaagagtgtgaaatatgggggaagcagacagcagctacccgacaacccggaaagatttgaccagtctgcgactgtgctgggtactcagatcttcaccagtgggagacactactgggaggtggaggtgggaaacaagaccgagtgggaagtgggcatctgcaaggactctgtgagcagaaaggggaatctccccaagccacctggggacctgttctcactaataggtttaaaaatcggagatgattacagcctctgggtctcgtcacctttgaaaggtcagcacgtcagagagcctgtgtgtaaggttggtgtcttcctggactatgaatctggacatatagcattctacaacgggacggatgaatccctcatctacagcttcccgcaggcttctttccaagaggccctcaggcctatcttttccccctgcctcccaaatgaggggacaaacacagaccctctcaccatctgctcactgaacagccacgtctgaggggcgtgccctgagccgtcacagcgggcgatgtctgagaccaagacacaactattaagacgatgaaggcatcgacagtattaatgtcaggtgatctgaaataaactcccgtaaccccacccc

SEQ ID NO: 2244 - DNA, 22130 bp, Homo sapiens
cgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctggtgggagcctcctcagttcttttcggatgcactccacccccgcgaatccggtggaagccgtggtgcagagagccggctttgtggcctcccaggcttcgctctgaccctgtctgggctggacggaggccggaccgcggttcctggcgcctgtgcagagaggggcagcctcccgtgctgacgaccctggaaacaggatagacgggcgggtgacccgtggccccgtacccacgagtttgggtcccctgaggcatctctccaggcctctgcctggtgggtctgcgttagtctgatcttgtagttcattataataacttcctttattagggattattcttttctccattgtctcttcctggaaaaattattgattaatttttttctaagctaatatgtagagtgaaaccgggatgaatcacacagtggttgaggtgtatatgggctttgatagggatatgggttggaacctgcactctgtcatttactaattttgtaatttgtggcaaattggttaatatgtctgaacttccatttactcattaagagatcaagtatctttgaacctccgtttacacatttaaacttttagaccattttttatacctttagaatactgtgaggattaaatgagagaacatacatgcagtaaataaattaagccaaatgtgaggaggaggtcgtagtggtaatttattagctctttaggagaaaaatacctgtgcattcatatccccgcttcttttttaactggcagatttgcctgaggttgactgtacatacaaatattgagcatttcctcctggcctccgtgataaacaggggttttgatattgttaggcgagatggaaagaaagtatcaaggagtgagctgaagccactgcccttgagaaccctctcgaggagtctggcctcatgaagatgccagaataagtggcaggtatatcctgaatgaatgtgagatttttactatgtgaaatgcctgtgaggagtggtgagttatcttctgaaaactttatgatgaaaatgcagacaagagtgtcttaagattatcgtaataatcataattaatgcttatatagcactttcaatgcgccaagaaattgttgtaggcactttgcacattaactttcttcaaattgctcttgggtttttatttttttattgcgatgtaattcataattataaaattcacccttttgtacagtcagtggtttttattatatattcaagaggttcaccactgtctagttgctcagcattttcatcatctcagaaggaaatctcttcctaaccattaaagcagtcacatcccatcttccccctctcctagtccttggcaaccactagtctgctatctatgtgaaattgcctattctgaatatttcctaagaaatcatgcaacatgtggccttttgtatctggcttctttcacttataacattcttgaggtccatcagttttgtagcacttgttcctttttatggctgcgtagtagtccattgtatggatgtaatattttgttcatccattcatcagttgatgaacatttagattgtttcccctttttgactattgtgactaatactagtgtgaatattcttatgtaagtatttttgtgggtgtatgttttcatttcccttgggtatacatacttaggagtaaaattgctgggtcatatggtaactctttaactttttgaggaacgccaaactgtttcctgtagatgctgcaccattttacatttccaccagcaatgtgtgaagatacatattacctcttaatcctcacaatagccttaagagttaagttgttatcctaattttttaagtggggaaactgactcacagagagattcagtaccttttcccaaaatcacagagctaagaagtgacagaatcaggatttaaaatctggcagtgtggctctacaatctgctttgaactttaacataatatgtacaaagcctgaagcaaattctcagtactgtatttaagagggcatagcaatgtaagtcttcctaaatcaataatttataaatgaaacaacttaaaagacttccaagtttcaatcttacgatattgatttatcacacaaatcaatatacttaaactcatctatataaattatgtcctgtagtaagaagaaaaagagcaaagataagaagagaaaaagagaagatgaagaaacccagcttgatacgttggtgagtcagttttcagtgctttattctgaaaaaagttaacatttcttgagatctcattgaaaatattttcctagttagaaatttatgatgtattcatatttgtcttaaagtgcttaaatattacctacagttgcaaattccatttattctttagcacagtagatgctactgatgcctttacttcattatcagaacagagcacaggagagaagaattacaactctctgacttagtaggcaccattagactgcttaataatagctggagattctgatacataattttaaaggcttaatgtaaatgttattcaaccaaatatattttacaagctattttctttgaacatgtatacattttagttgtagaagtcagttgtctcttaaacaaagtatcttcataggaaaaatcattattttgtgaactctgaaatgaatgaaaattttaaatacaatatcagggtagcctgtaaatgatactggaaataaactgacccaaacacacttaaccagcctgttttccgtttagctgtttccatactttttttttctcttttaaaacttggcaagttgcattttgaatcttcataaattatggtagcttaaaaaatatataaaatatggaatggtgtaaagctaatgttctggaagaatcattgcttttgaaatggcaaatcaacaattctaaaattagggtaaatatctagggtagatatgtagatgtggaattgctgtgtcaaaggataggtgaatgtttaactatataagaaactgtcaaaatttttcaaaagtggttgcgctattttatcctccttttcagtttcttaatggtggtttttggatggacagcttttttcttttttttttttttgagatggagtctggctctgtcacccaggctggagggcagtggcgcgatctcggttcactgcaagctccacctcccaggttcacgccattctcctgccttagcttcccaagtagctgggactacaggcacctgccaccacgcccagctaattttttgtgtttttagtagtgacagggtttcaccatgttagccaggatggtcagaagcttttaatgtttataaagctttgtttattttttttcttttatggttactgccttatctctttgatctaagagatctttgcttaccccaaagtctggaaaatattctacattgtcttttagaggcatcatagttttagtttttacattaaatctgtcattaatctcaaattaatttttggcatggtgtgagtttggttccaagatttccttttttttttttttttaacatcttgatagccatttgtgccagcgccactggtgtttcctttttccattaatccagttttgtatcttcataaaaagtcaattaactttctatgtattggtctatttctggactctgttctatcgattttctgtttttcttttggcatatttatcttgattgttataatttcatgaagtcttgagatcaggtagtgtgtgtcctccaactttgtacttactattagtttattgatttcttcagtgaagcctgttggattttctcggagaattgtattgagtccagagcatttgggggagaatcaacatcttaatattgggcctcaatatttcataattttcaatgtagcagtcttgcatgcgtgtttaaaaatttattcttaagtattttataattttacactactatcagtagaacttttgaacttgattttccagttgtttgttgtcagtatgtagatatacaattgatttttgtatagtgactttgtagtctgataagtctgtttcacttattacttctagtggtttgtttatatagaaaactaagaaatttgcaattatgtttcctgtgactatcgttttacttctttctttctaatccttatgtcttgtcttgctttttattggtttattatactgtccaggacttccatagtgttgaacagaagtcacgagaatgggcataattgcattgtttccaagcttaggcagaaagctttcagtagtccaccatatggtatgatgtctgtatgatctgcagagaaaacctttatcaaaatgaggacattccttttaaactttgtttcttggcagtttttatcataacgatgtttaatgctgtcaaatgtctctttctgtatctgttgagatgattatacaaatttcttcattctgccaatgaattacattggtttcattttcaacttttaaactaactttacatccctgagataaaccccacttggttgtggtgtgttgtcctttgggatattgctagatttgatttctaggtgtttttttttcttttcttttttttttttttttaagatttctatattggtgttgatgggagatattggactttgtatccttttcttgtaatgtctttatttgattttggtgtcaaggttttattgggtgtcataaaattagatgggaagtgctgtctccttccctgtttttggaaatagctgtgtaagatcggtatgatttcttctttacatgtttgataggatttaccagtgaaatcatctgaacctagagggttttatttggtttggttttagttttttgtgggagaattaagattttttaagagatattttcagatttttctgttgtcagttttggtaatttgtgtcttttaggaaaatttcatttcatccaagttgttggatttattggcataaaatttttcagaatattcctttaatatccttttactgtctgtagaatctaatctgtattgcagtctcttcatattggtaatttgtgttttttctgttttttcctggatcagtcagtctagctggaggtttatcaattctttataagatcacttattttagatcattaatgatcttttagtacaggggtattcaatcttttagcttccctgggccacaatggaaggagaagaattgttttgggccacacatagaatacactaacgataagctgatgagtcaaaaaaaaaaaaaaggaaaaaaatctcataatgtttcaagaaagtttatgaatttgtgttgggctgcattcaaacctggcctgggccacatgcagccctcaggatggacaagcctgtttcagtattacttattttctatttttttcattttttatttcatttattttcagtctttattttcctccctttaacttattttcagtttactttgctcttgttttattgcttcttaagaagagagttagatctcttcattccacattagttttagttatagtcaacacattttgctttcattttcattccattcaaaatatcatctagttttccttgtgagttttcttttcatggacacttgagttatttaaaagtgtattgttttttaatttctactacatagagatattataagtatgttattgttgctgatttctaattcatttatagtatagttggagaacatactttcttagtgaatttccatgtacacttgacaagaatgtgtattctgcagatgttggttcagggttttttttttttttggagatgaagtcgctctctgttgcccagcaggctggagtgcagtggcacaatctcggctcactgcagcctccgcctcccaggttcaagtgattctcctgcctcagcctctggaggagctggaattacaggcacctgccaccatgcctggctaattttttttatatttttaatagagacggagtttcaccacgttggccaagctggtctcaaactcctgacctcaggcgatccacccgcctcggcctcccaaagtgttgggattacgggcgtgagccgtggcgcccagtggttcagtgttctttagatgtcagttagatcaactggtggagcttgtggctatgcacatcttctgtgtccttactgattttttactcatcctacaatgtattgagagttatgttaaaatctccagctctacttgagcagtttttgcttaaagtattttgaagctgtcatgtgtacacacttaggattgttaagtcttccttataaattcagtctttcattttcataacattttaacctttatttctgttaaatgtcttgatgcctagttaaattatttgaccacccttttgctcctgtcaagcctgggcctttgttagtttgtgcttatttattagatttttacctgcagacttagacagtgactcttactctaggagatgttcatcctcatgggcctcagccatatgttctaggtatacttgatgagttctctccactctgctatgtcccaaatttgtgtgatctctggcatctccagtcagccctcagaagtgccagccactctgcagaggccttgtggagcctgcctgctgtatgcactccccccagcccttggccccagacctgcagagaacttttgcattctcttttgaggcctcacctgtatgtagttccctcttctccagtaccttattctataaactccaaacatgttagcactgcaagactctcagcttagtgacagtgacattgcctcatttttggaggtctctacctctctctgtgtggtcaagaaactgccattgggcagaaaacagaagtgtgtgtgagatttgcctcctgtgttttcctgttctcaaatatcacagtcctgttctgcctgtgttccaatccctgaaaagagttttctcaaatattctatccagtttcagttttctcattggtcatggtgggagggcaagtccatcttggctggaagaggaagtccttcttcatctttttctctttgtccttccaccttcttttgcattgtggattttctaaacttgccgtataagtaagcatgtgcctatttgtgaagggaaagaaaaaacccttttaattttttaaagctgttctgttggttcctcacaaggatctgaagggattggtaaataggatgaaagaaattctgtctttcacatggagaataccatgtgtgacattaataaaaatgagcatgtctgtaagcaaagagtttcactgagctctgctagattcagaagctattgaacttacaacatcgtagtttgcaaaacacagatttgatttactcaggaactgaagctaagtaagctatgtgttaatagaaagtctgtgaagggtacttagactacagtaagattggggaagaaaattccatttccaaatctaagatatatcattcctttttgccaagcacataatgaaggtagagatttaagggggcccttagcacagaagcactgggttagtcagaaggtgacgtgagctgtcacacagccttgattctagaatgagggtgccctggtagtatcttatcagccatgacactggtacatcgggccagtttttttttttttttttttttttttgagacaggctcttgctttgttgctcaggctggagtgcagtgacgtgatcatggctcattgcaccctcgaccttgtaggctcaagcaattctctcacctcggactcccgagtagctgggaccacagtcttataccaccatacccagctaatttcttaatttttttgtagagatgggggtctccttttgttgcctaggctgatcttgaactcctgggcttaagtgattctcctgcttccacctctcaaagtgctgggttacaggcatgccagatatatggaagcattctcaactatgtgaaaatatgtgaaaagctttgttatgcattgtgagacaacacagtgggaatatttcatcatctgcctaaggtttaaaaggaaataactttaagcatgtgtctaaatagcaagtaatgttttagagcggattctcttaaattcagcttgggcgtctgcagcatatacacagcttgagctgtaacctgacatagagacaggcaacttcagtgcccactgttcctaggatccacggctttttcacacctaaaacccctgagtggcactgttaagtattatgttatgttactttagtcattaaacgtataagcatacctccaaaggttgaatgtaggccacttgcagaaagtaggcagaatgctcacatttaattcttgatgatactgtgtttagctttcttattctttgaaatatcattgagaagaaatactggcatctgctcaaagtaatttctttttcagttgacaatattataagtaatgttattgtatcatttccctacttggacagagtgtgaaaattttgaggattgtctgccacaaatttcttcttcatttgcaaaacattcatgagatattatatttaaatgattttatttaatattaagtgtacttggtgaaggtggcatagaaaatacaaaataaaactaatttaaaaatattaactattacatttataagaaagacttgctaatcataacactgttcataatgattctgaataaagcattatttcttttactgaaaacaattgtagctataactcaatcatctaaattgtcattagttttatttctttctaatcgcctctagctgaaattttaattttgattaattttctttttctccattggtttcgtgtgtgtgtggaggtaaaatatacagaatgtagaatttgttagtttttctatttttacgtttacacttcagtggcatttaaatacatgcaccattttaccttcccaccagcgttgcacaaggtttcagtttctccacatcctgcccaacatttgtttttctggttttcttggtttctgttttttgtttgttttgataatagcattctaatgggtgtgaagtggtattgcattatggttttgatttatatttccctaatgactagtgatgttgagcatcttttccagtgcttattggccatttgtatatcatctttggagcaatgtccgtgtatatcctttgcccagttttgaattgtatttgtctttttggagttctctatatagtctggatattaactccttatcatgtatgtagtttacaaatattttctccattctctgggttgccttttactgtgttgacagtggttcttgatgcacaaaactttttaattctgatgaagtccagtttgtctatgttttcttttgttgcctgtgcctttgatgttctatataagaaatcattgccaaattcattgtcgtgaagcttttcccattttcttctaaaagttttctaactttagctcttacgtttaggtctttggtctattttagttactttttgtatttggtgttagataagggtccaacttcattttagctgaaattttatatattttaaaattgattatgaaaagcatgaaatgtttagttgaatagaaaattttgtgcagtggaattaactgaatctttaaaacctttttattatggaaatatccaaactaatccatacatagaagaatataatgagtcccccatgtgcccaggccccagcattaattatcaatattttgccaatctcgtttcatttacatacacacccccacacacattttttcctagaaaattctaagtaaaatcacagatattatgtcattttacccataagtacataaatgtacatttcttaacttggtatgtctttctctcatcacctgttttgtcctttacttttatgcattatactatgtcattatcagaccttgtaaaattaacaagaattccttaatatttcatatccagttaatgattgactcatttctactctagttaaagtacaatttaggaggaggtttgaggatattttttaacattaagatataaacttttataacaactgctaaaataattgttgctaaagtctaacatttctattggcaaattggaaattagtatacatagacatagattctgctcattttgctttcaatctaaaatcgtagttaagattactggccgggcgcggtggctcacatctgtaatcccagcactttgggaggcagaggcaggtggatcacgagatcaggagttcaagaccagcctggccaatgtggtgaaactccgtctctactaaaaatacaaaaaaaattattcgggcatggtggcaggctcttgtaaccccagctactctggaagctgaggcagagaattgtttaaatccaggaggtggaggtcgcagtgagccaagatcgcgtcactgcactccagcctgggcgacagagcgagactccgtctcaaaaaaaaaaaaaagattactatgctagaaagtcttcctgagagacatttttaagaagtattatgataggcattgcctctggaaagcaggcatgaatagatggctagggtctatcatgagagagaccgttctccatatatcactttgtaccttcacatgttgccttttgttttgttttggtctttttttgaaacaggaccttgctctgtcactcaggctatagtgcagtggcgtgatcatagctcactataaccttgaactcctgggctcaagtgatcctctttcacagctccccgagtagctgggattacaggcatgcacccccatgcctggctgtatgttgctattttgtattttaaaaacctaatcctgactgtgctggtagttgcatgaatctgtgtacacacatgcgaacaagtacatgtaaaactggtgaaatctgaataagcttcatggattatatcaatgtcagtttcctgattctaacaatgtatgatacttatgcaagatgtcatcattgagacaaagtaagtaaaggatatgtgagatcttcatattatttcttacaactgcaagataaaaggtttttaaaactaagttataataacaactctgtgtcaaaactaaaatataaagttgaaatatcaattttattttttaggaatctggtgaacagtaacaaactttggtgaaatttcaggaaccatagccattgaaatggatgagggaacctatatacatgcactcgacaatggtctttttaccctgggagctccacacaaagaaggtttgtgtctggaagggaagatcctgccacaagtgtagattttaggacattcattcacttaggccaaactctaactagtatcaaacattttccaaaggaatgtaaccattgcatttgactcttccattttttttaattccttaatatttaccagccattggcaagtccctctttctaatataagcatttgaaaacattccgtatagttccagaagagtatctttggaaatctaaacaatatgaataattaaaatagtaagtggaaagaaaaaagaaaacctatttcagtcaaacatgtttgaatttcttttttattcagacttattaccaaaactaacctgggtgcatttaacaatttgaagtttcctcgttttctttagcccattagaggaagcactaatgagatacgaagtaattagaagataaaaagcagtatcatttggtcagcaaggccatccattgaataaatgaaagcatttagcttttttaaataagtgcttacttatgactgtattttaaaacataaagagaagctatctctaaagttattaaataagcattatatcaccctgtcttactcagtgtataaaattagcactgtagttaaaagaaggtaaaatagatcttgattccaaagatacagtattacagtgacatcagtatatctgaatattcttacatttaattgcagaagaaaatagccacattttttaaagcaaaataatgtctttatatttatagcaaatgtcaaatttattttcaaatgttttttctccaatattgatgagggccctagtcctccagagcagtttatggctgtcaaattatctgattccaggtgagcttatgttgtaatataattagtaaccagttattttaaaaatttaattgtattcattaaaaattttagtgtctgtcttaaggccatggtaattttgatataaaaaatgaaatagcttttttgaaaagtagattttgtgatctacttttagtggatttcctatcaatatataatgctaggctggaaaaaagatatgtaaattaaaaaatgaagattaataatttcacacaccaagtaagatagattaaaaaataaatcaaatagtacaaaacctggttcactgttgctatgatatttaaactcactgtttggaagtctaaagacaaacaggaagactaaaaaaagggacattgttgaaaccagcagagaatgttacagcatcataacaaccaaaagaatatttttactcactatttttacagtcattttataaagtaaccttttttattctcaccttgtgcagaaatatagaatgattctttgggtaaaagatactgaaagtgaatttacatactttagtaattggttacatcaacatgataatgatttctgttatataatcattaacgtataaaggagtaaaagtcaattatggcatccgaggagattcttagtaaggtaaaagaaatcataattttaaaaaatcacattaagatgattatttctatactttctttgaaattctgataagtagggtgaaagacagaataaaagcagaggaagaaaaattcaatagttttaaactgctttacaattataaacaaaaaaagattatacagaaaattaactgacaaatgaggaaaatatttgcaacaatcttaataggcagtgagttcttactcttcatatgtatcttgtatagaattcatagcactgaagaccccagtagagaaattgtgaacaatcagatctgaatagaaaaatggacaagggacattaccagataatctaaaagctagaaaggaaaagaaaaacaattgttattctagttaactactaaaatgcaaattaataggatactgttttttttccatatcaggttttcaagtatttttttagagtcataatgtttaaaaaaaatccatgatacaaaacatactctattaatttgaggtaagaatgtaaatggaagcagcattttctggaaaacagtttgatgacataaagttttagtaatttattattgaaggttataactaaagaggtataattgaagaatgatgaattttgaaaatatttgttatgtaatatataaggtacaatgtttatattaaaaaagcaaaataaaaaactaaatttaaaactttactgtccaatatggcaacaactagtcacatgtagcttttttttttttgaaggcacagagtctctgtcacccaggctggagggcagtggtgtgatcatagctcactataacctcaaatttctgggctcaagcactcctcctgcgtcagcctcccaagtagctggtattacatgtgcacaccaccatgcccagctaactttttaaattttttgtaaagatggggtctcactatgttgtccaggctgatcttgaacttcttgcctcaagcaattctcccattgccttcccaaagcacagaggttacaggagtgagtcaccactcagccacatgcatcttttgaacacttggaatatgtccagtctgaaactttagatatgtacacacccacacacatacacatgtcctgttttgatgtcctataattaattttctctccgtttttaacttttatctatcttattaatgtacagaatcgccctgaaatctggctatggaaaatatcttggtataaattcagatgaacttgttgggcattcagatgcaattggaccaagagaacaatgggaaccagtctttcaaaatgtaagtgctgttattgtttataaaaacttcctgtcagtttaacagaaagtctgtaacagtcaatcataatatatttaaaaagaaaaagtaggatgcaatagtataatacattaaattggaataaaccactaagaacatagagccttaaagagatctcaaaatatagtgcaacaaaaatagcattagtacttttgtccacaattatttctgtatacccttagtgcctagatatggatctcatttccattgaagaaccagtcaattttaggtcacagagtaggaaaacagaatagttcctaagtatcttctttttagcagaaatcatggatgttttcagaaacattacaggccgtaagcgaacagtggagctagctaagaccaagttgtgacaatttgcgtataaaatataaataataatagttcattgaagtaaattatctctaaaagactttcagttcataagcttaaaatagtgtacgaaaagatagttttaatataagaagaaaaaagttaatgtactaattctttattttattaagtagacagttgtagtatatggatgttttgttaaatctttgttgatacagaatacataatttcctttttctgtttgtgtgagaagtaaagattgaacaaaaatatgtgagtgctaaactgtctttaaaaagtagataactatatcaaaaacagtaaggaccagtgggcaccacgcagaacaagcaaatagaagataagctcagcctttgagtagcagctttggtagtatacaataatgaactgaaaataggaactcagcagtgttttctaagatgacagattaaacaaacatcccaccagaaagaggtaatcacttagactaatttcctcatcccctaggataaaatcttaagtcagtgacttgaaaactattttgacccaatccattgagaaatgcatttttacattgccagcccagcacaaacatatgtataactggagcaagagttgtacttaacaatacatacttatccatgtgttatgcaccttgatattttgtattctcttttaccccttcctctgtgtgtctgtgtgtattcctttcccccccaacccacccaataccgttcaggaaacattacattgatttcattacctgctaatgtgttgcaacccctttgagatgatcctactagttatgatgagatgcttctaataaaagttacaccagtagaaaatgccaatatttcataaggccaggatgatcgcttagatagtactaataatacaacactttaggaaagttcatttcattttatttttaggaaggacactaagtttcaaaaatttaaatttaaatgaaagagggtcttaaaactgtattgcgaaaaggactcagctgaataatctgtggcacaggtttaaatcgccttggaccacaccgccatgttccagggctcaccaggagccatccagatgagagaccacccagcccttgtgacttgactaagaaattaaatccatgttatcagcacatttttaactggatgtgatataaggttaacatattttgtaatcattgtatttataaatattttgtctaaatgttatggtattccaagttttccaaaagaatcaaccaaatacaagttataaataaacgttatatttgttacgggagttaagctaaccaaatttataacccagatttaaatacacaagaaaatcaggttttacagttttgtttaatagaaaccagtgtaatacatcaaacattaaacaactaaaaatgtatatgaatatttattttcacacacaaaagtccctcagacattgattcttaaattcaaaacaccaaaggcattgtatgtaccttttcatgttttctaattgtgaagaaaataaattttacttaaaatgttaatatctgaataaagtatgcattcataattatgttcttgtctttaaagttaattttccaagcagaactaaatcagttttatcttcagtagatcttttagaaaggaagcaatcctactaggaagatacactacaaatgtttattgtggtaatctttgaatagtaaaatgaaaggtgattttggtttccttttctatatgttcttgtattatatttttgaggtttttctctcagttcttttctgtgacttttaaatcagggaggaaaaattaattcagtctaagcacttaatgtttcttccacaagaagtatcctcatggctattttgttattttgtttcacttaggggaaaatggctttgttggcctcaaatagctgctttattagatgcaatgaagcaggggacatagaagcaaaaagtaaaacagcaggagaagaagaaatgatcaaggtaatgatgccattttatacagatgactgaattcacacatgcgatgtgactgtatctctttaaaatgttaagtcatcatttactgtcactttaaagattcagttaatagctttttataatgtggtgtttcaaatagactcatttttaattataaatcccatagttgatggcttgtttatacaatgtggtagagaaatcagtgcatctaggagctaccttgccattatctccatggattagtatctttttctggtagttccacatgctctttttaagcttccattttcttgttttcttgcgtgtattttaaaatctaattttttaaatagataacatgtacatgtggtccaacatttttaaataaaagcatatgaagatgaagatatatgcctgccatgcatcttactcacctgtgtcccagctccggttcctctttccctttgtttttttttttatagcctcctaaaatttctttataaacatatgaatatatttataattttcaactgttttacactaaaggcaaccttctctatagtcttctcgactttgatttttttttccttaaaattgtatcttggagagttttctactattagtttgaatgtagaaagttttctctttttcttgcttttcctctctttctctctctctcttttttaacagccacataatattccattttagggatgtaccttaatttatttagtcttttgtagatggaaatttaggttgtttccagtcttttgctcttctaaatagtgctgcagtacataacattgaatatgcatcaatttgtagatgtgcgggtggacctgcagataaatttccagaagcagaattaccaggtcggggtatacgtgtttgtatttacataatgcttgagcttctgtgatgataatcactctatgaaacattaaaaatcatagcagaactgctggctccttagcccttacattttaaaaatatttttattaatagtacccatcttctttgcattaggagaaacatgaatcacataaaacatgatttttattttatttttaaaatttgtgtgcatcactaagctggaaataaaagttccttattccaggctaaattccctcatccgtagtcagatgcattatccattgcaccagtggcctgtgccctccctaatcctactctttgttttacatcattgtaaaagttacacagacatcttcatatcaaggtgaaattctaaataatactgttaatataacctagataggtagttaactggaatttgatgaaaacatttaaggcttaattttttagactcacaaaagccactgatctttaatgataaacatataccaggatgtgtctaaagaataactcccgccttcttgacacatggcttttctgtgtcttggcatttcatcgcagtactgagcatcctgaaccttgctttgtttgtctctgttgggaatcacaggttgcatccagtctgacccagatttgctctgtaaggcattgtgggggccagagtggaaggctctaagagagggggcaaatgccttttctaaaatgcccttcgttcttataattagagcataaaaatttatgttacatttttctctactaccagtgtaatttaaaagcatctatcaattctctgtatgtgcttcatgttagatttctggtcatatgtttgattttcttcttagaatagtcttgatttcagataatttcaaatctaaagctcaaacaatttcaatttaaaatgtaggcattttcttacagttagagaagtgaaatgttatacttttcgttgcatgcatccggcacatgcgcacatgcgttatagtcttgaatttccataatgatcctgtgaggtggatgtgagctcagccttacagacaggaagacagcctctgaccctccttacatcctcgtggtttttgtcagtcacttcatggaaatcacagtgatttcaaggtgtggtaggacaggatgtgtacccaggcccagctgactccagaggccactctcagtatttcatagcacattgcttctcaagaaacaggtcattgaggaaatgcagatgggtttgtgacttacatttaattttacttatttatattttattgtatcatgtgtaaattatttttcatctggatatcatcacaaaagtgttattgaaggcaacaattgcaaatatatgtgcagtgctttgcacttatacaaagatacaaagatacttacacaaagattgcgtttttcactatttaaagaaattttcagatgaaataccaagttttctgggtctctttggttagtcaagtacttggaagctctgaacagtgattatttaggacacttttcgtaccatttaattgcaagctctcctaatctctgtcagcccttcatctttatgaccttgccttgtctaccagaacacacatccctcttactaaaggtagcattgtgctacaggccctagcagggaatgttttcaggtctgggacccctctaatcaaaactgtcacaaagatgtcattggcacaaacgcgttatttgtcatcactgtctaagcagccctggaactggactctggccacagagatcccttaggagacatgagtccttaccattgccaattgcctgttctgtgggcgatcctaatcgttgaatgcagaacaattaatttatgacatgtgatagtaagcatctgtccaaacttaggaggatataagaagctagtaaaagaggtgggttccaattaattaaaaacaagttgtgtaatgttaaaagttttaatactttggtaatagtctgtgcaatgtaaaatagctattaagctttcaatctgatcaaatgaacacttgtctactagggataatttgatcctagtgtattcacttggaggacaaagttaaattaactaatgattgctttattgcctagcaggatctgatgtgtaaaatgtttctgaaataattttgtctgtagtgtttctgacacaagggctgcggaggaagcatgtgacagcacttactcatatagattatatatatgaagtaaaaacacatagccagaacctgtctttttctgattatagttgctcagttaattttttcttctgcataagaaatcatcttgaatgttcttatgtgacacataaagtggggaaggtggaagataaacatataacccattggattctcttttccaatatctagattagatcctgtgctgaaaaagaaaccaagaaaaaagatgacattccagaagaagacaaaggaaatgtaaaacaatgtgaaatcaattatgtgtatgtatgcttttccttttagacctacagatttgacagtgaagtgcttctcaaagtgctttcaaaataaattacctaattagctggggatggtgttgcatgcctgtaggcccagctactcaggaggctgagacaggaggattgtttgagcccaggagttcaaggctgcagtgacctctgatcaccactgtattccagcctgggtgacagagcaagaccgtgtctgaaaaaatgaaaactgatagacaagaagaggcaacacaatgtagcctctaggacagagcactgagctaaatgcttttcttgaggtttcaggtttcctaatcatcctaccagctcccaaagctagtcacttgggttagtcaatctctctattcattcatagaatgggcgtgatgccagtcaaaggctgtgctatggtcaggacagaggggactccagccagcatgccctaatagaagtggggccttctgctacccagtcaatgagtggccctcctcttgagaggtcatgaaggtcatctttgttgttcaaaagctccagcttattaaaaaaatacaattagactttttttttctcccccaagacagagtctcactctgtcccccagactggagtgcagtgccactatctcggctcattgcaacctctgcctcccaggttcatgtgattctcctgcctcagcctcccgagtagctgggactacaggcacgcgccactacgctcggctaatttttgtatttttagtagagacggggtttcaccatgttggccaggctgttctcaaactcctgacctcgagtgatctgcctgccttggcctcccaaagtgctgggattgcaggcatgagccactgcacctggcctacagttagacttttttaataagtgaaaaaagaaattaacagtatttataaatttaatagtaaatatgtgtaatcagagtttgaggtatttttcaatgaagacattttctttgcagaaagaaatttcagagcttccaagaccacaaacttaaaataagtaaagaagagagtaaaattcttaaaaaggctcagaaagatggatttttgcatgagacgcttctggacaggtagctatttatttacttattttcactattttcagtagctaatagaaatggcatgtagaaaacctatattctcttaaattactgtagttttcacatttttgtctttatttataatttatgagtgtggcaatattacctagagaggacatcatgagtttgggaaaagactgtcaagaaagaatatctaaaaattataaccgattataagtatatactttaagaaattcaggtttgactgtatctacttcataaatttatcattatctttttataactattagaaccagagttagaaagaagcagtttgactaatataaaaattctgtggattctgttagagtagttcatgttccttaaaataagcatagatcaactaaaaaactaagtataaaagctaaacaagtgaaattgaagcagttttattgtaagatttggaagagtgcaggatgtttatcatagcacattattcatatttattactcttcctatgtagataagtaatgtcctagatttacaacatagaaaaacaggtagagacgtttagctgtgagtgtaaaagtataaatcaattaagtgccagattttgataatcaccagccgctcatttaagtcctatgttacaaagttactcttaccctttttttacattacttgataaaggcaatgtttaattacatatttcctgttaactagctggtagagttcatacctaaagtcagtaaataatgttaagaattttttccagctgagcaaatggatatgtatctagttgtaagaaatcaagaagaggatataaaatataatcaggatgtggactctgaaacggaataacctctttgtcctgtaacttttttcacttgtaataatacagcattctcaccctattaaatggaaatttagagcacccttaaattccggaataattaaaattgctatttggattgaaaaagcccttaggcaatatttattgaatattaggaaataacttttataagattagaatccattttttatagaaaccaaatttaaaagtatacatattttaatatgtgttgtggtaatacaataaccacaattgaacacacagttttaaagctttttatatttagtagcagttgaatatatatggcatgttttacatagattaattttactatttttctttgtttaaacaagagaaccaaattgaaagccgacagatactgcaaatgactggaatttttgtttctgccttatctttttgtgttttttttttctgaataaaatattcagaggaaatgctttta

SEQ ID NO: 2245 - DNA, 556 bp, Homo sapiens
tcaactttggaagcacagatcataatataaaaataaagcaaagatcccagaaatatttaacagacaacgaatctttcacatcatcttactatagcaactaaacatataataacttagaatgatccattaattataaataaagaataaattcttttacaaagcataactattaatattattgaccatcataagagcaaatattttaagtaaaacaccataaatactttacagaaaggagcgagttgcagacacagtcattcttggatttctttcaacaccaggctttcttcccttttgacctgaactgggagttgaatattgcctctctttgccttctgaccctctagtctctgaaacatcttttgtactagaggtatgtgcagagacttcctggaaatttggatttgtaaattgtgctgttgtatcttctaggcactgcagtgatccagatatagagctgttgctcttgcttgtataattgtaacattttgattcaaaaaaggaagtaaaaggaagagttgattaaatttggctactgacattaataataataaat

SEQ ID NO: 2246 - DNA, 931 bp, Homo sapiens
catggagaataggaataacatgacagagtttgttttgctggggcttacagagaatccaaagatgcagaaaatcatatttgttgtgttttttgtcatctatatcatcactgtggtgggatatgtgctcattgtggtcaccatcactgccagcccatcactggggtcccccatgtacctttccctggcctatctctcctttattgatgcctgctattcctctgtcaatacccctaacctgatcacacattcactctatggaaagaaggccatcctattcaatggatgcatgactcaagtctttggagaacatttcttcggaggtgcagagggcatcctacttactgtgatggcctatgaccactatgtggccatctgcaagcccttgcactatatgactatcatgaaccagtgtgtgtgtgccctgctaatgggagtggtgtggatgggaggctttcttcatgcaaccatacagatcctcttcatcttccaattacctttctgtggtcctaatgtcatagatcactttatgtgtgatctgaaccctttgctcaacctcgcctgcactgacacccatatgctggaactcttcattgctgccaacagtggattcatctgcttgttaaactttgccctcctgctggtctcctatgtggtcatcttgtgctccctaaggactcatagcttggaggcaaggcacaaagccctctccacctgtgtctcccacatcacggttgtcatcttattctttgtgccctgcatatttgtgtacatgagacctgcagctactttacctattgataaagcagttgctatattctacactatgataactcctatgttaaaccccttaatctataccttgaagaatgcccagatgaaaaatgccatcaggaaattgtgtagtagaaaggacatttcaggtgacaaataa
